(12) United States Patent
Cutcliffe et al.

(10) Patent No.: US 11,583,558 B2
(45) Date of Patent: Feb. 21, 2023

(54) METHODS AND COMPOSITIONS FOR TREATMENT OF MICROBIOME-ASSOCIATED DISORDERS

(71) Applicant: Pendulum Therapeutics, Inc., San Francisco, CA (US)

(72) Inventors: Colleen Cutcliffe, Menlo Park, CA (US); John S. Eid, San Francisco, CA (US); Tomer Altman, San Francisco, CA (US); Orville G. Kolterman, La Jolla, CA (US); James H. Bullard, San Francisco, CA (US)

(73) Assignee: PENDULUM THERAPEUTICS, INC., San Francisco, CA (US)

( * ) Notice: Subject to any disclaimer, the term of this patent is extended or adjusted under 35 U.S.C. 154(b) by 222 days.

(21) Appl. No.: 16/804,285

(22) Filed: Feb. 28, 2020

(65) Prior Publication Data

US 2020/0268811 A1 Aug. 27, 2020

Related U.S. Application Data

(63) Continuation of application No. PCT/US2018/048955, filed on Aug. 30, 2018.

(60) Provisional application No. 62/551,983, filed on Aug. 30, 2017.

(51) Int. Cl.
| | | |
|---|---|---|
| A61K 35/74 | (2015.01) | |
| A61P 25/22 | (2006.01) | |
| A61K 9/28 | (2006.01) | |
| A61K 31/733 | (2006.01) | |

(52) U.S. Cl.
CPC ............... *A61K 35/74* (2013.01); *A61K 9/28* (2013.01); *A61K 31/733* (2013.01); *A61P 25/22* (2018.01); *C12Y 207/02007* (2013.01)

(58) Field of Classification Search
None
See application file for complete search history.

(56) References Cited

U.S. PATENT DOCUMENTS

| | | |
|---|---|---|
| 3,625,214 A | 12/1971 | Higuchi |
| 4,789,734 A | 12/1988 | Pierschbacher |
| 4,897,268 A | 1/1990 | Tice et al. |
| 4,906,474 A | 3/1990 | Langer et al. |
| 4,925,673 A | 5/1990 | Steiner et al. |
| 5,075,109 A | 12/1991 | Tice et al. |
| 5,143,845 A | 9/1992 | Masuda et al. |
| 5,443,826 A | 8/1995 | Borody |
| 5,744,134 A | 4/1998 | Paul |
| 5,811,128 A | 9/1998 | Tice et al. |
| 5,814,344 A | 9/1998 | Tice et al. |
| 5,820,883 A | 10/1998 | Tice et al. |
| 5,853,763 A | 12/1998 | Tice et al. |
| 5,928,647 A | 7/1999 | Rock |
| 5,942,252 A | 8/1999 | Tice et al. |
| 6,028,098 A | 2/2000 | Goodman et al. |
| 6,241,983 B1 | 6/2001 | Paul et al. |
| 6,479,051 B1 | 11/2002 | Bruce et al. |
| 6,926,891 B1 | 8/2005 | Neeser et al. |
| 6,960,341 B2 | 11/2005 | Viscomi et al. |
| 7,033,764 B2 | 4/2006 | Korlach et al. |
| 7,052,847 B2 | 5/2006 | Korlach et al. |
| 7,056,661 B2 | 6/2006 | Korlach et al. |
| 7,056,676 B2 | 6/2006 | Korlach et al. |
| 7,101,565 B2 | 9/2006 | Monte |
| 7,183,101 B2 | 2/2007 | Arigoni et al. |
| 7,195,906 B2 | 3/2007 | Collins et al. |
| 7,307,062 B2 | 12/2007 | Bolte |
| 7,550,285 B2 | 6/2009 | Schiffrin et al. |
| 7,785,581 B2 | 8/2010 | Cui |
| 7,862,808 B2 | 1/2011 | Isolauri et al. |
| 7,947,482 B2 | 5/2011 | Molin et al. |
| 7,988,960 B2 | 8/2011 | Isolauri et al. |
| 8,192,733 B2 | 6/2012 | Cobb et al. |
| 8,329,672 B2 | 12/2012 | Rull Prous et al. |
| 8,343,482 B2 | 1/2013 | Bergonzelli et al. |
| 8,460,648 B2 | 6/2013 | Borody |
| 8,478,544 B2 | 7/2013 | Colwell et al. |
| 8,501,169 B2 | 8/2013 | Sanz Herranz et al. |
| 8,529,887 B2 | 9/2013 | Schiffrin |
| 8,557,233 B2 | 10/2013 | Macsharry et al. |
| 8,709,398 B2 | 4/2014 | Macsharry et al. |
| 8,728,794 B2 | 5/2014 | Miwa et al. |
| 8,734,783 B2 | 5/2014 | Mogna et al. |
| 8,802,179 B2 | 8/2014 | Miller |
| 8,906,668 B2 | 12/2014 | Henn et al. |

(Continued)

FOREIGN PATENT DOCUMENTS

| | | |
|---|---|---|
| AU | 2012302364 A1 | 4/2014 |
| CA | 2851602 A1 | 3/2013 |

(Continued)

OTHER PUBLICATIONS

Abrahamsson, et al. Low Diversity of the Gut Microbiota in Infants with Atopic Eczema. J Allergy Clin. Immunol. 2012; 129:434-40.
Agarwal, et al. The current and future state of companion diagnostics. Pharmgenomics Pers Med. Mar. 31, 2015;8:99-110. doi: 10.2147/PGPM.S49493. eCollection 2015.
Alger, et al. Multisite, multimodal neuroimaging of chronic urological pelvic pain: Methodology of the MAPP Research Network. Neuroimage Clin. Jan. 6, 2016;12:65-77. doi: 10.1016/j.nicl.2015.12.009. eCollection 2016.

(Continued)

*Primary Examiner* — Brian Gangle
(74) *Attorney, Agent, or Firm* — Brian E. Davy; Ypsita Demunshi; Bozicevic, Field & Francis LLP

(57) ABSTRACT

Disclosed herein are methods and compositions for treatment of a microbiome associated disorder. Further, disclosed herein are methods and compositions for modulating short chain fatty acid production in a subject.

15 Claims, 16 Drawing Sheets

Specification includes a Sequence Listing.

(56) References Cited

U.S. PATENT DOCUMENTS

| | | |
|---|---|---|
| 8,951,512 B2 | 2/2015 | Blaser et al. |
| 9,011,834 B1 | 4/2015 | Mckenzie et al. |
| 9,028,841 B2 | 5/2015 | Henn et al. |
| 9,040,101 B2 | 5/2015 | Heiman et al. |
| 9,168,275 B2 | 10/2015 | Finegold |
| 9,173,910 B2 | 11/2015 | Kaplan et al. |
| 9,180,147 B2 | 11/2015 | Mckenzie et al. |
| 9,192,179 B2 | 11/2015 | Roughead et al. |
| 9,192,554 B2 | 11/2015 | Guitard et al. |
| 9,259,447 B2 | 2/2016 | Burcelin et al. |
| 9,314,489 B2 | 4/2016 | Kelly et al. |
| 9,339,055 B2 | 5/2016 | Fujiwara et al. |
| 9,386,793 B2 | 7/2016 | Blaser et al. |
| 9,408,872 B2 | 8/2016 | Borody |
| 9,415,079 B2 | 8/2016 | Honda et al. |
| 9,421,230 B2 | 8/2016 | Honda et al. |
| 9,433,650 B2 | 9/2016 | Nieuwdorp et al. |
| 9,433,652 B2 | 9/2016 | Honda et al. |
| 9,439,933 B2 | 9/2016 | Masuoka et al. |
| 9,443,652 B2 | 9/2016 | Yoon et al. |
| 9,446,080 B2 | 9/2016 | Mckenzie et al. |
| 9,463,169 B2 | 10/2016 | Heiman et al. |
| 9,486,487 B2 | 11/2016 | Cutcliffe et al. |
| 9,493,737 B2 | 11/2016 | Georgieva et al. |
| 9,533,014 B2 | 1/2017 | Henn et al. |
| 9,572,841 B2 | 2/2017 | Borody |
| 9,585,921 B2 | 3/2017 | Mckenzie et al. |
| 9,603,876 B2 | 3/2017 | Blaser et al. |
| 9,623,055 B2 | 4/2017 | Nieuwdorp et al. |
| 9,623,056 B2 | 4/2017 | Borody |
| 9,642,881 B2 | 5/2017 | Honda et al. |
| 9,642,882 B2 | 5/2017 | Honda et al. |
| 9,644,210 B2 | 5/2017 | Schrezenmeir |
| 9,649,345 B2 | 5/2017 | Honda et al. |
| 9,649,346 B2 | 5/2017 | Klapper |
| 9,668,991 B1 | 6/2017 | Cahan |
| 9,668,992 B1 | 6/2017 | Cahan |
| 9,688,967 B2 | 6/2017 | Falb et al. |
| 9,710,606 B2 | 7/2017 | Apte et al. |
| 9,771,624 B2 | 9/2017 | Van Sinderen et al. |
| 9,833,484 B2 | 12/2017 | Mogna et al. |
| 10,149,867 B2 | 12/2018 | Kaplan et al. |
| 10,149,870 B2 | 12/2018 | Kaplan et al. |
| 10,668,116 B2 | 6/2020 | Cutcliffe et al. |
| 10,675,312 B2 | 6/2020 | Cutcliffe et al. |
| 10,729,732 B2 | 8/2020 | Kaplan et al. |
| 10,767,156 B2 | 9/2020 | Sorek et al. |
| 10,842,830 B2 | 11/2020 | Cutcliffe et al. |
| 10,842,831 B2 | 11/2020 | Cutcliffe et al. |
| 10,864,235 B2 | 12/2020 | Henn et al. |
| 11,213,556 B2 | 1/2022 | Cutcliffe et al. |
| 2002/0013270 A1 | 1/2002 | Bolte |
| 2004/0170617 A1 | 9/2004 | Finegold |
| 2005/0112112 A1 | 5/2005 | Park et al. |
| 2006/0115465 A1 | 6/2006 | Macfarlane et al. |
| 2007/0014756 A1 | 1/2007 | Touchot |
| 2007/0258953 A1 | 11/2007 | Duncan et al. |
| 2008/0038240 A1 | 2/2008 | Farmer et al. |
| 2008/0069861 A1 | 3/2008 | Brown et al. |
| 2008/0145341 A1 | 6/2008 | Myatt et al. |
| 2008/0182318 A1 | 7/2008 | Vanzin |
| 2008/0286252 A1 | 11/2008 | Sinnott |
| 2008/0311640 A1 | 12/2008 | Cox et al. |
| 2009/0010891 A1 | 1/2009 | Masuda et al. |
| 2009/0010892 A1 | 1/2009 | Masuda et al. |
| 2009/0010981 A1 | 1/2009 | Bechert et al. |
| 2009/0169531 A1 | 7/2009 | Lacoste et al. |
| 2009/0252708 A1 | 10/2009 | Fitzpatrick et al. |
| 2010/0086528 A1 | 4/2010 | Olofsson et al. |
| 2010/0086981 A1 | 4/2010 | Latouf et al. |
| 2010/0087481 A1 | 4/2010 | Lee |
| 2010/0172874 A1 | 7/2010 | Turnbaugh et al. |
| 2010/0215738 A1 | 8/2010 | Ritter et al. |
| 2010/0284979 A1 | 11/2010 | O'Mahony et al. |
| 2010/0331641 A1 | 12/2010 | Bangera et al. |
| 2011/0081320 A1 | 4/2011 | Westall et al. |
| 2011/0287072 A1 | 11/2011 | Ritter et al. |
| 2012/0107291 A1 | 5/2012 | Burcelin et al. |
| 2012/0129794 A1 | 5/2012 | Dowd et al. |
| 2012/0165792 A1 | 6/2012 | Ortiz et al. |
| 2012/0183513 A1 | 7/2012 | Neu et al. |
| 2012/0183514 A1 | 7/2012 | Mercenier et al. |
| 2012/0230956 A1 | 9/2012 | Mclean et al. |
| 2012/0238468 A1 | 9/2012 | Tuk et al. |
| 2013/0005586 A1 | 1/2013 | Ehrlich |
| 2013/0045874 A1 | 2/2013 | Ehrlich |
| 2013/0121968 A1 | 5/2013 | Quay |
| 2013/0143288 A1 | 6/2013 | Mullin et al. |
| 2013/0266539 A1 | 10/2013 | Borody |
| 2013/0280225 A1 | 10/2013 | Faure et al. |
| 2013/0296165 A1 | 11/2013 | Harel et al. |
| 2014/0037688 A1 | 2/2014 | Berkes et al. |
| 2014/0073610 A1 | 3/2014 | Ekwuribe |
| 2014/0079676 A1 | 3/2014 | Olmstead |
| 2014/0093478 A1 | 4/2014 | Turnbaugh et al. |
| 2014/0135398 A1 | 5/2014 | Matar et al. |
| 2014/0147417 A1 | 5/2014 | Sadowsky et al. |
| 2014/0286920 A1 | 9/2014 | Mayra-Makinen et al. |
| 2014/0341921 A1 | 11/2014 | Honda et al. |
| 2014/0363397 A1 | 12/2014 | Allen-Vercoe et al. |
| 2015/0209383 A1 | 7/2015 | Boileau et al. |
| 2015/0218507 A1 | 8/2015 | Georgieva et al. |
| 2015/0232801 A1 | 8/2015 | Yde et al. |
| 2015/0246081 A1 | 9/2015 | Morris |
| 2015/0258151 A1 | 9/2015 | Mani et al. |
| 2015/0259728 A1 | 9/2015 | Cutcliffe et al. |
| 2015/0306152 A1 | 10/2015 | Cani et al. |
| 2015/0320808 A1 | 11/2015 | Burcelin et al. |
| 2015/0374760 A1 | 12/2015 | Scher et al. |
| 2016/0000838 A1 | 1/2016 | Harmsen et al. |
| 2016/0030494 A1 | 2/2016 | Henn et al. |
| 2016/0040215 A1 | 2/2016 | Henn et al. |
| 2016/0108442 A1 | 4/2016 | Adelstein et al. |
| 2016/0143961 A1 | 5/2016 | Berry et al. |
| 2016/0143962 A1 | 5/2016 | Berry et al. |
| 2016/0151432 A1 | 6/2016 | Borody |
| 2016/0151433 A1 | 6/2016 | Borody |
| 2016/0158294 A1 | 6/2016 | Von Maltzahn et al. |
| 2016/0193258 A1 | 7/2016 | Berry et al. |
| 2016/0199424 A1 | 7/2016 | Berry et al. |
| 2016/0232311 A1 | 8/2016 | Segal et al. |
| 2016/0232319 A1 | 8/2016 | Apte et al. |
| 2016/0243172 A1 | 8/2016 | Cook et al. |
| 2016/0243175 A1 | 8/2016 | Bushman et al. |
| 2016/0263144 A1 | 9/2016 | O'Hara et al. |
| 2016/0263153 A1 | 9/2016 | O'Hara |
| 2016/0263166 A1 | 9/2016 | Elinav et al. |
| 2016/0271188 A1 | 9/2016 | Berry et al. |
| 2016/0271189 A1 | 9/2016 | Cutcliffe et al. |
| 2016/0271190 A1 | 9/2016 | O'Hara et al. |
| 2016/0271191 A1 | 9/2016 | O'Hara |
| 2016/0287645 A1 | 10/2016 | O'Hara |
| 2016/0317432 A1 | 11/2016 | Garcia-Garcia et al. |
| 2016/0317653 A1 | 11/2016 | Cook et al. |
| 2016/0342735 A1 | 11/2016 | Apte et al. |
| 2016/0354417 A1 | 12/2016 | Smittle et al. |
| 2016/0354418 A1 | 12/2016 | Quintens et al. |
| 2016/0354509 A1 | 12/2016 | Parlato et al. |
| 2016/0355847 A1 | 12/2016 | Liu et al. |
| 2016/0367661 A1 | 12/2016 | Flavell et al. |
| 2016/0375068 A1 | 12/2016 | Borody |
| 2017/0000834 A1 | 1/2017 | Klosterbuer et al. |
| 2017/0007691 A1 | 1/2017 | Honda et al. |
| 2017/0020932 A1 | 1/2017 | Cutcliffe et al. |
| 2017/0027876 A1 | 2/2017 | Caillard |
| 2017/0042860 A1 | 2/2017 | Kashyap et al. |
| 2017/0058270 A1 | 3/2017 | Garcia-Garcia et al. |
| 2017/0067065 A1 | 3/2017 | Falb et al. |
| 2017/0080015 A1 | 3/2017 | Heiman et al. |
| 2017/0095517 A1 | 4/2017 | Mayra et al. |
| 2017/0101484 A1 | 4/2017 | Naeye et al. |
| 2017/0106026 A1 | 4/2017 | Kovarik |
| 2017/0112915 A1 | 4/2017 | Honda et al. |
| 2017/0119828 A1 | 5/2017 | Nakamura et al. |

(56) References Cited

U.S. PATENT DOCUMENTS

| | | | |
|---|---|---|---|
| 2017/0143774 A1 | 5/2017 | Mulder et al. |
| 2017/0151290 A1 | 6/2017 | Blaser et al. |
| 2017/0151291 A1 | 6/2017 | Henn et al. |
| 2017/0157034 A1 | 6/2017 | Klapper |
| 2017/0165201 A1 | 6/2017 | Anselmo et al. |
| 2017/0165302 A1 | 6/2017 | Henn et al. |
| 2017/0273997 A1 | 9/2017 | Sakwinska et al. |
| 2017/0304375 A1 | 10/2017 | Kyle et al. |
| 2017/0312232 A1 | 11/2017 | Vitetta et al. |
| 2018/0094233 A1 | 4/2018 | Belzer et al. |
| 2018/0357375 A1 | 12/2018 | Cutcliffe et al. |
| 2019/0030096 A1 | 1/2019 | Cutcliffe et al. |
| 2019/0038678 A1 | 2/2019 | De |
| 2019/0046590 A1 | 2/2019 | Kaplan et al. |
| 2019/0070227 A1 | 3/2019 | Cutcliffe et al. |
| 2019/0070228 A1 | 3/2019 | Cutcliffe et al. |
| 2020/0121733 A1 | 4/2020 | Kaplan et al. |
| 2020/0121734 A1 | 4/2020 | Kaplan et al. |
| 2020/0121735 A1 | 4/2020 | Kaplan et al. |
| 2020/0121736 A1 | 4/2020 | Kaplan et al. |
| 2020/0121738 A1 | 4/2020 | Cutcliffe et al. |
| 2020/0237835 A1 | 7/2020 | Kaplan et al. |
| 2020/0246395 A1 | 8/2020 | Kaplan et al. |
| 2020/0261517 A1 | 8/2020 | Cutcliffe et al. |
| 2020/0345796 A1 | 11/2020 | Cutcliffe et al. |
| 2021/0386798 A1 | 12/2021 | Cutcliffe et al. |

FOREIGN PATENT DOCUMENTS

| | | | |
|---|---|---|---|
| CN | 101410128 A | 4/2009 | |
| CN | 102448477 A | 5/2012 | |
| CN | 102458415 A | 5/2012 | |
| CN | 104244733 A | 12/2014 | |
| CN | 105030841 A | 11/2015 | |
| CN | 105106245 A | 12/2015 | |
| EP | 0456418 A2 | 11/1991 | |
| EP | 0446069 B1 | 9/1993 | |
| EP | 0456418 B1 | 9/1996 | |
| EP | 1600060 A1 | 11/2005 | |
| EP | 1359924 B1 | 10/2007 | |
| EP | 2030623 A1 | 3/2009 | |
| EP | 2439264 A1 | 4/2012 | |
| EP | 2442814 A2 | 4/2012 | |
| EP | 2318513 B1 | 9/2012 | |
| EP | 1680501 B1 | 12/2012 | |
| EP | 2117567 B1 | 6/2014 | |
| EP | 2753187 A1 | 7/2014 | |
| EP | 2836224 A2 | 2/2015 | |
| EP | 2766026 A4 | 5/2015 | |
| EP | 2789340 A4 | 7/2015 | |
| EP | 2556835 B1 | 8/2015 | |
| EP | 2919796 A1 | 9/2015 | |
| EP | 2951285 A1 | 12/2015 | |
| EP | 2953472 A1 | 12/2015 | |
| EP | 2953474 A2 | 12/2015 | |
| EP | 2956006 A2 | 12/2015 | |
| EP | 2988761 A1 | 3/2016 | |
| EP | 3052111 A1 | 8/2016 | |
| EP | 3058085 A2 | 8/2016 | |
| EP | 3074027 A1 | 10/2016 | |
| EP | 3102670 A4 | 7/2017 | |
| EP | 3223834 A2 | 10/2017 | |
| EP | 3135754 A4 | 12/2017 | |
| FR | 2874825 A1 | 3/2006 | |
| JP | H08298982 A | 11/1996 | |
| JP | 2006314219 A | 11/2006 | |
| JP | 2007031291 A | 2/2007 | |
| JP | 5019563 B2 | 9/2012 | |
| JP | 2014527068 A | 10/2014 | |
| JP | 2015537042 A | 12/2015 | |
| JP | 2017535597 A | 11/2017 | |
| KR | 20140128936 A | 11/2014 | |
| KR | 20200040277 A | 4/2020 | |
| RU | 2014112223 A | 10/2015 | |
| WO | WO-199001335 A1 | 2/1990 | |
| WO | WO-0015760 A1 | 3/2000 | |
| WO | WO-0188095 A1 | 11/2001 | |
| WO | WO-0193904 A1 | 12/2001 | |
| WO | WO-0197822 A1 | 12/2001 | |
| WO | WO-0207741 A1 | 1/2002 | |
| WO | WO-03070203 A1 | 8/2003 | |
| WO | WO-2004085628 A1 | 10/2004 | |
| WO | WO-2005055934 A2 | 6/2005 | |
| WO | WO-2006000992 A1 | 1/2006 | |
| WO | WO-2006013441 A2 | 2/2006 | |
| WO | WO-2007046697 A1 | 4/2007 | |
| WO | WO-2007046699 A2 | 4/2007 | |
| WO | WO-2007125566 A2 | 11/2007 | |
| WO | WO-2008076696 A2 | 6/2008 | |
| WO | WO-2009018447 A2 | 2/2009 | |
| WO | WO-2009024429 A2 | 2/2009 | |
| WO | WO-2009077352 A1 | 6/2009 | |
| WO | WO-2009153662 A1 | 12/2009 | |
| WO | WO-2010036876 A2 | 4/2010 | |
| WO | WO-2010108865 A1 | 9/2010 | |
| WO | WO-2010146568 A2 | 12/2010 | |
| WO | WO-2011043654 A1 | 4/2011 | |
| WO | WO-2010146568 A3 | 5/2011 | |
| WO | WO-2011096809 A1 | 8/2011 | |
| WO | WO-2011099514 A1 | 8/2011 | |
| WO | WO-2011135194 A2 | 11/2011 | |
| WO | WO-2012021678 A2 | 2/2012 | |
| WO | WO-2012024638 A2 | 2/2012 | |
| WO | WO-2012033814 A2 | 3/2012 | |
| WO | WO-2012089782 A1 | 7/2012 | |
| WO | WO-2012122478 A1 | 9/2012 | |
| WO | WO-2012142605 A1 | 10/2012 | |
| WO | WO-2013032328 A1 | 3/2013 | |
| WO | WO-2013050792 A1 | 4/2013 | |
| WO | WO-2013050833 A1 | 4/2013 | |
| WO | WO-2013107913 A1 | 7/2013 | |
| WO | WO-2013130773 A2 | 9/2013 | |
| WO | WO-2013175038 A1 | 11/2013 | |
| WO | WO-2013191845 A1 | 12/2013 | |
| WO | WO-2014011233 A1 | 1/2014 | |
| WO | WO-2014070014 A1 | 5/2014 | |
| WO | WO-2014075745 A1 | 5/2014 | |
| WO | WO-2014076246 A1 | 5/2014 | |
| WO | WO-2014082050 A1 | 5/2014 | |
| WO | WO-2014121298 A2 | 8/2014 | |
| WO | WO-2014121301 A1 | 8/2014 | |
| WO | WO-2014121302 A2 | 8/2014 | |
| WO | WO-2014121304 A1 | 8/2014 | |
| WO | WO-2014137211 A1 | 9/2014 | |
| WO | WO-2014145958 A2 | 9/2014 | |
| WO | WO-2014151565 A1 | 9/2014 | |
| WO | WO-2014152338 A1 * | 9/2014 | ................ A61P 1/10 |
| WO | WO-2014153194 A2 | 9/2014 | |
| WO | WO-2014121302 A3 | 10/2014 | |
| WO | WO-2014201037 A2 | 12/2014 | |
| WO | WO-2014153194 A4 | 1/2015 | |
| WO | WO-2015013214 A2 | 1/2015 | |
| WO | WO-2015051323 A1 | 4/2015 | |
| WO | WO-2015059690 A1 | 4/2015 | |
| WO | WO-2015067936 A1 | 5/2015 | |
| WO | WO-2015067938 A1 | 5/2015 | |
| WO | WO-2015067947 A1 | 5/2015 | |
| WO | WO-2015067948 A1 | 5/2015 | |
| WO | WO-2015067949 A1 | 5/2015 | |
| WO | WO-2015077794 A1 | 5/2015 | |
| WO | WO-2015088227 A1 | 6/2015 | |
| WO | WO-2015095241 A2 | 6/2015 | |
| WO | WO-2015131076 A1 | 9/2015 | |
| WO | WO-2015166489 A2 | 11/2015 | |
| WO | WO-2015166492 A2 | 11/2015 | |
| WO | WO-2015095241 A4 | 12/2015 | |
| WO | WO-2015189472 A1 | 12/2015 | |
| WO | WO-2016013921 A2 | 1/2016 | |
| WO | WO-2016065419 A1 | 5/2016 | |
| WO | WO-2016070151 A1 * | 5/2016 | ........... A23L 33/135 |
| WO | WO-2016079731 A2 | 5/2016 | |
| WO | WO-2016084029 A1 | 6/2016 | |
| WO | WO-2016110585 A1 | 7/2016 | |
| WO | WO-2016118730 A1 | 7/2016 | |

(56) References Cited

FOREIGN PATENT DOCUMENTS

| | | |
|---|---|---|
| WO | WO-2016139217 A1 | 9/2016 |
| WO | WO-2016149149 A1 | 9/2016 |
| WO | WO-2016149687 A1 | 9/2016 |
| WO | WO-2016174677 A1 | 11/2016 |
| WO | WO-2016176380 A1 | 11/2016 |
| WO | WO-2016177797 A1 | 11/2016 |
| WO | WO-2016177801 A1 | 11/2016 |
| WO | WO-2016185469 A1 | 11/2016 |
| WO | WO-2016186243 A1 | 11/2016 |
| WO | WO-2016194427 A1 | 12/2016 |
| WO | WO-2016196440 A1 | 12/2016 |
| WO | WO-2016201053 A1 | 12/2016 |
| WO | WO-2017009187 A1 | 1/2017 |
| WO | WO-2017019273 A1 | 2/2017 |
| WO | WO-2017024237 A1 | 2/2017 |
| WO | WO-2017032897 A1 | 3/2017 |
| WO | WO-2017035188 A1 | 3/2017 |
| WO | WO-2017035412 A1 | 3/2017 |
| WO | WO-2017041039 A1 | 3/2017 |
| WO | WO-2017042347 A1 | 3/2017 |
| WO | WO-2017047968 A1 | 3/2017 |
| WO | WO-2017060468 A1 | 4/2017 |
| WO | WO-2017060698 A1 | 4/2017 |
| WO | WO-2017063066 A1 | 4/2017 |
| WO | WO-2017075098 A1 | 5/2017 |
| WO | WO-2017079450 A1 | 5/2017 |
| WO | WO-2017091783 A2 | 6/2017 |
| WO | WO-2017097987 A1 | 6/2017 |
| WO | WO-2017102816 A1 | 6/2017 |
| WO | WO-2017130859 A1 | 8/2017 |
| WO | WO-2017134240 A1 | 8/2017 |
| WO | WO-2017159643 A1 | 9/2017 |
| WO | WO-2018106844 A1 | 6/2018 |
| WO | WO-2019046646 A1 | 3/2019 |

OTHER PUBLICATIONS

Allen, et al. Probiotic May Help Alleviate Stress-Related Conditions. Society for Neuroscience (SfN) 2015 Annual Meeting. Abstract 162.04. Presented Oct. 18, 2015.

Allin, et al. Aberrant intestinal microbiota in individuals with prediabetes. Diabetologia. Jan. 29, 2018. doi: 10.1007/s00125-018-4550-1. [Epub ahead of print].

Amar, et al. (2011). Intestinal mucosal adherence and translocation of commensal bacteria at the early onset of type 2 diabetes: molecular mechanisms and probiotic treatment. EMBO Mol. Med. 3, 559-572. doi: 10.1002/emmm. 201100159.

American Chemical Society. "No guts no glory: Harvesting the microbiome of athletes." ScienceDaily. ScienceDaily, Aug. 20, 2017. www.sciencedaily.com/releases/2017/08/170820075017.htm.

Angelakis, et al. The relationship between gut microbiota and weight gain in humans. Future Microbiol. Jan. 2012;7(1):91-109. doi: 10.2217/fmb.11.142.

Anonymous. Allergies; New findings from Hokkaido University describe advances in allergies. Clinical Trials Week [Atlanta] (Mar. 22, 2010): 42.

Anonymous. Clostridium; New Clostridium data have been reported by scientists at Ghent University. Science Letter [Atlanta] (Aug. 17, 2010): 1811.

Anonymous. Nutrition; Research on nutrition detailed by scientists at Institute of Agrochemistry and Food Technology. Obesit, Fitness & Wellness Week [Atlanta] (Jul. 17, 2010): 2819.

Ansel, Howard C, et al. Pharmaceutical Dosage Forms and Drug Delivery Systems. Philadelphia, PA: Lippincott-Williams & Wilkins, 1999. Print.

Arora, et al., Propionate Anti-Obesity and Satiety Enhancing Factor? Appetite, Apr. 2011, 56(2):511-5.

Asano, et al. Critical role of gut microbiota in the production of biologically active, free catecholamines in the gut lumen of mice. Am J Physiol Gastrointest Liver Physiol. Dec. 1, 2012;303(11):G1288-95. doi: 10.1152/ajpgi.00341.2012. Epub Oct. 11, 2012.

ATCC Catalogue, accessed Dec. 14, 2017. https://www.atcc.org/Search_Results.aspx?dsNav=Ntk:PrimarySearch%07cClostridium+beijerinckii%07c3')/07c,Ny:True,Rpp:100,N :1000552&searchTerms=Clostridium+beijerinckii&redir=1.

Athauda, et al. Exenatide once weekly versus placebo in Parkinson's disease: a randomised, double-blind, placebo-controlled trial. Lancet. Aug. 3, 2017. pii: S0140-6736(17)31585-4. doi: 10.1016/S0140-6736(17)31585-4. [Epub ahead of print].

ATLAS. Handbook of Microbiological Media. Fourth Edition. CRC Press. 2010.

Ausubel, et al. eds. Current Protocols in Molecular Biology. United States. Greene Publishing Associates and Wiley-Interscience. 1987. (Table of Contents).

Axling, et al. Green tea powder and Lactobacillus plantarum affect gut microbiota, lipid metabolism and inflammation in high-fat fed C57BL/6J mice. Nutr Metab (Lond). Nov. 26, 2012;9(1):105. doi: 10.1186/1743-7075-9-105.

Aziz, et al. Changes in gut hormones and fecal bacterial community composition in response to diet-induced obesity in the rat. Obesity, suppl. 1 19 (Nov. 2011): S166-S167.

Bach, et al. The presence of HLA-B27 shapes gut microbiome composition in rats. Arthritis and Rheumatism, suppl. 10 64 (Oct. 2012): S1052-S1053.

Backhed, et al., Mechanisms underlying the resistance to diet-induced obesity in germ-free mice, PNAS, Jan. 16, 2007, 104(3):979-84.

Backhed, et al., The gut microbiota as an environmentalfactor that regulates fat storage, PNAS, Nov. 2, 2004, 101(44):15718-23.

Baffoni, et al. Effect of dietary supplementation of Bifidobacterium and Lactobacillus strains in Apis mellifera L. against Nosema ceranae. Benef Microbes. Nov. 13, 2015:1-8. [Epub ahead of print].

Baker. The role of microorganisms in atopic dermatitis. Clin Exp Immunol. Apr. 2006;144(1):1-9.

Barcenilla, et al. Phylogenetic relationships of butyrate-producing bacteria from the human gut. Appl Environ Microbiol. Apr. 2000. 66(4):1654-61.

Baviera, et al. Microbiota in Healthy Skin and in Atopic Eczema. Hindawi Publishing Corporation, BioMed Research International, vol. 2014.

BD Diagnostics. Media Solutions For Microbial and Molecular Genetics Research Applications. Jul. 2009.

Belenguer, et al. Impact of pH on Lactate Formation and Utilization by Human Fecal Microbial Communities. Appl Environ Microbiol. Oct. 2007; 73(20): 6526-6533. Published online Aug. 31, 2007. doi: 10.1128/AEM.00508-07.

Belenguer, et al. Two routes of metabolic cross-feeding between Bifidobacterium adolescentis and butyrate-producing anaerobes from the human gut. Appl Environ Microbiol. May 2006;72(5):3593-3599. doi: 10.1128/AEM.72.5.3593-3599.2006.

Belzer, et al. (2012). Microbes inside-from diversity to function: the case of Akkermansia. ISME J. 6, 1449-1458. doi: 10.1038/ismej.2012.6.

Ben-Amor, et al. Genetic diversity of viable, injured, and dead fecal bacteria assessed by fluorescence-activated cell sorting and 16S rRNA gene analysis. Appl Environ Microbiol. Aug. 2005;71(8):4679-89. doi: 10.1128/AEM.71.8.4679-4689.2005.

Berridge. 'Liking' and 'wanting' food rewards: brain substrates and roles in eating disorders. Physiol Behav. Jul. 14, 2009;97(5):537-50. doi: 10.1016/j.physbeh.2009.02.044. Epub Mar. 29, 2009.

Berry, et al., Phylotype-level 16S rRNA analysis reveals new bacterial indicators of health state in acute murine colitis, ISME Journal 6.11 (Nov. 2012): 2091-2106.

Beye, et al. Careful use of 16S rRNA gene sequence similarity values for the identification of Mycobacterium species. New Microbes New Infect. Dec. 29, 2017;22:24-29. doi: 10.1016/j.nmni.2017.12.009. eCollection Mar. 2018.

Bick, et al.From research to clinical practice: implementation of functional magnetic imaging and white matter tractography in the clinical environment. J Neurol Sci. Jan. 15, 2012;312(1-2):158-65. doi: 10.1016/j.jns.2011.07.040. Epub Aug. 23, 2011.

Bjelland, et al. The validity of the Hospital Anxiety and Depression Scale. An updated literature review. J Psychosom Res. Feb. 2002;52(2):69-77.

(56) References Cited

OTHER PUBLICATIONS

BMS acquires Amylin Pharmaceuticals, expands diabetes alliance with AstraZeneca. Jul. 2, 2012. 4 pages. http://www.centerwatch.com/news-online/2012/07/02/bms-acquires-amylin-pharmaceuticals-expands-diabetes-alliance-with-astrazeneca/.
Bourassa, et al., Butyrate, neuroepigenetics and the gut microbiome: can a high fiber diet improve brain health, Neuroscience Letters, 2016, 625:56-63.
Bourhis, et al. Contribution of C. beijerinckii and C. sporogenes in association with C. tyrobutyricum to the butyric fermentation in Emmental type cheese. International Journal of Food Microbiology. 113 (2007) 154-163.
Bouter, et al. Differential metabolic effects of oral butyrate treatment in lean versus metabolic syndrome subjects. Clin Transl Gastroenterol. May 25, 2018. 9(5):155. doi: 10.1038/s41424-018-0025-4.
Bowman, et al. Analysis of Full-Length Metagenomic 16S Genes by SMRT Sequencing. American Society for Microbiology 2013 General Meeting May 19, 2013 Poster Session, pp. 116 Poster 390. Available on the internet: http://files.pacb.com/pdf/Analysis_of_Full_Length_Metagenomic_16S_Genes_by_SMRT_Sequencing.pdf.
Bravo, Ingestion of Lactobacillus strain regulates emotional behavior and central GABA receptor expression in a mouse via the vagus nerve. Proc Natl Acad Sci USA. Sep. 20, 2011;108(38):16050-5. Doi: 10.1073/pnas.1102999108. Epub Aug. 29, 2011.
Brown. "Akkermansia: new discoveries from the microbiome", Functional Medicine, Masterclass, Sep. 20, 2014, XP055327009.
Brown et al. Chemical synthesis and cloning of a tyrosine tRNA gene. Methods Enzymol. 68:109-51 (1979).
Brun, et al. (2013). Toll-like receptor 2 regulates intestinal inflammation by controlling integrity of the enteric nervous system. Gastroenterology 145, 1323-1333. doi: 10.1053/j.gastro.2013.08.047.
Bueter; et al, "Gastric Bypass Increases Energy Expenditure in Rats. Gastroenterology", Gastroenterology, Gastroenterology, 2010, 138(5), 1845-1853.
Buhwald et al. (2004), "Bariatric Surgery: A Systematic Review and Meta-Analysis", JAMA, 292(14): 1724-1737.
Burger, et al. A functional neuroimaging review of obesity, appetitive hormones and ingestive behavior. Physiol Behav. Sep. 2014;136:121-7. doi: 10.1016/j.physbeh.2014.04.025. Epub Apr. 21, 2014.
Canani, et al. Potential beneficial effects of butyrate in intestinal and extraintestinal diseases. World J. Gastroenterol., Mar. 28, 2011; 17 (12): 1519-1528.
Candela, et al., Unbalance of intestinal microbiota in atopic children, BMC Microbiology 12 (Jun. 6, 2012).
Cani, et al. (2004). Inulin-type fructans modulate gastrointestinal peptides involved in appetite regulation (glucagon-like peptide-1 and ghrelin) in rats. Br. J. Nutr. 92, 521-526. doi: 10.1079/BJN20041225.
Cani, et al. (2006). Improvement of glucose tolerance and hepatic insulin sensitivity by oligofructose requires a functional glucagon-like peptide 1 receptor. Diabetes Metab. Res. Rev. 55, 1484-1490. doi: 10.2337/db05-1360.
Cani, et al. (2007). Metabolic endotoxemia initiates obesity and insulin resistance. Diabetes Metab. Res. Rev. 56, 1761-1772. doi: 10.2337/db06- 1491.
Cani, et al., Changes in Gut Microbia Control Metabolic Endotoxemia-Induced Inflammation In High-Fat Diet-Induced Obesity And Diabetes In Mice, Diabetes, 2008, 57(6):1470-81.
Cani, et al. (2009). Changes in gut microbiota control inflammation in obese mice through a mechanism involving GLP-2-driven improvement of gut permeability. Gut 58, 1091-1103. doi: 10.1136/gut.2008.165886.
Cani, et al. Involvement of gut microbiota in the development of low-grade inflammation and type 2 diabetes associated with obesity. Gut Microbes. Jul.-Aug. 2012;3(4):279-288. doi: 10.4161/gmic.19625. Epub May 14, 2012.
Cani et al. Next-Generation Beneficial Microbes: The Case of Akkermansia muciniphila. Front Microbiol. Sep. 22, 2017;8:1765. doi: 10.3389/fmicb.2017.01765. eCollection 2017.
Cani. Gut microbiota, low grade inflammation and metabolism. Appetite, suppl. 1 59 Jul. (2012): e11.
Cappelleri, et al. Psychometric analysis of the Three-Factor Eating Questionnaire-R21: results from a large diverse sample of obese and non-obese participants. Int J Obes (Lond). Jun. 2009;33(6):611-20. doi: 10.1038/ijo.2009.74. Epub Apr. 28, 2009.
Caricilli, et al. (2011). Gut microbiota is a key modulator of insulin resistance in TLR 2 knockout mice. PLOS Biol. 9:e1001212. doi: 10.1371/journal.pbio.1001212.
Casellas, et al., Defective Akkermansia Muciniphila in Feces of Ulcerative Colitis Patients, Northern Light Life Sciences Conference Abstracts (Oct. 24, 2011).
Chao, et al. Food cravings, food intake, and weight status in a community-based sample. Eat Behav. Aug. 2014;15(3):478-82. doi: 10.1016/j.eatbeh.2014.06.003. Epub Jun. 18, 2014.
Chen, et al. Bifidobacterium adolescentis supplementation ameliorates visceral fat accumulation and insulin sensitivity in an experimental model of the metabolic syndrome. Br J Nutr. May 2012;107(10):1429-34. doi: 10.1017/S0007114511004491. Epub Sep. 14, 2011.
Chethankumar, et al. Butyric acid modulates activities of intestinal and renal disaccharidases in experimentally induced diabetic rats. Nahrung. Oct. 2002;46(5):345-8. doi: 10.1002/1521-3803(20020901)46:5 345::AID-FOOD3453.0.CO;2-7.
Chia, et al. (2018) "Deciphering the trophic interaction between Akkermansia muciniphila and the butyrogenic gut commensal Anaerostipes caccae using a metatranscriptomic approach," Antonie Van Leeuwenhoek, vol. 111, No. 6, pp. 859-873.
Chin, et al. Nonhybrid, finished microbial genome assemblies from long-read SMRT sequencing data. Nat Methods. Jun. 2013;10(6):563-9. doi: 10.1038/nmeth.2474. Epub May 5, 2013.
Clayton. Metabolic differences underlying two distinct rat urinary phenotypes, a suggested role for gut microbial metabolism of phenylalanine and a possible connection to autism. FEBS Lett. Apr. 5, 2012;586(7):956-61. doi: 10.1016/j.febslet.2012.01.049. Epub Feb. 1, 2012.
Collado, et al. (2007). Intestinal integrity and Akkermansia muciniphila, a mucin-degrading member of the intestinal microbiota present in infants, adults, and the elderly. Appl. Environ. Microbiol. 73, 7767-7770. doi: 10.1128/AEM.01477-07.
Cork, et al. Epidermal Barrier Dysfunction in Atopic Dermatitis. J Invest Dermatol. Aug. 2009;129(8):1892-908. doi: 10.1038/jid.2009.133. Epub Jun. 4, 2009.
Costello, et al. Postprandial remodeling of the gut microbiota in Burmese pythons. ISME J. Nov. 2010;4(11):1375-85. doi: 10.1038/ismej.2010.71. Epub Jun. 3, 2010.
Cryan, et al. Mind-altering microorganisms: the impact of the gut microbiota on brain and behaviour. Nat Rev Neurosci. Oct. 2012;13(10):701-12. doi: 10.1038/nrn3346. Epub Sep. 12, 2012.
Culligan, et al., Functional metagenomics reveals novel salt tolerance loci from the human gut microbiome. ISME Journal 6.10 (Oct. 2012): 1916-1925.
Dailey, et al. Glucagon-like peptide 1 and appetite. Trends Endocrinol Metab. Feb. 2013;24(2):85-91. doi: 10.1016/j.tem.2012.11.008. Epub Jan. 16, 2013.
Database WPI, Week 201371, Thomson Scientific, London, GB; AN 2013-R31140, XP002805741, and CN103131647A (Shanghai Shangyao Pharm Ind, Co, LTD, Jun. 5, 2013.
Database GNPD [Online] MINTEL; Feb. 2015, PharmXcross: "Triple Premium Alive Probiotics", XP002779023, Database accession No. 2898253.
De Filippo, et al., Impact of Diet In Shaping Gut Microbiota Revealed By A Comparative Study In Children From Europe And Rural Africa, PNAS, Aug. 2010, 107(33):14691-6.
De Leoz, et al., Human Milk Glycomics and Gut Microbial Genomics in Infant Feces Show a Correlation between Human Milk Oligosaccharides and Gut Microbiota: A Proof-of-Concept Study, J. Proteome Res., 2015, 14:491-502.

(56) References Cited

OTHER PUBLICATIONS

De Vadder, et al. Microbiota-generated metabolites promote metabolic benefits via gut-brain neural circuits. Cell. Jan. 16, 2014;156(1-2):84-96. doi: 10.1016/j.cell.2013.12.016. Epub Jan. 9, 2014.
Declaration of Interference, Patent Interference No. 106,130, filed Jan. 26, 2021, 9 pages.
Delahanty, et al. Psychological and behavioral correlates of baseline BMI in the diabetes prevention program (DPP). Diabetes Care. Nov. 2002;25(11):1992-8.
Derrien, et al. (2004). Akkermansia muciniphila gen. nov., sp. nov., a human intestinal mucin-degrading bacterium. Int. J. Syst. Evol. Microbiol. 54(Pt 5), 1469-1476. doi: 10.1099/ijs.0.02873-0.
Derrien, et al. (2008). The Mucin degrader Akkermansia muciniphila is an abundant resident of the human intestinal tract. Appl. Environ. Microbiol. 74, 1646-1648. doi: 10.1128/AEM.01226-07.
Derrien, et al. (2011). Modulation of mucosal immune response, tolerance, and proliferation in mice colonized by the mucin-degrader Akkermansia muciniphila. Front. Microbiol. 2:166. doi: 10.3389/fmicb.2011.00166.
Derrien, et al., Akkermansia muciniphila, gen. nov., sp. nov., a novel intestinal mucin-degrading bacterium, FEMS Congress of European Microbiologists Abstract Book 1 (2003): 237.
Derrien, et al. Mucin-bacterial interactions in the human oral cavity and digestive tract. Gut Microbes. Jul.-Aug. 2010; 1(4): 254-268.
Derrien. Mucin utilisation and host interactions of the novel intestinal microbe Akkermansia muciniphila. 2007.
Desbonnet, et al. Effects of the probiotic Bifidobacterium infantis in the maternal separation model of depression. Neuroscience. Nov. 10, 2010;170(4):1179-1188. doi: 10.1016/j.neuroscience.2010.08.005. Epub Aug. 6, 2010.
Detman, et al. Cell factories converting lactate and acetate to butyrate: Clostridium butyricum and microbial communities from dark fermentation bioreactors. Microb Cell Fact. Feb. 13, 2019;18(1):36. doi: 10.1186/s12934-019-1085-1.
Dewulf, et al. (2011). Inulin-type fructans with prebiotic properties counteract GPR43 overexpression and PPARgamma-related adipogenesis in the white adipose tissue of high-fat diet-fed mice. J. Nutr. Biochem. 22, 712-722. doi: 10.1016/j.jnutbio.2010.05.009.
Diamant, et al. Do nutrient-gut-microbiota interactions play a role in human obesity, insulin resistance and type 2 diabetes? Obesity reviews. 2011; 12:272-281.
Diaz Heijtz, et al. Normal gut microbiota modulates brain development and behavior. Proc Natl Acad Sci U S A. Feb. 15, 2011;108(7):3047-52. doi: 10.1073/pnas.1010529108. Epub Jan. 31, 2011.
Dolfing, et al. Acetate inhibition of methanogenic, syntrophic benzoate degradation. Appl Environ Microbiol. Jul. 1988;54(7):1871-3.
Donohoe, et al. A gnotobiotic mouse model demonstrates that dietary fiber protects against colorectal tumorigenesis in a microbiota- and butyrate-dependent manner. Cancer Discov. Dec. 2014;4(12):1387-97. doi: 10.1158/2159-8290.CD-14-0501. Epub Sep. 29, 2014.
Donohoe, et al. The microbiome and butyrate regulate energy metabolism and autophagy in the mammalian colon. Cell Metab. May 4, 2011;13(5):517-26. doi: 10.1016/j.cmet.2011.02.018.
Dray, et al. Co-inertia analysis and the linking of ecological data tables. Ecology. 2003; 84(11):3078-3089.
Dubourg, et al. (2013). High-level colonisation of the human gut by Verrucomicrobia following broad-spectrum antibiotic treatment. Int. J. Antimicrob. Agents 41, 149-155. doi: 10.1016/j.ijantimicag.2012.10.012.
Duncan, et al. Acetate Utilization and Butyryl Coenzyme A (CoA): Acetate-CoA Transferase in Butyrate-Producing Bacteria from the Human Large Intestine. Appl Environ Microbiol. Oct. 2002;68(10):5186-90.
Duncan et al. "Lactate-utilizing bacteria, isolated from human feces, that produce butyrate as a major fermentation product" Applied and environmental microbiology. 2004, vol. 70, No. 10, pp. 5810-5817.
Eckburg, PB. et al., Diversity of the human intestinal microbial flora, Science. Jun. 10, 2005;308(5728):1635-8. Epub Apr. 14, 2005.
Edgar, R.C. Updating the 97% identity threshold for 16S ribosomal RNA OTUs. Bioinformatics. Jul. 15, 2018;34(14):2371-2375. doi: 10.1093/bioinformatics/bty113.
Eid, et al. Real-time DNA sequencing from single polymerase molecules. Science. Jan. 2, 2009;323(5910):133-8. doi: 10.1126/science.1162986. Epub Nov. 20, 2008.
Endo, et al. Butyrate-producing probiotics reduce nonalcoholic fatty liver disease progression in rats: new insight into the probiotics for the gut-liver axis. PLoS One. May 16, 2013;8(5):e63388. doi: 10.1371/journal.pone.0063388. Print 2013.
Epel, et al. The reward-based eating drive scale: a self-report index of reward-based eating. PLoS One. Jun. 30, 2014;9(6):e101350. doi: 10.1371/journal.pone.0101350. eCollection 2014.
Erickson, et al. Integrated metagenomics/metaproteomics reveals human host-microbiota signatures of Crohn's disease. PLoS One. 2012;7(11):e49138. doi: 10.1371/journal.pone.0049138. Epub Nov. 28, 2012.
European search report and opinion dated Jun. 28, 2021 for EP Application No. 18850315.5.
European search report with written opinion dated Mar. 26, 2018 for EP Application No. 15853671.4.
European search report with written opinion dated Nov. 19, 2018 for EP Application No. 16765880.6.
Everard, et al. (2011). Responses of gut microbiota and glucose and lipid metabolism to prebiotics in genetic obese and diet-induced leptin-resistant mice. Diabetes Metab. Res. Rev. 60, 2775-2786. doi: 10.2337/db11-0227.
Everard, et al. Akkermansia muciniphila link gut barrier function with inflammation and metabolic disorders associated with obesity. Keystone Symposia: The Microbiome (Q8) (Keystone, USA, du Apr. 3, 2012 au Sep. 3, 2012). Accessed Nov. 8, 2021 online at https://dial.uclouvain.be/pr/boreal/object/boreal:138299 (1 page).
Everard, et al. PO9 «Akkermansia muciniphila»: Une nouvelle bactérie jouant un rôle clé dans la fonction barrière de l'intestin, l'inflammation et les désordres métaboliques associés à l'obésité? (English: PO9 "Akkermansia muciniphila": a new bacterium playing a key role in the barrier function of the intestine, inflammation and associated metabolic disorders associated with obesity?) Diabetes & Metabolism. vol. 38. Supplement 2. (2012) p. A24. https://doi.org/10.1016/S1262-3636(12)71071-6. (English Machine Translation).
Everard, et al. (2013). Cross-talk between Akkermansia muciniphila and intestinal epithelium controls diet-induced obesity. Proc. Natl. Acad. Sci. U.S.A. 110, 9066-9071. doi: 10.1073/pnas.1219451110.
Everard, et al. Gut microbiota and GLP-1. Rev Endocr Metab Disord. Sep. 2014;15(3):189-96. doi: 10.1007/s11154-014-9288-6.
Fabricius, et al. Quantitative investigations into the elimination of in vitro-obtained spores of the non-pathogenic Clostridium butyricum strain CNRZ 528, and their persistence in organs of different species following intravenous spore administration. Res Microbiol. Nov.-Dec. 1993 144(9):741-53. DOI: 10.1016/0923-2508(93)90038-4.
Falony et al. Cross-Feeding between Bifidobacterium longum BB536 and Acetate-Converting, Butyrate-Producing Colon Bacteria during Growth on Oligofructos. Appl. Environ. Microbiol. 72(12):7835-7841 (2006).
Flores, et al. Microbiome of Affected and Unaffected Skin of Patients with Atopic Dermatitis Before and After Emollient Treatment. Journal of Drugs in Dermatology, Nov. 2014, vol. 13, Issue 11, pp. 611-618.
Flores, et al. Skin Microbiome Diversity in Patients with Atopic Dermatitis Before and After Emollient Treatment.
Franks, et al. Variations of bacterial populations in human feces measured by fluorescent in situ hybridization with group-specific 16S rRNA-targeted oligonucleotide probes. Appl Environ Microbiol. Sep. 1998;64(9):3336-45.
Freshney. Culture of Animal Cells: A Manual of Basic Technique and Specialized Applications. 6th Edition. 2010.
Furet, et al., Differential Adaptation of Human Gut Microbiota to Bariatric Surgery-Induced Weight Loss: Links with Metabolic and Low-Grade Inflammation Markers, Diabetes, 2010, 59(12):3049-57.

(56) References Cited

OTHER PUBLICATIONS

Ganesh, et al. Enterococcus faecium NCIMB 10415 does not protect interleukin-10 knock-out mice from chronic gut inflammation. Beneficial Microbes 3.1 (Mar. 2012): 43-50.
Gao, et al. Butyrate improves insulin sensitivity and increases energy expenditure in mice. Diabetes. Jul. 2009. 58(7):1509-17. doi: 10.2337/db08-1637. Epub Apr. 14, 2009.
Gearhardt, et al. Preliminary validation of the Yale Food Addiction Scale. Appetite. Apr. 2009;52(2):430-6. doi: 10.1016/j.appet.2008.12.003. Epub Dec. 11, 2008.
Gennaro, A.R. Quality Assurance and Control. Remington: The Science and Practice of Pharmacy. 2000. Lippincott Williams & Wilkins, 20th ed. pp. 980-983.
Gibbs et al. Urocanic Acid in the Skin: A Mixed Blessing? Journal of Investigative Dermatology (2011) 131, 14-17.
Gibson, et al. (1995). Dietary modulation of the human colonic microbiota: introducing the concept of prebiotics. J. Nutr. 125, 1401-1412.
Gibson, et al. "Inulin and Oligofructose: New Scientific Developments", Nutrition Today, Mar. 1, 2008, pp. 54-59, XP055327770.
Gomez-Gallego, et al. Akkermansia muciniphila: a novel functional microbe with probiotic properties. Benef Microbes. Jun. 13, 2016:1-14. doi:10.3920/BM2016.0009.
Gomez-Gallego, et al. Infant formula supplemented with polyamines alters the intestinal microbiota in neonatal BALB/cOlaHsd mice. J Nutr Biochem. Nov. 2012;23(11):1508-13. doi: 10.1016/j.jnutbio.2011.10.003. Epub Mar. 7, 2012.
Gurry et al., (2017) "Synbiotic approaches to human health and well-being." Microbial Biotechnology, vol. 10, No. 5, pp. 1070-1073.
Grasset, et al. A Specific Gut Microbiota Dysbiosis of Type 2 Diabetic Mice Induces GLP-1 Resistance through an Enteric NO-Dependent and Gut-Brain Axis Mechanism. Cell Metab. May 2, 2017;25(5):1075-1090.e5. doi: 10.1016/j.cmet.2017.04.013.
Gregoriadis. Chapter 14: Liposomes. Drug Carriers in Biology and Medicine (57 pgs) (Academic Press, 1979).
Grice, E. The Skin Microbiome: Potential for Novel Diagnostic and Therapeutic Approaches to Cutaneous Disease. Semin Cutan Med Surg, 2014, 33:98-103.
Grzeskowiak, et al., The impact of perinatal probiotic intervention on gut microbiota: Double-blind placebo-controlled trials in Finland and Germany, ANAEROBE 18.1 (Feb. 2012): 7-13.
Gupta, et al. Patterns of brain structural connectivity differentiate normal weight from overweight subjects. Neuroimage Clin. Jan. 13, 2015;7:506-17. doi: 10.1016/j.nicl.2015.01.005. eCollection 2015.
Hai Suisan Shigen Oyobi Shokuhin Kako Zansa o Genryo to suru Kokinosei Hakko Shiryo Seizo Gijutsu no Kaihatsu. Heisei 22 Nendo Senryakuteki Kiban Gijutsu Kodoka Shien Jigyo Kenkyu Seika Hokokusho. Kanto Bureau of Economy, Trade and Industry. 2011, pp. 1-26.
Hakansson, et al. Gut microbiota and inflammation. Nutrients. Jun. 2011;3(6):637-82. doi: 10.3390/nu3060637. Epub Jun. 3, 2011.
Hamer, et al. Review article: the role of butyrate on colonic function. Aliment Pharmacol Ther. Jan. 15, 2008;27(2):104-19. Epub Oct. 25, 2007.
Hansen, et al., Early life treatment with vancomycin propagates Akkermansia muciniphila and reduces diabetes incidence in the NOD mouse, Diabetologia (2012), 55:2285-2294.
Harmsen, et al. Extensive Set of 16S rRNA-Based Probes for Detection of Bacteria in Human Feces. Applied and Environmental Microbiology Jun. 2002, 68 (6) 2982-2990; DOI: 10.1128/AEM.68.6.2982-2990.2002.
Hendrickson et al., Remington: The Science and Practice of Pharmacy, 21st Edition; Lippincott Williams & Wilkins: Philadelphia, PA, 2005; pp. 889-938.
Henry Ford Health Clinic, Endocrinology, Diabetes and Bone Mineral Disorders webcite information. 2016. 2 pages. http://www.henryford.com/body_academic.cfm?id-52450.

Hildebrand, et al., A comparative analysis of the intestinal metagenomes present in guinea pigs (*Cavia porcellus*) and humans (*Homo sapiens*, BMC Genomics 13 (Sep. 28, 2012).
Hildebrandt, et al., High-Fat Diet Determines the Composition of the Murine Gut Microbiome Independently of Obesity, Gastroenterology, 2009, 137(5):1716-24 el-2.
HiVeg Peptone, Technical Data Sheet, 2019 (Year: 2019).
Hjorth, et al. Pre-treatment microbial Prevotella-to- Bacteroides ratio, determines body fat loss success during a 6-month randomized controlled diet intervention, International Journal of Obesity accepted article preview Sep. 8, 2017; doi: 10.1038/ijo.2017.220.
Hold, et al. Assessment of microbial diversity in human colonic samples by 16S rDNA sequence analysis. FEMS Microbiol Ecol. Jan. 1, 2002. 39(1):33-9. doi: 10.1111/j.1574-6941.2002.tb00904.x.
Hold et al. 'Oligonucleotide probes that detect quantitatively significant groups of butyrate-producing bacteria in human feces.' Applied and environmental microbiology. 2003, vol. 69, No. 7, pp. 4320-4324.
Hosseini et al. Propionate as A Health-Promoting Microbial Metabolite in the Human Gut. Nutrition Reviews 69:245-258 (2010).
Hu, et al. Type 1 Diabetes and Gut Microbiota: Friend or Foe? Pharmacological Research 98 (2015): 9-15.
International search report and written opinion dated Jan. 27, 2016 for PCT Application No. US2015/058511.
International search report and written opinion dated Jun. 17, 2016 for PCT/US2016/023311.
International search report with written opinion dated Nov. 23, 2018 for PCT/US18/48955.
Ismail, et al. Frequency of Firmicutes and Bacteroidetes in gut microbiota in obese and normal weight Egyptian children and adults. Arch Med Sci. Jun. 2011;7(3):501-7. doi: 10.5114/aoms.2011.23418. Epub Jul. 11, 2011.
Isolauri, et al. Probiotics in the management of atopic eczema. Clin Exp Allergy. Nov. 2000;30(11):1604-10.
Jeurink, et al. (2013). Human milk: a source of more life than we imagine. Benef. Microbes 4, 17-30. doi: 10.3920/BM2012. 0040.
Johnson, et al. Is primary prevention of Clostridium difficile infection possible with specific probiotics? Int J Infect Dis. Nov. 2012;16(11):e786-92. doi: 10.1016/j.ijid.2012.06.005. Epub Aug. 3, 2012.
Kadooka, et al. Regulation of abdominal adiposity by probiotics (*Lactobacillus gasseri* SBT2055) in adults with obese tendencies in a randomized controlled trial. Eur J Clin Nutr. Jun. 2010;64(6):636-43. doi: 10.1038/ejcn.2010.19. Epub Mar. 10, 2010.
Kalliomaki, et al. Probiotics in primary prevention of atopic disease: a randomised placebo-controlled trial. Lancet. Apr. 7, 2001;357(9262):1076-9.
Kallus, et al., the Intestinal Microbiota and Obesity, J. Clin. Gastroenterol, Jan. 2012, 46(1):16-24.
Kamneva, et al, Analysis of Genome Content Evolution in PVC Bacterial Super-Phylum: Assessment of Candidate Genes Associated with Cellular Organization and Lifestyle, Genome Biology and Evolution 4.12 (2012): 1375-1390.
Karlsson, et al. Gut metagenome in European women with normal, impaired and diabetic glucose control. Nature. Jun. 6, 2013;498(7452):99-103. doi: 10.1038/nature12198. Epub May 29, 2013.
Karlsson, et al., The Microbiota of the Gut in Preschool Children With Normal and Excessive Body Weight, Obesity 20.11 (Nov. 2012): 2257-2261.
Khan, et al. Antioxidants keep the potentially probiotic but highly oxygen-sensitive human gut bacterium *Faecalibacterium prausnitzii* alive at ambient air. PLoS One. May 5, 2014;9(5):e96097. doi: 10.1371/journal.pone.0096097. eCollection 2014.
Khan, et al., Pathophysiology and Treatment of Type 2 Diabetes: Perspectives On The Past, Present And Future, Lancet, Mar. 22, 2014, 383(9922):1068-1083.
Kilpatrick, et al. Influence of sucrose ingestion on brainstem and hypothalamic intrinsic oscillations in lean and obese women. Gastroenterology. May 2014;146(5):1212-21. doi: 10.1053/j.gastro.2014.01.023. Epub Jan. 28, 2014.

(56) References Cited

OTHER PUBLICATIONS

Kim, et al. Effects of Probiotics for the Treatment of Atopic Dermatitis: A Meta-Analysis of Randomized Controlled Trials. Ann. Allergy Asthma Immunol 113 (2014): 217-226.
Kinumaki, et al. Longitudinal analysis of gut flora in Kawasaki disease patients using next-generation DNA sequencing. Pediatrics International, suppl. 1 54 (Feb. 2012): 81.
Knip, et al. The role of the intestinal microbiota in type 1 diabetes mellitus. Nat Rev Endocrinol. Mar. 2016;12(3):154-67. doi: 10.1038/nrendo.2015.218. Epub Jan. 4, 2016.
Kober, et al. The effect of probiotics on immune regulation, acne, and photoaging. Int J Womens Dermatol. Apr. 6, 2015;1(2):85-89. doi: 10.1016/j.ijwd.2015.02.001. eCollection Jun. 2015.
Komaroff. How the Microbiome Might Promote Metabolic Syndrome and Obesity. Anthony L. Komaroff, MD reviewing Perry RJ et al. Nature Jun. 9, 2016. Trajkovski M and Wollheim CB. Nature Jun. 9, 2016. Published Jul. 14, 2016.
Kong et al. Temporal shifts in the skin microbiome associated with disease flares and treatment in children with atopic dermatitis. Genome Res 22(5):850-859 (2012).
Kootte, et al., the Therapeutic Potential Of Manipulating Gut Microbiota In Obesity and Type 2 Diabetes Mellitus, Diabetes, Obesity And Metabolism, Epub 2011, 14:112-120.
Kuhn, et al. Applied predictive modeling. Springer, 2013. 595 pages.
Lamont. Infection in the prediction and antibiotics in the prevention of spontaneous preterm labour and preterm birth. BJOG: an International Journal of Obstetrics and Gynaecology. 2003; 110(Suppl 20):71-75.
Lange, Vinzenz et al. Selected reaction monitoring for quantitative proteomics: a tutorial. Molecular Systems Biology 4(222):1-14 (Oct. 14, 2008).
Larsen, et al. Gut Microbiota in Human Adults with Type 2 Diabetes Differs from Non-Diabetic Adults. PLoS One. Feb. 5, 2010;5(2):e9085. doi: 10.1371/journal.pone.0009085.
Le Barz, et al. Probiotics as Complementary Treatment for Metabolic Disorders. Diabetes Metab J. Aug. 2015; 39(4): 291-303. doi:10.4093/dmj.2015.39.4.291.
Lebourhis et al. Development and Validation of PCR Primers To Assess the Diversity of Clostridium spp. in Cheese by Temporal Temperature Gradient Gel Electrophoresis. Applied and Environmental Microbiology, Jan. 2005, p. 29-38 vol. 71.
Lefebvre, et al., Role of Bile Acids and Bile Acid Receptors In Metabolic Regulation, Physiol Rev, 2009, 89(1):147-91.
Leung. New Insights into Atopic Dermatitis: Role of Skin Barrier and Immune Dysregulation. Allergol Int. Jun. 2013;62(2):151-61. doi: 10.2332/allergolint.13-RAI-0564.
Levinson et al., Acute Gastrointestinal Graft-vs-Host Disease Is Associated With Increased Enteric Bacterial Bloodstream Infection Density in Pediatric Allogeneic Hematopoietic Cell Transplant Recipients, Clinical Infectious Diseases, May 5, 2015,61(3):350-357.
Levkovich, et al. Probiotic Bacteria Induce a 'Glow of Health'. PLoS One. 2013;8(1):e53867. doi: 10.1371/journal.pone.0053867. Epub Jan. 16, 2013.
Ley, et al., Microbial Ecology: Human Gut Microbes Associated With Obesity, Nature, Dec. 21, 2006, 444:1022-3.
Li, et al. Akkermansia Muciniphila Protects Against Atherosclerosis by Preventing Metabolic Endotoxemia-Induced Inflammation in Apoe-/- Mice. Circulation. Jun. 14, 2016;133(24):2434-46. doi: 10.1161/CIRCULATIONAHA.115.019645. Epub Apr. 25, 2016.
Li et al., Metabolic Surgery Profoundly Influences Gut Microbial-Host Metabolic Cross-Talk, Gut, 2011; 60(9):1214-23.
Liou, et al. Conserved shifts in the gut microbiota due to gastric bypass reduce host weight and adiposity. Sci Transl Med. Mar. 27, 2013;5(178):178ra41. doi: 10.1126/scitranslmed.3005687.
Liu, et al. Butyrate protects rat liver against total hepatic ischemia reperfusion injury with bowel congestion. PLoS One. Aug. 29, 2014;9(8):e106184. doi: 10.1371/journal.pone.0106184. eCollection 2014.
Liu, et al. Neuroprotective Effects of Clostridium butyricum against Vascular Dementia in Mice via Metabolic Butyrate. Biomed Res Int. 2015;2015:412946. doi: 10.1155/2015/412946. Epub Oct. 7, 2015.
Lopez-Siles et al., Cultured Representatives of Two Major Phylogroups of Human Colonic Faecalibacterium prausnitzii Can Utilize Pectin, Uronic Acids, and Host-Derived Substrates for Growth, Applied and Environmental Microbiology, 420-428.
Louis et al. Diversity, metabolism and microbial ecology of butyrate-producing bacteria from the human large intestine. FEMS Microbiol Lett. 2009, vol. 294(1), p. 1-8.
Lukovac, et al. Differential Modulation by Akkermansia muciniphila and Faecalibacterium prausnitzii of Host Peripheral Lipid Metabolism and Histone Acetylation in Mouse Gut Organoids. mBio. Jul.-Aug. 2014; 5(4): e01438-14. Published online Aug. 12, 2014. doi: 10.1128/mBio.01438-14.
Lyra, et al. Comparison of bacterial quantities in left and right colon biopsies and faeces. World J Gastroenterol. Aug. 28, 2012; 18(32): 4404-4411.
Lyra, et al. Quantities of Commensal and Pathogenic Bacteria in Mucosal Biopsies of the Left and Right Colon and Feces. Gastroenterology 142.5, Suppl. 1 (May 2012): S542.
MacFarland, et al. Pharmaceutical probiotics for the treatment of anaerobic and other infections. Anaerobe. Apr.-Jun. 1997;3(2-3):73-8.
Maldonado-Gomez, et al. Stable Engraftment of Bifidobacterium longum AH1206 in the Human Gut Depends on Individualized Features of the Resident Microbiome. Cell Host Microbe. Sep. 28, 2016. pii: S1931-3128(16)30378-X. doi: 10.1016/j.chom.2016.09.001.
Man et al. The Internal Transcribed Spacer Region, a New Tool for Use in Species Differentiation and Delineation of Systematic Relationships within the Campylobacter Genus. Applied and Environmental Microbiology, May 2010, vol. 76, No. 10, p. 3071-3081. (Year: 2010).
Maslowski, et al. Regulation of inflammatory responses by gut microbiota and chemoattractant receptor GPR43. Nature. Oct. 29, 2009;461(7268):1282-6. doi: 10.1038/nature08530.
Maurer, et al. (2010). Consumption of diets high in prebiotic fiber or protein during growth influences the response to a high fat and sucrose diet in adulthood in rats. Nutr.Metab. (Lond) 7:77. doi: 10.1186/1743-7075-7-77.
Mayer, et al. Gut microbes and the brain: paradigm shift in neuroscience. J Neurosci. Nov. 12, 2014;34(46):15490-6. doi: 10.1523/JNEUROSCI.3299-14.2014.
Mayer, et al. Gut/brain axis and the microbiota. J Clin Invest. Mar. 2, 2015;125(3):926-38. doi: 10.1172/JCI76304. Epub Feb. 17, 2015.
McLean et al. Characterisation and selection of a Lactobacillus species to re-colonise the vagina of women with recurrent bacterial vaginosis. J. Med. Microbiol., 2000, vol. 49, pp. 543-552.
McPherson, M. J. et al. (Eds.) PCR 2: A Practical Approach. Practical approach series. IRL Press. 1995. (Table of Contents).
Mekkes, et al. The development of probiotic treatment in obesity: a review. Beneficial MICR, Wageningen Academic Publishes, NL, vol. 5, No. 1, Mar. 1, 2014, pp. 19-28.
Meneghin, et al. Probiotics and atopic dermatitis in children. Pharmaceuticals (Basel). Jul. 6, 2012;5(7):727-44. doi: 10.3390/ph5070727.
Messaoudi, et al. Assessment of psychotropic-like properties of a probiotic formulation (Lactobacillus helveticus R0052 and Bifidobacterium longum R0175) in rats and human subjects. Br J Nutr. Mar. 2011;105(5):755-64. doi: 10.1017/S0007114510004319. Epub Oct. 26, 2010.
Millon, et al. Comparative meta-analysis of the effect of Lactobacillus species on weight gain in humans and animals. Microb Pathog. Aug. 2012;53(2):100-8. doi: 10.1016/j.micpath.2012.05.007. Epub May 24, 2012.
Molloy et al. The Potential Link between Gut Microbiota and IgE-Mediated Food Allergy in Early Life. Int. J. Environ. Res. Public Health 2013, 10, 7235-7256.
Muller, et al., The dynamics of genome replication using deep sequencing, Nucleic Acids Research, 2014, 42(1), e3, 11 pages. Epub Oct. 1, 2013.

(56) References Cited

OTHER PUBLICATIONS

Munoz-Tamayo, et al. Kinetic modelling of lactate utilization and butyrate production by key human colonic bacterial species. FEMS Microbiol. Ecol., 76 (2011), 615-624 DOI:10.1111/j.1574-6941.2011.01085.x.
Murphy, et al. Gut hormones and the regulation of energy homeostasis. Nature. Dec. 14, 2006;444(7121):854-9.
Naito, et al., Beneficial Effect of Oral Administration of Lactobacillus Casei Strain Shirota On Insulin Resistance In Diet-Induced Obesity Mice, J. appl. microbial., Mar. 2011, 110(3):650-7.
Narang, et al. Improved phosphotriester method for the synthesis of gene fragments. Methods Enzymol. 1979;68:90-8.
Naruszewicz, et al. Effect of Lactobacillus plantarum 299v on cardiovascular disease risk factors in smokers. Am J Clin Nutr. Dec. 2002;76(6):1249-55.
Navarro-Noya, et al., Bacterial Communities Associated With The Rhizosphere Of Pioneer Plants (Bahia Xylopoda And Viguiera Linearis) Growing On Heavy Metals-Contaminated Soils, Antonievan Leeuwenhoek, 2010, 97:335-49.
Netherlands Trial Register (NTR): "Dosefinding trial studying effect of 4 weeks Intervention on safety and efficacy in males with Metabolic syndrome with oral Eubacterium hallii" dated Nov. 22, 2014, https://www.trialregister.nl/trial/4775. Retrieved online Nov. 9, 2020. (2 pages).
Nilsson, et al. A Cereal-Based Evening Meal Rich in Indigestible Carbohydrates Increases Plasma Butyrate the Next Morning. J Nutr. Nov. 2010;140(11):1932-6. doi: 10.3945/jn.110.123604. Epub Sep. 1, 2010.
Nohr, et al. GPR41/FFAR3 and GPR43/FFAR2 as cosensors for short-chain fatty acids in enteroendocrine cells vs FFAR3 in enteric neurons and FFAR2 in enteric leukocytes. Endocrinology. Oct. 2013;154(10):3552-64. doi: 10.1210/en.2013-1142. Epub Jul. 24, 2013.
Notice of Allowance dated Jan. 13, 2020 for U.S. Appl. No. 15/271,672.
Notice of Allowance dated Feb. 19, 2020 for U.S. Appl. No. 15/271,672.
Notice of Allowance dated Feb. 21, 2020 for U.S. Appl. No. 16/159,536.
Notice of Allowance dated Jul. 17, 2020 for U.S. Appl. No. 16/159,532.
Notice of Allowance dated Jul. 23, 2020 for U.S. Appl. No. 16/159,537.
Notice of Allowance dated Sep. 2, 2016 for U.S. Appl. No. 15/139,097.
Notice of Allowance dated Oct. 13, 2021 for U.S. Appl. No. 16/830,995.
Notice of Allowance dated Nov. 17, 2021 for U.S. Appl. No. 16/830,995.
Notice of Allowance dated Nov. 24, 2021 for U.S. Appl. No. 16/830,972.
Nylund, et al. Severity of atopic disease inversely correlates with intestinal microbiota diversity and butyrate-producing bacteria. Allergy. Feb. 2015;70(2):241-4. doi: 10.1111/all.12549.
Obata, et al. Indigenous opportunistic bacteria inhabit mammalian gut-associated lymphoid tissues and share a mucosal antibody-mediated symbiosis. Proc Natl Acad Sci USA. Apr. 20, 2010. 107(16):7419-24. doi: 10.1073/pnas.1001061107. Epub Apr. 1, 2010.
Office action dated Jan. 11, 2019 for U.S. Appl. No. 15/286,218.
Office action dated Feb. 7, 2017 for U.S. Appl. No. 15/286,218.
Office action dated Feb. 21, 2020 for U.S. Appl. No. 15/286,218.
Office action dated Mar. 4, 2021 for U.S. Appl. No. 16/830,972.
Office action dated Mar. 5, 2020 for U.S. Appl. No. 16/159,536.
Office action dated Apr. 4, 2019 for U.S. Appl. No. 16/159,524.
Office action dated Apr. 16, 2020 for U.S. Appl. No. 16/159,532.
Office action dated Apr. 29, 2020 for U.S. Appl. No. 16/159,537.
Office action dated May 10, 2019 for U.S. Appl. No. 15/271,672.
Office action dated May 10, 2019 for U.S. Appl. No. 16/159,532.
Office action dated May 27, 2021 for U.S. Appl. No. 16/830,995.
Office action dated May 31, 2019 for U.S. Appl. No. 16/159,536.
Office action dated Jun. 5, 2019 for U.S. Appl. No. 16/159,537.
Office action dated Jun. 11, 2018 for U.S. Appl. No. 15/074,923.
Office action dated Jun. 16, 2017 for U.S. Appl. No. 15/286,218.
Office action dated Aug. 28, 2018 for U.S. Appl. No. 15/271,672.
Office action dated Sep. 18, 2019 for U.S. Appl. No. 16/159,524.
Office action dated Sep. 30, 2021 for U.S. Appl. No. 16/830,972.
Office action dated Oct. 16, 2019 for U.S. Appl. No. 15/286,218.
Office action dated Oct. 30, 2019 for U.S. Appl. No. 16/159,532.
Office action dated Oct. 31, 2019 for U.S. Appl. No. 15/271,672.
Office action dated Oct. 31, 2019 for U.S. Appl. No. 16/159,536.
Office action dated Oct. 31, 2019 for U.S. Appl. No. 16/159,537.
Office action dated Nov. 13, 2020 for U.S. Appl. No. 16/830,972.
Office action dated Nov. 13, 2020 for U.S. Appl. No. 16/830,995.
Office action dated Nov. 27, 2017 for U.S. Appl. No. 15/286,218.
Office action dated Dec. 13, 2018 for U.S. Appl. No. 16/159,536.
Office action dated Dec. 13, 2018 for U.S. Appl. No. 16/159,537.
Office action dated Dec. 20, 2017 for U.S. Appl. No. 15/074,923.
Oh, et al. Shifts in Human Skin and Nares Microbiota of Healthy Children and Adults. Genome Medicine 2012, 4:77.
O'Keefe, et al. Fat, fibre and cancer risk in African Americans and rural Africans. Nat Commun. Apr. 28, 2015;6:6342. doi: 10.1038/ncomms7342.
Ong, et al. Endogenous antimicrobial peptides and skin infections in atopic dermatitis. N Engl J Med. Oct. 10, 2002;347(15):1151-60.
Ouwehand, et al. (2005). Prebiotics and other microbial substrates for gut functionality. Curr. Opin. Biotechnol. 16, 212-217. doi: 10.1016/j.copbio.2005. 01.007.
Ouwerkerk, et al. Akkermansia glycaniphila sp. nov., an anaerobic mucin-degrading bacterium isolated from reticulated python faeces. Int J Syst Evol Microbiol. Nov. 2016;66(11):4614-4620. doi: 10.1099/ijsem.0.001399. Epub Aug. 5, 2016.
Ouwerkerk, et al. Akkermansia glycaniphila sp. nov., an anaerobic mucin-degrading bacterium isolated from reticulated python faeces. Int J Syst Evol Microbiol. Nov. 2016;66(11):4614-4620. doi: 10.1099/ijsem.0.001399. Epub Aug. 5, 2016. (Manuscript Draft—21 pages).
Pachikian, et al. (2012). Prebiotic approach alleviates hepatic steatosis: implication of fatty acid oxidative and cholesterol synthesis pathways. Mol. Nutr. Food Res. 57, 347-359. doi: 10.1002/mnfr.201200364.
Panther, et al. The Importance of Acidification in Atopic Eczema: An Underexplored Avenue for Treatment. J Clin Med. May 18, 2015;4(5):970-8. doi: 10.3390/jcm4050970.
Parnell, et al. Weight loss during oligofructose supplementation is associated with decreased ghrelin and increased peptide YY in overweight and obese adults. Am J Clin Nutr. Jun. 2009;89(6):1751-9. doi: 10.3945/ajcn.2009.27465. Epub Apr. 22, 2009.
Patti, et al., Serum Bile Acids Are Higher In Humans with Prior Gastric Bypass: Potential Contribution to Improved Glucose And Lipid Metabolism, Obesity (silver spring), 2009, 17(9): 1671-7.
Peng, et al. Butyrate enhances the intestinal barrier by facilitating tight junction assembly via activation of AMP-activated protein kinase in Caco-2 cell monolayers. J Nutr. Sep. 2009;139(9):1619-1625. doi: 10.3945/jn.109.104638. Epub Jul. 22, 2009.
Perez, et al. Surface Properties of Bifidobacterial Strains of Human Origin. Applied and Environmental Microbiology. vol. 64. No. 1. pp. 21-26. Jan. 1998.
Perry, et al. Acetate mediates a microbiome-brain-$\beta$-cell axis to promote metabolic syndrome. Nature. Jun. 8, 2016;534(7606):213-7. doi: 10.1038/nature18309.
Petrof et al. Stool substitute transplant therapy for the eradication of Clostridium difficile infection: "RePOOPulating" the gut. Microbiome 1(1):3 (2013).
Plovier, et al. A purified membrane protein from Akkermansia muciniphila or the pasteurized bacterium improves metabolism in obese and diabetic mice. Nature Medicine, Jan. 2017, 23(1):107-16.
Png, et al. (2010). Mucolytic bacteria with increased prevalence in IBD mucosa augment in vitro utilization of mucin by other bacteria. Am. J. Gastroenterol. 105, 2420-2428. doi: 10.1038/ajg.2010.281.
Poul, et al. Functional characterization of human receptors for short chain fatty acids and their role in polymorphonuclear cell activation. J Biol Chem. Jul. 11, 2003;278(28):25481-9. Epub Apr. 23, 2003.

(56) References Cited

OTHER PUBLICATIONS

Psichas, et al. The short chain fatty acid propionate stimulates GLP-1 and PYY secretion via free fatty acid receptor 2 in rodents. Int J Obes (Lond). Mar. 2015;39(3):424-9. doi: 10.1038/ijo.2014. 153. Epub Aug. 11, 2014.
Puddu et al. Evidence for the Gut Microbiota Short-Chain Fatty Acids as Key Pathophysiological Molecules Improving Diabetes. Mediators Inflamm. vol. 2014;2014:162021. Epub Aug. 17, 2014.
Queipo-Ortuno, et al. Gut microbiota composition in male rat models under different nutritional status and physical activity and its association with serum leptin and ghrelin levels. PLoS One. May 28, 2013;8(5):e65465. doi: 10.1371/journal.pone.0065465. Print 2013.
Rajilic-Stojanovic, et al. Development and application of the human intestinal tract chip, a phylogenetic microarray: analysis of universally conserved phylotypes in the abundant microbiota of young and elderly adults. Environ Microbiol. Jul. 2009. 11(7):1736-51. doi: 10.1111/j.1462-2920.2009.01900.x. Epub Mar. 11, 2009.
Rajilic-Stojanovic, et al. Diversity of the human gastrointestinal tract microbiota revisited. Environ Microbiol. Sep. 2007;9(9):2125-36. doi: 10.1111/j.1462-2920.2007.01369.x.
Rao, et al. A randomized, double-blind, placebo-controlled pilot study of a probiotic in emotional symptoms of chronic fatigue syndrome. Gut Pathog. Mar. 19, 2009;1(1):6. doi: 10.1186/1757-4749-1-6.
Rautava, et al., New therapeutic strategy for combating the increasing burden of allergic disease: Probiotics—A Nutrition, Allergy, Mucosal Immunology and Intestinal Microbiota (NAMI) Research Group report, J Allergy Clin Immunol, 16(1) 31-37.
Ravussin, et al. Responses of gut microbiota to diet composition and weight loss in lean and obese mice. Obesity (Silver Spring). Apr. 2012;20(4):738-47. doi: 10.1038/oby.2011.111. Epub May 19, 2011.
Ravussin. Molecular and Physiological Adaptations to Weight Perturbation in Mice. Columbia University, 2012. ProQuest Dissertations Publishing, (2012). 3475216.
Redeclaration, Patent Interference No. 106,130, filed Feb. 24, 2021, 3 pages.
Registad, et al. Gut microbes promote colonic serotonin production through an effect of short-chain fatty acids on enterochromaffin cells. FASEB J. Apr. 2015;29(4):1395-403. doi: 10.1096/fj.14-259598. Epub Dec. 30, 2014.
Remington: The Science and Practice of Pharmacy, Nineteenth Ed (Easton, Pa.: Mack Publishing Company, 1995.
RIDACOM. "Plant Based Media." RIDACOM—Comprehensive Bioscience Supplier—Plant Based Media, 2019, ridacom.com/en/product-list/353/Plant-based-media.
Rippke, et al. Stratum Corneum pH in Atopic Dermatitis: Impact on Skin Barrier Function and Colonization with *Staphylococcus Aureus*. Am J Clin Dermatol. 2004;5(4):217-23.
Roberfroid, et al. (2010). Prebiotic effects: metabolic and health benefits. Br. J. Nutr. 104, S1-S63. doi: 10.1017/S0007114510003363.
Roelofsen, et al. The interaction of short-chain fatty acids with adipose tissue: relevance for prevention of type 2 diabetes. Benef Microbes. Nov. 2010;1(4):433-7. doi: 10.3920/BM2010.0028.
Rogers, et al., From gut dysbiosis to altered brain function and mental illness: mechanisms and pathways, Molecular Psychiatry (2016), 21, 738-48.
Rosenfeldt et al. Effect of probiotic Lactobacillus strains in children with atopic dermatitis. J Allergy Clin Immunol 111(2):389-395 (2003).
Roshchina, V. Evolutionary Considerations of Neurotransmitters in Microbial, Plant, and Animal Cells. In: Lyte M, Fitzgerald P (eds). Microbial Endocrinology: Interkingdom Signaling in Infectious Disease and Health. New York: Springer, Feb. 2010, pp. 17-52.
Rossi-Tamisier, et al. Cautionary tale of using 16S rRNA gene sequence similarity values in identification of human-associated bacterial species. Int J Syst Evol Microbiol. Jun. 2015;65(Pt 6):1929-34. doi: 10.1099/ijs.0.000161. Epub Mar. 3, 2015.
Roudsari, et al. Health Effects of Probiotics on the Skin. Crit Rev Food Sci Nutr. 2015;55(9):1219-40. doi: 10.1080/10408398.2012. 680078.
Roy, et al., Gut Microbiota Transplantation Demonstrates Its Causal Role in the Development of Type 2 Diabetes and Fatty Liver, Oral Presentations, Journal of Hepatology, 2012, vol. 56, S23.
Rubino, et al., Metabolic Surgery to Treat Type 2 Diabetes: Clinical Outcomes and Mechanisms of Action, Annu. rev. med., 2010, 61:393-411.
Sahoo, et al. Boolean implication networks derived from large scale, whole genome microarray datasets. Genome Biol. Oct. 30, 2008;9(10):R157. doi: 10.1186/gb-2008-9-10-r157.
Saleem, et al. Screening of Various Plant Based Extracts for Their Suitability to Be Used As Growth Promoting Substances in the Preparation of Culture Media for Fungi. 114th General Meeting of the American Society for Microbiology. Conference abstracts. 2014.
Sambrook, et al. Molecular Cloning: A Laboratory Manual. 4th Edition, 2012.
Samuel, et al., a Humanized Gnotobiotic Mouse Model of Host-Archaeal-Bacterial Mutualism, PNAS, Jun. 27, 2006, 103(26):10011-16.
Sanmiguel, et al. Interactions between Host Factors and the Skin Microbiome. Cell. Mol. Life Sci., Dec. 2014.
Santacruz, et al. Gut microbiota composition is associated with body weight, weight gain and biochemical parameters in pregnant women. Br J Nutr. Jul. 2010;104(1):83-92. doi: 10.1017/S0007114510000176. Epub Mar. 8, 2010.
Sanz, et al. Gut microbiota and weight gain in overweight and normal weight pregnant women. Journal of Pediatric Gastroenterology and Nutrition, suppl. 3 48 (May 2009): E74.
Sanz, et al. Insights into the roles of gut microbes in obesity. Interdisciplinary perspectives on infectious diseases. vol. 2008 (2008): 829101. doi:10.1155/2008/829101.
Scheuermayer, et al. Rubritalea marina gen. nov., sp nov., a marine representative of the phylum 'Verrucomicrobia', isolated from a sponge (Porifera). Int J Syst Evol Microbiol. Sep. 2006;56(Pt 9):2119-24.
Schink, B. Energetics of syntrophic cooperation in methanogenic degradation. Microbiol Mol Biol Rev. Jun. 1997;61(2):262-80.
Second Redeclaration, Patent Interference No. 106,130, filed Apr. 12, 2021, 4 pages.
Segain, et al. Butyrate inhibits inflammatory responses through NFkappaB inhibition: implications for Crohn's disease. Gut. Sep. 2000;47(3):397-403.
Seki, et al. Prevention of antibiotic-associated diarrhea in children by Clostridium butyricum MIYAIRI. Pediatr Int. Feb. 2003;45(1):86-90.
Senevirathne. Effect of Resistant Starch on Microbial Content of the Intestinal Tract. LSU Doctoral Dissertations. 2717. digitalcommons.lsu.edu/gradschool_dissertations/2717.
Sáez-Lara, et al., Effects of Probiotics and Synbiotics on Obesity, Insulin Resistance Syndrome, Type 2 diabetes and Non-alcoholic Fatty Liver Disease: a Review of Human Clinical Trials, Int. J. Mol. Sci. 2016, 17, 928; doi:10.3390/ijms17060928.
Sharma, et al. Glucagon-like peptide-1 (GLP-1) receptor agonist prevents development of tolerance to anti-anxiety effect of ethanol and withdrawal-induced anxiety in rats. Metab Brain Dis. Jun. 2015;30(3):719-30. doi: 10.1007/s11011-014-9627-z. Epub Nov. 8, 2014.
Simakachorn et al., Tolerance, Safety, and Effect on the Faecal Microbiota of an Enteral Formula Supplemented With Pre- and Probiotics in Critically Ill Children, J. of Ped. Gastroenterology and Nutrition, Aug. 2011, 53(2):174-181.
Sinha, et al. Mutant WT1 is associated with DNA hypermethylation of PRC2 targets in AML and responds to EZH2 inhibition. Blood. Jan. 8, 2015;125(2):316-26. doi: 10.1182/blood-2014-03-566018. Epub Nov. 14, 2014.
Sokol, et al. Faecalibacterium prausnitzii is an anti-inflammatory commensal bacterium identified by gut microbiota analysis of Crohn disease patients. Proc Natl Acad Sci U S A. Oct. 28, 2008;105(43):16731-6. doi: 10.1073/pnas.0804812105. Epub Oct. 20, 2008.

(56) References Cited

OTHER PUBLICATIONS

Sonoyama, et al, Comparison of gut microbiota and allergic reactions in BALB/c mice fed different cultivars of rice, British Journal of Nutrition 103.2 (Jan. 28, 2010): 218-226.
Sonoyama, et al, Response of Gut Microbiota to Fasting and Hibernation in Syrian Hamsters, Applied and Environmental Microbiology 75.20 (Oct. 15, 2009): 6451-6456.
Speakman, et al., Revised Equations For Calculating C02 Production From Doubly Labeled Water In Humans, Am J. physiol., Jun. 1993, pp. e912-7.
Stevenson, et al., New strategies for cultivation and detection of previously uncultured microbes. Appl Environ Microbiol. Aug. 2004;70(8):4748-55.
Stilling, et al. The neuropharmacology of butyrate: The bread and butter of the microbiota-gut-brain axis? Neurochem Int. Oct. 2016;99:110-132. doi: 10.1016/j.neuint.2016.06.011. Epub Jun. 23, 2016.
Stylopoulos, et al., Roux-En-Y Gastric Bypass Enhances Energy Expenditure And Extends Lifespan In Diet-Induced Obese Rats, Obesity, Oct. 2009, 17(10):1839-47.
Swann, et al., Systemic Gut Microbial Modulation Of Bile Acid Metabolism In Host Tissue Compartments, PNAC, Mar. 15, 2011, 108(11):4523-30.
Swidsinki, et al. Acute appendicitis is characterised by local invasion with Fusobacterium nucleatum/necrophorum. Gut. Jan. 2011;60(1):34-40. doi: 10.1136/gut.2009.191320. Epub Nov. 18, 2009.
Takahashi, et al. Reduced Abundance of Butyrate-Producing Bacteria Species in the Fecal Microbial Community in Crohn's Disease. Digestion. 2016;93(1):59-65. doi: 10.1159/000441768. Epub Jan. 14, 2016.
Takaishi, et al. Imbalance in intestinal microflora constitution could be involved in the pathogenesis of inflammatory bowel disease. Int J Med Microbiol. Jul. 2008;298(5-6):463-72. Epub Sep. 25, 2007.
Tang, et al., Endothelial TLR4 and the microbiome drive cerebral cavernous malformations cerebral cavernous malformations, Nature, 2017, May 18, 545:305-10.
Te Biesebeke, et al. Microbial Functionality in the Human Gastrointestinal Tract. Microbes and Environments 19.4:276. Japan Science and Technology Agency. (2004).
Texas Diabetes and Endocrinology Center, website information. 2016. 4 pages. http://www.texasdiabetes.com/.
Thaler, at al., Minireview: Hormonal And Metabolic Mechanisms of Diabetes Remission After Gastrointestinal Surgery, Endocrinology, 2009, 150(6):2518-25.
The Benefits of Butyrate: More than just your average short chain fatty acid. Mar. 9, 2015. 6 pages, http://fionamilne.tumblr.com/post/113178890752/the-benefits-of-butyrate-more-than-just-your.
Thioulouse. Simultaneous analysis of a sequence of paired ecological tables: A comparison of several methods. The Annals of Applied Statistics. 2011; 2300-2325.
Third Party Submission received for EP Application No. 13754666. 9, mailed on Aug. 26, 2021, 11 pages.
Thomas, et al., Tgr5- Mediated Bile Acid Sensing Controls Glucose Homeostasis, Cell Metab, 2009, 10(3):167-77.
Thompson-Chagoyan, et al., Faecal Microbiota and Short-Chain Fatty Acid Levels in Faeces from Infants with Cow's Milk Protein Allergy, Int Arch Allergy Immunol 2011,156:325-32. Epub Jun. 29, 2011.
Tolhurst, et al. Short-chain fatty acids stimulate glucagon-like peptide-1 secretion via the G-protein-coupled receptor FFAR2. Diabetes. Feb. 2012;61(2):364-71. doi: 10.2337/db11-1019. Epub Dec. 21, 2011.
Tollefson, et al. Atopic Dermatitis: Skin-Directed Management. Pediatrics vol. 134, No. 6, Dec. 2014, pp. e1735-e1744.
Trajkovski, et al. Physiology: Microbial signals to the brain control weight. Nature. Jun. 8, 2016;534(7606):185-7. doi: 10.1038/534185a.
Tremaroli, et al. Functional interactions between the gut microbiota and host metabolism. Nature. Sep. 13, 2012;489(7415):242-249. doi: 10.1038/nature11552.
Turnbaugh, et al., a Core Gut Microbiome In Obese And Lean Twins, Nature, 2009, 457(7228):480-4.
Turnbaugh, et al., an Obesity-Associated Gut Microbiome with Increased Capacity For Energy Harvest, Nature, Dec. 2006, 444:1027-31.
Turnbaugh, et al., The Effect of Diet on The Human Gut Microbiome: A Metagenomic Analysisin Humanized Gnotobiotic Mice, Sci. Transl. Med, 2009, 1(6):6ra14.
Tvede, et al. Bacteriotherapy for chronic relapsing Clostridium difficile diarrhoea in six patients. Lancet. May 27, 1989;1(8648):1156-60.
UCLA Neurobiology of Stress and Resilience Multisite Imaging, website information. 2016. 2 pages, http://uclacns.org/cores/data-core/multisite-neuroimaging/.
Udayappan, et al. Oral treatment with Eubacterium hallii improves insulin sensitivity in db/db mice. NPJ Biofilms Microbiomes. Jul. 6, 2016;2:16009. doi: 10.1038/npjbiofilms.2016.9. eCollection 2016.
Underwood et al., (2014) "Intestinal dysbiosis: Novel mechanisms by which gut microbes trigger and prevent disease." Preventive Medicine, vol. 65, pp. 133-137.
Val-Laillet, et al. Neuroimaging and neuromodulation approaches to study eating behavior and prevent and treat eating disorders and obesity. Neuroimage Clin. Mar. 24, 2015;8:1-31. doi: 10.1016/j.nicl.2015.03.016. eCollection 2015.
Van Baarlen, et al. Differential NF-κB pathways induction by Lactobacillus plantarum in the duodenum of healthy humans correlating with immune tolerance. Proc Natl Acad Sci U S A. Feb. 17, 2009. 106(7):2371-6. doi: 10.1073/pnas.0809919106. Epub Feb. 3, 2009.
Van Den Abbeele, et al., Arabinoxylans and inulin differentially modulate the mucosal and luminal gut microbiota and mucindegradation in humanized rats, Environmental Microbiology 13.10 (Oct. 2011): 2667-2680.
Van Den Abbeele, et al. Microbial Community Development in a Dynamic Gut Model Is Reproducible, Colon Region Specific, and Selective for Bacteroidetes and Clostridium Cluster IX. Appl Environ Microbiol. Aug. 2010;76(15):5237-46. doi: 10.1128/AEM.00759-10. Epub Jun. 18, 2010.
Van Der Ark. Metabolic characterization and viable delivery of Akkermansia muciniphila for its future application. PhD Thesis. Wageningen University. 2018.
Van Passe, et al., The Genome of Akkermansia muciniphila, a Dedicated Intestinal Mucin Degrader, and Its Use in Exploring Intestinal Metagenomes, PLoS ONE, Mar. 2011, 6(3):e16876, 8 pages.
Van Passel, et al., MetaMining of Metagenomes: Uncovering Akkermansia Diversity and Distribution, Abstracts of the General Meeting of the American Society for Microbiology 110 (2010): N-2237.
Vigsnaes, et al. Gram-negative bacteria account for main differences between faecal microbiota from patients with ulcerative colitis and healthy controls. Benef Microbes. Dec. 1, 2012;3(4):287-97. doi: 10.3920/BM2012.0018.
Vipperla, et al. Diet, microbiota, and dysbiosis: a 'recipe' for colorectal cancer. Food Funct. Apr. 20, 2016;7(4):1731-40. doi: 10.1039/c5fo01276g.
Vital et al. Revealing the bacterial butyrate synthesis pathways by analyzing (meta)genomic data. mBIO 5(2):e00889-14.
Volkow, et al. Obesity and addiction: neurobiological overlaps. Obes Rev. Jan. 2013;14(1):2-18. doi: 10.1111/j.1467-789X.2012.01031.x. Epub Sep. 27, 2012.
Vrieze, et al. Metabolic effects of transplanting gut microbiota from lean donors to subjects with metabolic syndrome. Diabetologia (2010) 53:[Suppll] p. S44.
Vrieze, et al. The environment within: how gut microbiota may influence metabolism and body composition. Diabetologia. Apr. 2010. 53(4):606-13. doi: 10.1007/s00125-010-1662-7. Epub Jan. 26, 2010.
Vrieze, et al. Transfer of intestinal microbiota from lean donors increases insulin sensitivity in individuals with metabolic syn-

(56) References Cited

OTHER PUBLICATIONS drome. Gastroenterology. Oct. 2012;143(4):913-6.e7. doi: 10.1053/j.gastro.2012.06.031. Epub Jun. 20, 2012.

Vuong, et al., How the Microbiome Affects Cognition, Mood and Behavior, Abstract, Available at http://www.prohealth.com/library/showarticle.cfm?libid=30495, Accessed on Jul. 13, 2017.

Wang, et al., Low Relative Abundances of the Mucolytic Bacterium Akkermansia muciniphila and Bifidobacterium Spp. in Feces of Children with Austism, Applied and Environmental Microbiology, Sep. 2011, vol. 77(18):6718-6721.

Wang, et al. *Staphylococcus epidermidisin* the human skin microbiome mediates fermentation to inhibit the growth of Propionibacterium acnes: implications of probiotics in acne vulgaris. Appl Microbiol Biotechnol. Jan. 2014;98(1):411-24. doi: 10.1007/s00253-013-5394-8. Epub Nov. 22, 2013.

Ward, et al. (2013). Human milk metagenome: a functional capacity analysis. BMC Microbiol. 13:116. doi: 10.1186/1471-2180-13-116.

Watanabe, et al., Bile acids induce energy expenditure by promoting intracellular thyroid hormone activation, Nature, Jan. 26, 2006, 439:484-9.

Wedlake, et al. Fiber in the treatment and maintenance of inflammatory bowel disease: a systematic review of randomized controlled trials. Inflamm Bowel Dis. Mar. 2014;20(3):576-86. doi: 10.1097/01.MIB.0000437984.92565.31.

Wikoffa, et al., Metabolomics analysis reveals large effects of gut microflora on mammalian blood metabolites, PNAS, Mar. 10, 2009, 106(10):3698-3703.

Williams, et al. Discovery and characterization of gut microbiota decarboxylases that can produce the neurotransmitter tryptamine. Cell Host Microbe. Oct. 8, 2014;16(4):495-503. doi: 10.1016/j.chom.2014.09.001. Epub Sep. 25, 2014.

Williams, et al. Evidence that Human Skin Microbiome Dysbiosis Promotes Atopic Dermatitis. J Invest Dermatol. Dec. 2017;137(12):2460-2461. doi: 10.1016/j.jid.2017.09.010.

Williams, et al. The Role of the Skin Microbiome in Atopic Dermatitis. Curr Allergy Asthma Rep. Nov. 2015;15(11):65. doi: 10.1007/s11882-015-0567-4.

Wolever, et al. Do colonic short-chain fatty acids contribute to the long-term adaptation of blood lipids in subjects with type 2 diabetes consuming a high-fiber diet?. Am J Clin Nutr. Jun. 2002;75(6):1023-30. DOI: 10.1093/ajcn/75.6.1023.

Woodard, et al., Probiotics Improve Outcomes After Roux-En-Y Gastric Bypass Surgery: A Prospective Randomized Trial, J Gastrointest Surg, Jul. 2009, 13:1198-1204.

Yabe, et al. Two incretin hormones GLP-1 and GIP: comparison of their actions in insulin secretion and β cell preservation. Prog Biophys Mol Biol. Nov. 2011;107(2):248-56. doi: 10.1016/j.pbiomolbio.2011.07.010. Epub Jul. 28, 2011.

Yadav, et al. Beneficial metabolic effects of a probiotic via butyrate-induced GLP-1 hormone secretion. J Biol Chem. Aug. 30, 2013;288(35):25088-97. doi: 10.1074/jbc.M113.452516. Epub Jul. 8, 2013.

Ye. Intestinal bacteria associated with colitis and inflammatory bowel disease. University of California, Riverside, 2009. ProQuest Dissertations Publishing, (2009). 3389696.

Youssef, et al. Plant-based culture media: Efficiently support culturing rhizobacteria and correctly mirror their in-situ diversity. J Adv Res. Mar. 2016;7(2):305-16. doi: 10.1016/j.jare.2015.07.005. Epub Aug. 29, 2015.

Zeevi, et al. Personalized Nutrition by Prediction of Glycemic Responses. Cell. Nov. 19, 2015;163(5):1079-94. doi: 10.1016/j.cell.2015.11.001.

Zeng, et al. Mechanisms linking dietary fiber, gut microbiota and colon cancer prevention. World J Gastrointest Oncol. Feb. 15, 2014;6(2):41-51. doi: 10.4251/wjgo.v6.i2.41.

Zhang, et al. (2013). Human gut microbiota changes reveal the progression of glucose intolerance. PLOS ONE 8:e71108. doi: 10.1371/journal.pone.0071108.

Zhang, et al., Human gut microbiota in obesity and after gastric bypass, PNAS, Feb. 17, 2009, 106(7):2365-70.

Zhu, et al. Constructing a Boolean implication network to study the interactions between environmental factors and OTUs. Quantitative Biology. 2014; 2(4):127-141.

Zhu, et al. Gut microbiome and nonalcoholic fatty liver diseases. Pediatr Res. Jan. 2015;77(1-2):245-51. doi: 10.1038/pr.2014.157. Epub Oct. 13, 2014.

Zoetendal, et al. Temperature Gradient Gel Electrophoresis Analysis of 16S rRNA from Human Fecal Samples Reveals Stable and Host-Specific Communities of Active Bacteria. Appl Environ Microbiol. Oct. 1998; 64(10): 3854-3859.

\* cited by examiner (A) Standard Resolution (B) Complete Biome Test (CBT) resolution

METHODS AND COMPOSITIONS FOR TREATMENT OF MICROBIOME-ASSOCIATED DISORDERS

CROSS REFERENCE

This application is a continuation of International Application No. PCT/US2018/048955, filed Aug. 30, 2018, which claims the benefit of U.S. Provisional Patent Application No. 62/551,983, filed on Aug. 30, 2017, each of which is incorporated herein by reference in its entirety.

BACKGROUND

The microbiome can play an important role in maintaining physiological functions of the body. Dysbiosis of the microbiome can lead to various disorders. Microbe-based therapies can be used for treatment of microbiome-related disorders.

SEQUENCE LISTING

The instant application contains a Sequence Listing which has been submitted in ASCII format via EFS-Web and is hereby incorporated by reference in its entirety. Said ASCII copy, created on Feb. 14, 2020, is named 46790707301_SL.txt and is 36,245,354 bytes in size.

BIOLOGICAL DEPOSITS

This application contains a reference to a deposit of biological material. The following biological materials have been deposited with the American Type Culture Collection (ATCC), in Manassas, Va., and bear the following designations, accession numbers and dates of deposit: *Clostridium beijerinckii* (PTA-123634, deposited Dec. 14, 2016); and *Clostridium butyricum* (PTA-123635, deposited Dec. 14, 2016).

SUMMARY

In one aspect, the disclosure provides a method of treating a disorder in a subject in need thereof, the method comprising: administering a therapeutically-effective amount of a composition to a subject, wherein said composition comprises a population of isolated and purified microbes that increase production of butyrate in said subject, wherein said administering of said population of isolated and purified microbes results in modulation of a nervous system of said subject, thereby treating a disorder in said subject.

In some embodiments, the population of isolated and purified microbes comprises a microbe that modulates a gut-brain neural circuit in the subject.

In some embodiments, the modulation of the nervous system comprises altering activity of a nervous system receptor.

In some embodiments, the population comprises a microbe that encodes a polypeptide comprising a sequence that is at least about 85% identical to a butyrate kinase.

In some embodiments, the nervous system is an enteric nervous system. In some embodiments, the nervous system is a central nervous system.

In some embodiments, the composition increases production of GLP-1 in said subject.

In some embodiments, the population of isolated and purified microbes comprises a microbe that modulates neurotransmitter production in the subject. In some embodiments, the neurotransmitter is Gamma-aminobutyric acid (GABA).

In some embodiments, the population of isolated and purified microbes comprises a microbe that modulates production of a neuroactive metabolite in the subject.

In some embodiments, the disorder is a neurological or behavioral disorder. In some embodiments, the disorder is anxiety.

In some embodiments, the subject has gut dysbiosis.

In another aspect, the present disclosure provides a method of treating a metabolic disorder in a subject in need thereof, the method comprising: administering a therapeutically-effective amount of a composition comprising a population of isolated and purified microbes, wherein said population of isolated and purified microbes comprises a microbe that modulates activity of a G-protein coupled receptor (GPCR) in the subject.

In some embodiments, the population of isolated and purified microbes comprises a microbe that modulates butyrate production in the subject.

In some embodiments, the population of isolated and purified microbes comprises a microbe that modulates leptin production in the subject.

In some embodiments, the GPCR is a Free Fatty Acid (FFA) receptor in the subject. In some embodiments, the FFA is selected from the group consisting of: FFAR1, FFAR2, FFAR3, FFAR4, and any combination thereof. In some embodiments, the GPCR is GPR41.

In some embodiments, modulating the GPCR results in peptide tyrosine-tyrosine (PYY) production.

In some embodiments, modulating the GPCR results in GLP1 production.

In some embodiments, the modulating the GPCR results in modulation of an enteric nervous system of the subject.

In another aspect, the disclosure provides a method of treating a disorder in a subject in need thereof, the method comprising: administering a therapeutically-effective amount of a composition comprising a population of isolated and purified microbes, wherein said population of isolated and purified microbes comprises a microbe that modulates production of indole-3-propionate in the subject.

In some embodiments, the population of isolated and purified microbes is synergistic in the composition.

In some embodiments, the population comprises a first microbe that produces an intermediate molecule in a butyrate pathway. In some embodiments, the population comprises a second microbe that converts the intermediate molecule to butyrate.

In some embodiments, the treating results in improved behavior in the subject.

In some embodiments, the composition further comprises a pharmaceutically-acceptable carrier.

In some embodiments, the subject is human.

In some embodiments, the method further comprises a companion diagnostic.

In some embodiments, the pharmaceutical composition is formulated as an enteric-coated pill.

In some embodiments, the pharmaceutical composition is delivered to the subject's ileum and/or colon region.

In some embodiments, the pharmaceutical composition is administered before food intake.

In some embodiments, the pharmaceutical composition is formulated for oral delivery.

In some embodiments, the pharmaceutical composition further comprises a prebiotic. In some embodiments, the prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, *psyllium*, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In some embodiments, the prebiotic is an oligosaccharide. In some embodiments, the prebiotic is inulin.

In some embodiments, the pharmaceutical composition is administered after completion of an antibiotic regimen by the subject.

In some embodiments, the method further comprises determining the sequence of a population of the subject's microbiome by sequencing.

In some embodiments, the treating results in a subject with an altered microbiome.

In some embodiments, at least one of said microorganisms is a microbe with a rRNA sequence that is at least about 85% identical to the rRNA sequence of a microbe selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof.

In some embodiments, the composition produces butyrate in the subject.

In some embodiments, the composition produces propionate in the subject.

In some embodiments, the composition produces indole 3-propionate in the subject.

In some embodiments, the indole 3-propionate can be detected in a blood sample of the subject.

In some embodiments, the composition comprises at least 2 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof.

In some embodiments, the composition comprises at least 3 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Strep-* tococcus cremoris, *Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof.

In some embodiments, the composition comprises at least 4 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof.

In some embodiments, the composition comprises at least about $10^5$ colony forming units (CFU) of one or more microbes in said population of isolated and purified microbes.

In some embodiments, the population of isolated and purified microbes comprises a microbe that is an obligate anaerobe. In some embodiments, the obligate anaerobe is oxygen stable.

In some embodiments, the population comprises a cultured microbe.

In some embodiments, the population does not comprise fecal matter.

In one aspect, the disclosure provides a method of treating a disorder in a subject in need thereof, the method comprising: administering a therapeutically-effective amount of a composition to a subject, wherein the composition comprises a population of isolated and purified microbes, wherein said composition increases production of butyrate in said subject, wherein the increased butyrate production results in modulation of a nervous system of the subject, thereby treating a disorder in the subject. In one aspect, the population of isolated and purified microbes comprises a microbe that modulates a gut-brain axis in the subject. In one aspect, the population comprises a microbe that encodes a polypeptide comprising a sequence that is at least about 85% identical to a butyrate kinase. In one aspect, the nervous system is an enteric nervous system. In one aspect, the nervous system is a central nervous system. In one aspect, the nervous system is an autonomous nervous system. In one aspect, the composition increases production of GLP-1 in said subject. In one aspect, the composition activates a of Paraventricular Nucleus of Hypothalamus (PVN), parabrachial nucleus (PBN), nucleus tractus solitarii (NTS), or a combination thereof in said subject. In one aspect, the population of isolated and purified microbes comprises a microbe that modulates neurotransmitter production in the subject. In one aspect, the neurotransmitter is serotonin. In one aspect, the neurotransmitter is dopamine. In one aspect, the neurotransmitter is Gamma-aminobutyric acid (GABA). In one aspect, the population of isolated and purified microbes comprises a microbe that modulates production of a neuroactive metabolite in the subject. In one aspect, the neuroactive metabolite is selected from the group consisting of: branched chain and aromatic amino acids, p cresol, N acetyl putrescine, o cresol, phenol sulfate, kinurate, caproate, histamine, agmatine, or any combination thereof. In one aspect, the population of isolated and purified microbes comprises a microbe that modulates production of an inflammatory agent in the subject. In one aspect, the inflammatory agent is selected from the group consisting of: lipopolysaccharide, IL-1, IL-6, IL-8, TNF-alpha, CRP, or any combination thereof. In one aspect, the population of isolated and purified microbes comprises a microbe that modulates production of a steroid hormone in the subject. In one aspect, the steroid hormone is a corticosteroid. In one aspect, the corticosteroid is a glucocorticoid. In one aspect, the glucocorticoid is corticosterone. In one aspect, the glucocorticoid is cortisol. In one aspect, the population comprises a microbe that modulates said subject's thyroid homeostasis. In one aspect, the population comprises a microbe that modulates said subject's hypothalamus-pituitary-adrenal axis (HPA). In one aspect, the disorder is a neurological or behavioral disorder. In one aspect, the disorder is food addiction, anxiety, or Parkinson's disease. In one aspect, the subject has gut dysbiosis.

In one aspect, the disclosure provides a method of treating a disorder in a subject in need thereof. The method can comprise: administering a therapeutically-effective amount of a composition comprising a population of isolated and purified microbes, wherein the population of isolated and purified microbes comprises a microbe that modulates the subject's nervous system. In one aspect, the nervous system is an enteric nervous system. In one aspect, the nervous system is a central nervous system. In one aspect, the nervous system is an autonomous nervous system. In one aspect, a population of isolated and purified microbes comprises a microbe that modulates a gut-brain axis in the subject. In one aspect, a population of isolated and purified microbes comprises a microbe that modulates neurotransmitter production in the subject. In one aspect, a neurotransmitter is serotonin. In one aspect, a neurotransmitter is dopamine. In one aspect, a neurotransmitter is Gamma-aminobutyric acid (GABA). In one aspect, a population of isolated and purified microbes comprises a microbe that modulates production of a neuroactive metabolite in the subject. In one aspect, a neuroactive metabolite is selected from the group consisting of: branched chain and aromatic amino acids, p cresol, N acetyl putrescine, o cresol, phenol sulfate, kinurate, caproate, histamine, agmatine, or any combination thereof. In one aspect, a population of isolated and purified microbes comprises a microbe that modulates production of an inflammatory agent in the subject. In one aspect, an inflammatory agent is selected from the group consisting of: lipopolysaccharide, IL-1, IL-6, IL-8, TNF-alpha, CRP, or any combination thereof. In one aspect, a population of isolated and purified microbes comprises a microbe that modulates production of a steroid hormone in the subject. In one aspect, a steroid hormone is a corticosteroid. In one aspect, a corticosteroid is a glucocorticoid. In one aspect, a glucocorticoid is corticosterone. In one aspect, a glucocorticoid is cortisol. In one aspect, a population of isolated and purified microbes comprises a microbe that modulates a subject's thyroid homeostasis. In one aspect, a population of isolated and purified microbes comprises a microbe that modulates a subject's hypothalamus-pituitary-adrenal axis (HPA). In one aspect, a disorder is a neurological disorder. In one aspect, a disorder is a behavioral disorder. In one aspect, the neurological disorder is Alzheimer's disease. In one aspect, the disorder is stroke. In one aspect, the disorder is cerebral ischemia. In one aspect, the population of isolated and purified microbes comprises a microbe comprising at least about 85% sequence identity to a rRNA sequence of *Clostridium sporogenes*. In one aspect, a population of isolated and purified microbes comprises a microbe that modulates short-chain fatty acid (SCFA) production in the subject. In one aspect, a short-chain fatty acid is butyrate. In one aspect, a population of isolated and purified microbes comprises a microbe that encodes a polypeptide comprising a sequence that is at least about 85% identical to butyrate kinase. In one aspect, a subject has gut dysbiosis. In one aspect, the population of isolated and purified microbes is synergistic in the composition. In one aspect, the population of isolated and purified microbes comprises a first microbe that produces an intermediate molecule in a butyrate pathway. In one aspect, the population of isolated and purified microbes comprises a second microbe that converts the intermediate molecule to butyrate. In one aspect, the treating results in increased satiety in the subject. In one aspect, the treating results in reduced appetite in the subject. In one aspect, the treating results in improved behavior in the subject. In one aspect, the treating results in reduced body weight of the subject. In one aspect, the treating results in reduced adiposity in the subject. In one aspect, the treating results in improved glucose control in the subject. In one aspect, the treating results in improved insulin sensitivity in the subject. In one aspect, the composition further comprises a pharmaceutically-acceptable carrier. In one aspect, the subject is human. In one aspect, the method further comprises a companion diagnostic. In one aspect, the pharmaceutical composition is formulated as an enteric-coated pill. In one aspect, the pharmaceutical composition is delivered to the subject's ileum and/or colon region. In one aspect, the pharmaceutical composition is administered before food intake. In one aspect, the pharmaceutical composition is formulated for oral delivery. In one aspect, the pharmaceutical composition further comprises a prebiotic. In one aspect, a prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, *psyllium*, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In one aspect, a prebiotic is an oligosaccharide. In one aspect, a prebiotic is inulin. In one aspect, the pharmaceutical composition is administered after completion of an antibiotic regimen by the subject. In one aspect, the method further comprises determining the sequence of a population of the subject's microbiome by sequencing. In one aspect, treating results in a subject with an altered microbiome. In one aspect, at least one of the microorganisms is a microbe with a rRNA sequence that is at least about 85% identical to the rRNA sequence of a microbe selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativ-*

*orans, Methanobrevibacter smithii, Morganella morganii, Peptoniphilus asaccharolyticus, Peptostreptococcus,* and any combination thereof. In one aspect, the composition produces butyrate in the subject. In one aspect, the composition produces propionate in the subject. In one aspect, the composition produces indole 3-propionate in the subject. In one aspect, the indole 3-propionate can be detected in a blood sample of the subject. In one aspect, the composition increases butyrate production by at least about 1%, 5%, 10%, 15%, 30%, 50%, 75%, 80%, 90%, or 100% in the subject. In one aspect, the composition increases butyrate production by at least about 1%, 5%, 10%, 15%, 30%, 50%, 75%, 80%, 90%, or 100% in the subject compared to a control subject that is not treated with the composition. In one aspect, the composition increases indole 3-propionate production by at least about 1%, 5%, 10%, 15%, 30%, 50%, 75%, 80%, 90%, or 100% in the subject. In one aspect, the composition increases indole 3-propionate production by at least about 1%, 5%, 10%, 15%, 30%, 50%, 75%, 80%, 90%, or 100% in the subject compared to a control subject that is not treated with the composition. In one aspect, the pharmaceutical composition is formulated for oral administration. In one aspect, the composition comprises at least 2 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof. In one aspect, the composition comprises at least 3 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyri-* cum *Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least about $10^5$ colony forming units (CFU) of one or more microbes in said population of isolated and purified microbes. In one aspect, the population of isolated and purified microbes comprises a microbe that is an obligate anaerobe. In one aspect, the obligate anaerobe is oxygen stable.

In one aspect, the disclosure provides a method of treating a metabolic disorder in a subject in need thereof, the method comprising: administering a therapeutically-effective amount of a composition comprising a population of isolated and purified microbes, wherein said population of isolated and purified microbes comprises a microbe that modulates activity of a G-protein coupled receptor (GPCR) in the subject. In one aspect, a population of isolated and purified microbes comprises a microbe that modulates butyrate production in the subject. In one aspect, a population of isolated and purified microbes comprises a microbe that modulates leptin production in the subject. In one aspect, a GPCR is a Free Fatty Acid (FFA) receptor in the subject. In one aspect, a FFA is selected from the group consisting of: FFAR1, FFAR2, FFAR3, FFAR4, and any combination thereof. In one aspect, a GPCR is GPR41. In one aspect, modulation of the GPCR activity results in peptide tyrosine-tyrosine (PYY) production. In one aspect, modulating the GPCR results in GLP1 production. In one aspect, modulating the GPCR results in modulation of an enteric nervous system of the subject. In one aspect, a population of isolated and purified microbes comprises a microbe that modulates a gut-brain axis in the subject. In one aspect, a population of isolated and purified microbes comprises a microbe that modulates neurotransmitter production in the subject. In one aspect, a neurotransmitter is serotonin. In one aspect, a neurotransmitter is dopamine. In one aspect, a neurotransmitter is Gamma-aminobutyric acid (GABA). In one aspect, a population of isolated and purified microbes comprises a microbe that modulates production of a neuroactive metabolite in the subject. In one aspect, a neuroactive metabolite is selected from the group consisting of: branched chain and aromatic amino acids, p cresol, N acetyl putrescine, o cresol, phenol sulfate, kinurate, caproate, histamine, agmatine, or any combination thereof. In one aspect, a population of isolated and purified microbes comprises a microbe that modulates production of an inflammatory agent in the subject. In one aspect, an inflammatory agent is selected from the group consisting of: lipopolysaccharide, IL-1, IL-6, IL-8, TNF-alpha, CRP, or any combination thereof. In one aspect, a population of isolated and purified microbes comprises a microbe that modulates production of a steroid hormone in the subject. In one aspect, a steroid hormone is a corticosteroid. In one aspect, a corticosteroid is a glucocorticoid. In one aspect, a glucocorticoid is corticosterone. In one aspect, a glucocorticoid is cortisol. In one aspect, a population of isolated and purified microbes comprises a microbe that modulates a subject's thyroid homeostasis. In one aspect, a population of isolated and purified microbes comprises a microbe that modulates a subject's hypothalamus-pituitary-adrenal axis (HPA). In one aspect, a population of isolated and purified microbes comprises a microbe that modulates short-chain fatty acid production in the subject. In one aspect, a short-chain fatty acid is butyrate. In one aspect, a population of isolated and purified microbes comprises a microbe that modulates butyrate production in the subject. In one aspect, a population of isolated and purified microbes comprises a microbe that encodes a polypeptide comprising a sequence that is at least about 85% identical to butyrate kinase. In one aspect, a subject has gut dysbiosis. In one aspect, the population of isolated and purified microbes is synergistic in the composition. In one aspect, the population of isolated and purified microbes comprises a first microbe that produces an intermediate molecule in a butyrate pathway. In one aspect, the population of isolated and purified microbes comprises a second microbe that converts the intermediate molecule to butyrate. In one aspect, the treating results in increased satiety in the subject. In one aspect, the treating results in reduced appetite in the subject. In one aspect, the treating results in improved behavior in the subject. In one aspect, the treating results in reduced body weight of the subject. In one aspect, the treating results in reduced adiposity in the subject. In one aspect, the treating results in improved glucose control in the subject. In one aspect, the treating results in improved insulin sensitivity in the subject. In one aspect, the composition further comprises a pharmaceutically-acceptable carrier. In one aspect, the subject is human. In one aspect, the method further comprises a companion diagnostic. In one aspect, the pharmaceutical composition is formulated as an enteric-coated pill. In one aspect, the pharmaceutical composition is delivered to the subject's ileum and/or colon region. In one aspect, the pharmaceutical composition is administered before food intake. In one aspect, the pharmaceutical composition is formulated for oral delivery. In one aspect, the pharmaceutical composition further comprises a prebiotic. In one aspect, a prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, *psyllium*, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In one aspect, a prebiotic is an oligosaccharide. In one aspect, a prebiotic is inulin. In one aspect, the pharmaceutical composition is administered after completion of an antibiotic regimen by the subject. In one aspect, the method further comprises determining the sequence of a population of the subject's microbiome by sequencing. In one aspect, treating results in a subject with an altered microbiome. In one aspect, at least one of the microorganisms is a microbe with a rRNA sequence that is at least about 85% identical to the rRNA sequence of a microbe selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactoba-* cillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition produces butyrate in the subject. In one aspect, the composition produces propionate in the subject. In one aspect, the composition produces indole 3-propionate in the subject. In one aspect, the indole 3-propionate can be detected in a blood sample of the subject. In one aspect, the composition increases butyrate production by at least about 1%, 5%, 10%, 15%, 30%, 50%, 75%, 80%, 90%, or 100% in the subject. In one aspect, the composition increases butyrate production by at least about 1%, 5%, 10%, 15%, 30%, 50%, 75%, 80%, 90%, or 100% in the subject compared to a control subject that is not treated with the composition. In one aspect, the composition increases indole 3-propionate production by at least about 1%, 5%, 10%, 15%, 30%, 50%, 75%, 80%, 90%, or 100% in the subject. In one aspect, the composition increases indole 3-propionate production by at least about 1%, 5%, 10%, 15%, 30%, 50%, 75%, 80%, 90%, or 100% in the subject compared to a control subject that is not treated with the composition. In one aspect, the pharmaceutical composition is formulated for oral administration. In one aspect, the composition comprises at least 2 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least 3 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least 4 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, *Clostridium beijerinckii*, *Clostridium butyricum*, *Clostridium colinum*, *Clostridium coccoides*, *Clostridium indolis*, *Clostridium nexile*, *Clostridium orbiscindens*, *Clostridium propionicum*, *Clostridium xylanolyticum*, *Enterococcus faecium*, *Eubacterium hallii*, *Eubacterium rectale*, *Faecalibacterium prausnitzii*, *Fibrobacter succinogenes*, *Lactobacillus acidophilus*, *Lactobacillus brevis*, *Lactobacillus bulgaricus*, *Lactobacillus casei*, *Lactobacillus caucasicus*, *Lactobacillus fermentum*, *Lactobacillus helveticus*, *Lactobacillus lactis*, *Lactobacillus plantarum*, *Lactobacillus reuteri*, *Lactobacillus rhamnosus*, *Oscillospira guilliermondii*, *Roseburia cecicola*, *Roseburia inulinivorans*, *Ruminococcus flavefaciens*, *Ruminococcus gnavus*, *Ruminococcus obeum*, *Stenotrophomonas nitritireducens*, *Streptococcus cremoris*, *Streptococcus faecium*, *Streptococcus infantis*, *Streptococcus mutans*, *Streptococcus thermophilus*, *Anaerofustis stercorihominis*, *Anaerostipes hadrus*, *Anaerotruncus colihominis*, *Clostridium sporogenes*, *Clostridium tetani*, *Coprococcus*, *Coprococcus eutactus*, *Eubacterium cylindroides*, *Eubacterium dolichum*, *Eubacterium ventriosum*, *Roseburia faeccis*, *Roseburia hominis*, *Roseburia intestinalis*, *Lactobacillus bifidus*, *Lactobacillus johnsonii*, *Acidaminococcus fermentans*, *Acidaminococcus intestine*, *Blautia hydrogenotrophica*, *Citrobacter amalonaticus*, *Citrobacter freundii*, *Clostridium aminobutyricum* *Clostridium bartlettii*, *Clostridium cochlearium*, *Clostridium kluyveri*, *Clostridium limosum*, *Clostridium malenominatum*, *Clostridium pasteurianum*, *Clostridium peptidivorans*, *Clostridium saccharobutylicum*, *Clostridium sporosphaeroides*, *Clostridium sticklandii*, *Clostridium subterminale*, *Clostridium symbiosum*, *Clostridium tetanomorphum*, *Eubacterium oxidoreducens*, *Eubacterium pyruvativorans*, *Methanobrevibacter smithii*, *Morganella morganii*, *Peptoniphilus asaccharolyticus*, *Peptostreptococcus*, and any combination thereof. In one aspect, the composition comprises at least about $10^5$ colony forming units (CFU) of one or more microbes in said population of isolated and purified microbes. In one aspect, the population of isolated and purified microbes comprises a microbe that is an obligate anaerobe. In one aspect, the obligate anaerobe is oxygen stable.

In one aspect, the disclosure provides a method of treating a disorder in a subject in need thereof, the method comprising: administering a therapeutically-effective amount of a composition comprising a population of isolated and purified microbes, wherein said population of isolated and purified microbes comprises a microbe that modulates cytokine production in the subject. In one aspect, a disorder is an immune system disorder. In one aspect, a population of isolated and purified microbes comprises a microbe that modulates butyrate production in the subject. In one aspect, a population of isolated and purified microbes comprises a microbe that modulates a gut-brain axis in the subject. In one aspect, a population of isolated and purified microbes comprises a microbe that modulates neurotransmitter production in the subject. In one aspect, a neurotransmitter is serotonin. In one aspect, a neurotransmitter is dopamine. In one aspect, a neurotransmitter is Gamma-aminobutyric acid (GABA). In one aspect, a population of isolated and purified microbes comprises a microbe that modulates production of a neuroactive metabolite in the subject. In one aspect, a neuroactive metabolite is selected from the group consisting of: branched chain and aromatic amino acids, p cresol, N acetyl putrescine, o cresol, phenol sulfate, kinurate, caproate, histamine, agmatine, or any combination thereof. In one aspect, a population of isolated and purified microbes comprises a microbe that modulates production of an inflammatory agent in the subject. In one aspect, an inflammatory agent is selected from the group consisting of: lipopolysaccharide, IL-1, IL-6, IL-8, TNF-alpha, CRP, or any combination thereof. In one aspect, a population of isolated and purified microbes comprises a microbe that modulates production of a steroid hormone in the subject. In one aspect, a steroid hormone is a corticosteroid. In one aspect, a corticosteroid is a glucocorticoid. In one aspect, a glucocorticoid is corticosterone. In one aspect, a glucocorticoid is cortisol. In one aspect, a population of isolated and purified microbes comprises a microbe that modulates a subject's thyroid homeostasis. In one aspect, a population of isolated and purified microbes comprises a microbe that modulates a subject's hypothalamus-pituitary-adrenal axis (HPA). In one aspect, a disorder is a neurological disorder. In one aspect, a disorder is a behavioral disorder. In one aspect, the neurological disorder is Alzheimer's disease. In one aspect, the disorder is stroke. In one aspect, the disorder is cerebral ischemia. In one aspect, the population of isolated and purified microbes comprises a microbe comprising at least about 85% sequence identity to a rRNA sequence of *Clostridium sporogenes*. In one aspect, a population of isolated and purified microbes comprises a microbe that modulates short-chain fatty acid production in the subject. In one aspect, a short-chain fatty acid is butyrate. In one aspect, a population of isolated and purified microbes comprises a microbe that encodes a polypeptide comprising a sequence that is at least about 85% identical to butyrate kinase. In one aspect, a subject has gut dysbiosis. In one aspect, the population of isolated and purified microbes is synergistic in the composition. In one aspect, the population of isolated and purified microbes comprises a first microbe that produces an intermediate molecule in a butyrate pathway. In one aspect, the population of isolated and purified microbes comprises a second microbe that converts the intermediate molecule to butyrate. In one aspect, the treating results in increased satiety in the subject. In one aspect, the treating results in reduced appetite in the subject. In one aspect, the treating results in improved behavior in the subject. In one aspect, the treating results in reduced body weight of the subject. In one aspect, the treating results in reduced adiposity in the subject. In one aspect, the treating results in improved glucose control in the subject. In one aspect, the treating results in improved insulin sensitivity in the subject. In one aspect, the composition further comprises a pharmaceutically-acceptable carrier. In one aspect, the subject is human. In one aspect, the method further comprises a companion diagnostic. In one aspect, the pharmaceutical composition is formulated as an enteric-coated pill. In one aspect, the pharmaceutical composition is delivered to the subject's ileum and/or colon region. In one aspect, the pharmaceutical composition is administered before food intake. In one aspect, the pharmaceutical composition is formulated for oral delivery. In one aspect, the pharmaceutical composition further comprises a prebiotic. In one aspect, a prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, *psyllium*, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In one aspect, a prebiotic is an oligosaccharide. In one aspect, a prebiotic is inulin. In one aspect, the pharmaceutical composition is administered after completion of an antibiotic regimen by the subject. In one aspect, the method further comprises determining the sequence of a population of the subject's microbiome by sequencing. In one aspect, treating results in a subject with an altered microbiome. In one aspect, at least one of the microorganisms is a microbe with a rRNA sequence that is at least about 85% identical to a rRNA sequence of a microbe selected from the group consisting of: Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition produces butyrate in the subject. In one aspect, the composition produces propionate in the subject. In one aspect, the composition produces indole 3-propionate in the subject. In one aspect, the indole 3-propionate can be detected in a blood sample of the subject. In one aspect, the composition increases butyrate production by at least about 1%, 5%, 10%, 15%, 30%, 50%, 75%, 80%, 90%, or 100% in the subject. In one aspect, the composition increases butyrate production by at least about 1%, 5%, 10%, 15%, 30%, 50%, 75%, 80%, 90%, or 100% in the subject compared to a control subject that is not treated with the composition. In one aspect, the composition increases indole 3-propionate production by at least about 1%, 5%, 10%, 15%, 30%, 50%, 75%, 80%, 90%, or 100% in the subject. In one aspect, the composition increases indole 3-propionate production by at least about 1%, 5%, 10%, 15%, 30%, 50%, 75%, 80%, 90%, or 100% in the subject compared to a control subject that is not treated with the composition. In one aspect, the pharmaceutical composition is formulated for oral administration. In one aspect, the composition comprises at least 2 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least 3 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least 4 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least about $10^5$ colony forming units (CFU) of one or more microbes in said population of isolated and purified microbes. In one aspect, the population of isolated and purified microbes comprises a microbe that is an obligate anaerobe. In one aspect, the obligate anaerobe is oxygen stable.

In one aspect, the disclosure provides a method of treating a disorder in a subject in need thereof, the method comprising: administering a therapeutically-effective amount of a composition comprising a population of isolated and purified microbes, wherein said population of isolated and purified microbes comprises a microbe that modulates a nuclear factor kappa-light-chain-enhancer of activated B cells (NF-κB) pathway in the subject. In one aspect, a disorder is a neurological disorder. In one aspect, a disorder is a behavioral disorder. In one aspect, the neurological disorder is Alzheimer's disease. In one aspect, the disorder is stroke. In one aspect, the disorder is cerebral ischemia. In one aspect, the population of isolated and purified microbes comprises a microbe comprising at least about 85% sequence identity to a rRNA sequence of Clostridium sporogenes. In one aspect, a population of isolated and purified microbes comprises a microbe that modulates short-chain fatty acid production in the subject. In one aspect, a short-chain fatty acid is butyrate. In one aspect, a population of isolated and purified microbes comprises a microbe that encodes a polypeptide comprising a sequence that is at least about 85% identical to butyrate kinase. In one aspect, a subject has gut dysbiosis. In one aspect, the population of isolated and purified microbes is synergistic in the composition. In one aspect, the population of isolated and purified microbes comprises a first microbe that produces an intermediate molecule in a butyrate pathway. In one aspect, the population of isolated and purified microbes comprises a second microbe that converts the intermediate molecule to butyrate. In one aspect, the treating results in increased satiety in the subject. In one aspect, the treating results in reduced appetite in the subject. In one aspect, the treating results in improved behavior in the subject. In one aspect, the treating results in reduced body weight of the subject. In one aspect, the treating results in reduced adiposity in the subject. In one aspect, the treating results in improved glucose control in the subject. In one aspect, the treating results in improved insulin sensitivity in the subject. In one aspect, the composition further comprises a pharmaceutically-acceptable carrier. In one aspect, the subject is human. In one aspect, the method further comprises a companion diagnostic. In one aspect, the pharmaceutical composition is formulated as an enteric-coated pill. In one aspect, the pharmaceutical composition is delivered to the subject's ileum and/or colon region. In one aspect, the pharmaceutical composition is administered before food intake. In one aspect, the pharmaceutical composition is formulated for oral delivery. In one aspect, the pharmaceutical composition further comprises a prebiotic. In one aspect, a prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, psyllium, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In one aspect, a prebiotic is an oligosaccharide. In one aspect, a prebiotic is inulin. In one aspect, the pharmaceutical composition is administered after completion of an antibiotic regimen by the subject. In one aspect, the method further comprises determining the sequence of a population of the subject's microbiome by sequencing. In one aspect, treating results in a subject with an altered microbiome. In one aspect, at least one of the microorganisms is a microbe with a rRNA sequence that is at least about 85% identical to the rRNA sequence of a microbe selected from the group consisting of:

*Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof. In one aspect, the composition produces butyrate in the subject. In one aspect, the composition produces propionate in the subject. In one aspect, the composition produces indole 3-propionate in the subject. In one aspect, the indole 3-propionate can be detected in a blood sample of the subject. In one aspect, the composition increases butyrate production by at least about 1%, 5%, 10%, 15%, 30%, 50%, 75%, 80%, 90%, or 100% in the subject. In one aspect, the composition increases butyrate production by at least about 1%, 5%, 10%, 15%, 30%, 50%, 75%, 80%, 90%, or 100% in the subject compared to a control subject that is not treated with the composition. In one aspect, the composition increases indole 3-propionate production by at least about 1%, 5%, 10%, 15%, 30%, 50%, 75%, 80%, 90%, or 100% in the subject. In one aspect, the composition increases indole 3-propionate production by at least about 1%, 5%, 10%, 15%, 30%, 50%, 75%, 80%, 90%, or 100% in the subject compared to a control subject that is not treated with the composition. In one aspect, the pharmaceutical composition is formulated for oral administration. In one aspect, the composition comprises at least 2 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof. In one aspect, the composition comprises at least 3 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccha-* robutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least 4 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least about $10^5$ colony forming units (CFU) of one or more microbes in said population of isolated and purified microbes. In one aspect, the population of isolated and purified microbes comprises a microbe that is an obligate anaerobe. In one aspect, the obligate anaerobe is oxygen stable.

In one aspect, the disclosure provides a method of treating cancer in a subject in need thereof, the method comprising: administering a therapeutically-effective amount of a composition comprising a population of isolated and purified microbes, wherein said population of isolated and purified microbes comprises a microbe that modulates cell cycle arrest in the subject. In one aspect, a population of isolated and purified microbes comprises a microbe that modulates short-chain fatty acid production in the subject. In one aspect, a short-chain fatty acid is butyrate. In one aspect, a population of isolated and purified microbes comprises a microbe that encodes a polypeptide comprising a sequence that is at least about 85% identical to butyrate kinase. In one aspect, a subject has gut dysbiosis. In one aspect, the population of isolated and purified microbes is synergistic in the composition. In one aspect, the population of isolated and purified microbes comprises a first microbe that produces an intermediate molecule in a butyrate pathway. In one aspect, the population of isolated and purified microbes comprises a second microbe that converts the intermediate molecule to butyrate. In one aspect, the treating results in increased satiety in the subject. In one aspect, the treating results in reduced appetite in the subject. In one aspect, the treating results in improved behavior in the subject. In one aspect, the treating results in reduced body weight of the subject. In one aspect, the treating results in reduced adiposity in the subject. In one aspect, the treating results in improved glucose control in the subject. In one aspect, the treating results in improved insulin sensitivity in the subject. In one aspect, the composition further comprises a pharmaceutically-acceptable carrier. In one aspect, the subject is human. In one aspect, the method further comprises a companion diagnostic. In one aspect, the pharmaceutical composition is formulated as an enteric-coated pill. In one aspect, the pharmaceutical composition is delivered to the subject's ileum and/or colon region. In one aspect, the pharmaceutical composition is administered before food intake. In one aspect, the pharmaceutical composition is formulated for oral delivery. In one aspect, the pharmaceutical composition further comprises a prebiotic. In one aspect, a prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, psyllium, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In one aspect, a prebiotic is an oligosaccharide. In one aspect, a prebiotic is inulin. In one aspect, the pharmaceutical composition is administered after completion of an antibiotic regimen by the subject. In one aspect, the method further comprises determining the sequence of a population of the subject's microbiome by sequencing. In one aspect, treating results in a subject with an altered microbiome. In one aspect, at least one of the microorganisms is a microbe with a rRNA sequence that is at least about 85% identical to the rRNA sequence of a microbe selected from the group consisting of: Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus fae-

*cium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof. In one aspect, the composition produces butyrate in the subject. In one aspect, the composition produces propionate in the subject. In one aspect, the composition produces indole 3-propionate in the subject. In one aspect, the indole 3-propionate can be detected in a blood sample of the subject. In one aspect, the composition increases butyrate production by at least about 1%, 5%, 10%, 15%, 30%, 50%, 75%, 80%, 90%, or 100% in the subject. In one aspect, the composition increases butyrate production by at least about 1%, 5%, 10%, 15%, 30%, 50%, 75%, 80%, 90%, or 100% in the subject compared to a control subject that is not treated with the composition. In one aspect, the composition increases indole 3-propionate production by at least about 1%, 5%, 10%, 15%, 30%, 50%, 75%, 80%, 90%, or 100% in the subject. In one aspect, the composition increases indole 3-propionate production by at least about 1%, 5%, 10%, 15%, 30%, 50%, 75%, 80%, 90%, or 100% in the subject compared to a control subject that is not treated with the composition. In one aspect, the pharmaceutical composition is formulated for oral administration. In one aspect, the composition comprises at least 2 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof. In one aspect, the composition comprises at least 3 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof. In one aspect, the composition comprises at least 4 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lac-* tobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least about $10^5$ colony forming units (CFU) of one or more microbes in said population of isolated and purified microbes. In one aspect, the population of isolated and purified microbes comprises a microbe that is an obligate anaerobe. In one aspect, the obligate anaerobe is oxygen stable.

In one aspect, the disclosure provides a method of treating cancer in a subject in need thereof, the method comprising: administering a therapeutically-effective amount of a composition comprising a population of isolated and purified microbes, wherein said population of isolated and purified microbes comprises a microbe that produces butyrate. In one aspect, a population of isolated and purified microbes comprises a microbe that modulates short-chain fatty acid production in the subject. In one aspect, a short-chain fatty acid is butyrate. In one aspect, a population of isolated and purified microbes comprises a microbe that encodes a polypeptide comprising a sequence that is at least about 85% identical to butyrate kinase. In one aspect, a subject has gut dysbiosis. In one aspect, the population of isolated and purified microbes is synergistic in the composition. In one aspect, the population of isolated and purified microbes comprises a first microbe that produces an intermediate molecule in a butyrate pathway. In one aspect, the population of isolated and purified microbes comprises a second microbe that converts the intermediate molecule to butyrate. In one aspect, the treating results in increased satiety in the subject. In one aspect, the treating results in reduced appetite in the subject. In one aspect, the treating results in improved behavior in the subject. In one aspect, the treating results in reduced body weight of the subject. In one aspect, the treating results in reduced adiposity in the subject. In one aspect, the treating results in improved glucose control in the subject. In one aspect, the treating results in improved insulin sensitivity in the subject. In one aspect, the composition further comprises a pharmaceutically-acceptable carrier. In one aspect, the subject is human. In one aspect, the method further comprises a companion diagnostic. In one aspect, the pharmaceutical composition is formulated as an enteric-coated pill. In one aspect, the pharmaceutical composition is delivered to the subject's ileum and/or colon region. In one aspect, the pharmaceutical composition is administered before food intake. In one aspect, the pharmaceutical composition is formulated for oral delivery. In one aspect, the pharmaceutical composition further comprises a prebiotic. In one aspect, a prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, psyllium, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In one aspect, a prebiotic is an oligosaccharide. In one aspect, a prebiotic is inulin. In one aspect, the pharmaceutical composition is administered after completion of an antibiotic regimen by the subject. In one aspect, the method further comprises determining the sequence of a population of the subject's microbiome by sequencing. In one aspect, treating results in a subject with an altered microbiome. In one aspect, at least one of the microorganisms is a microbe with a rRNA sequence that is at least about 85% identical to the rRNA sequence of a microbe selected from the group consisting of: Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition produces butyrate in the subject. In one aspect, the composition produces propionate in the subject. In one aspect, the composition produces indole 3-propionate in the subject. In one aspect, the indole 3-propionate can be detected in a blood sample of the subject. In one aspect, the composition increases butyrate production by at least about 1%, 5%, 10%, 15%, 30%, 50%, 75%, 80%, 90%, or 100% in the subject. In one aspect, the composition increases butyrate production by at least about 1%, 5%, 10%, 15%, 30%, 50%, 75%, 80%, 90%, or 100% in the subject compared to a control subject that is not treated with the composition. In one aspect, the composition increases indole 3-propionate production by at least about 1%, 5%, 10%, 15%, 30%, 50%, 75%, 80%, 90%, or 100% in the subject. In one aspect, the composition increases indole 3-propionate production by at least about 1%, 5%, 10%, 15%, 30%, 50%, 75%, 80%, 90%, or 100% in the subject compared to a control subject that is not treated with the composition. In one aspect, the pharmaceutical composition is formulated for oral administration. In one aspect, the composition comprises at least 2 different microbial species selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least 3 different microbial species selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least 4 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium*

*malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least about $10^5$ colony forming units (CFU) of one or more microbes in said population of isolated and purified microbes. In one aspect, the population of isolated and purified microbes comprises a microbe that is an obligate anaerobe. In one aspect, the obligate anaerobe is oxygen stable.

In one aspect, the disclosure provides a method of treating cancer in a subject in need thereof, the method comprising: administering a therapeutically-effective amount of a composition comprising a population of isolated and purified microbes, wherein said population of isolated and purified microbes comprises a microbe that modulates a histone deacetylase (HDAC) in the subject. In one aspect, a population of isolated and purified microbes comprises a microbe that modulates short-chain fatty acid production in the subject. In one aspect, a short-chain fatty acid is butyrate. In one aspect, a population of isolated and purified microbes comprises a microbe that encodes a polypeptide comprising a sequence that is at least about 85% identical to butyrate kinase. In one aspect, a subject has gut dysbiosis. In one aspect, the population of isolated and purified microbes is synergistic in the composition. In one aspect, the population of isolated and purified microbes comprises a first microbe that produces an intermediate molecule in a butyrate pathway. In one aspect, the population of isolated and purified microbes comprises a second microbe that converts the intermediate molecule to butyrate. In one aspect, the treating results in increased satiety in the subject. In one aspect, the treating results in reduced appetite in the subject. In one aspect, the treating results in improved behavior in the subject. In one aspect, the treating results in reduced body weight of the subject. In one aspect, the treating results in reduced adiposity in the subject. In one aspect, the treating results in improved glucose control in the subject. In one aspect, the treating results in improved insulin sensitivity in the subject. In one aspect, the composition further comprises a pharmaceutically-acceptable carrier. In one aspect, the subject is human. In one aspect, the method further comprises a companion diagnostic. In one aspect, the pharmaceutical composition is formulated as an enteric-coated pill. In one aspect, the pharmaceutical composition is delivered to the subject's ileum and/or colon region. In one aspect, the pharmaceutical composition is administered before food intake. In one aspect, the pharmaceutical composition is formulated for oral delivery. In one aspect, the pharmaceutical composition further comprises a prebiotic. In one aspect, a prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, *psyllium*, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In one aspect, a prebiotic is an oligosaccharide. In one aspect, a prebiotic is inulin. In one aspect, the pharmaceutical composition is administered after completion of an antibiotic regimen by the subject. In one aspect, the method further comprises determining the sequence of a population of the subject's microbiome by sequencing. In one aspect, treating results in a subject with an altered microbiome. In one aspect, at least one of the microorganisms is a microbe with a rRNA sequence that is at least about 85% identical to the rRNA sequence of a microbe selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition produces butyrate in the subject. In one aspect, the composition produces propionate in the subject. In one aspect, the composition produces indole 3-propionate in the subject. In one aspect, the indole 3-propionate can be detected in a blood sample of the subject. In one aspect, the composition increases butyrate production by at least about 1%, 5%, 10%, 15%, 30%, 50%, 75%, 80%, 90%, or 100% in the subject. In one aspect, the composition increases butyrate production by at least about 1%, 5%, 10%, 15%, 30%, 50%, 75%, 80%, 90%, or 100% in the subject compared to a control subject that is not treated with the composition. In one aspect, the composition increases indole 3-propionate production by at least about 1%, 5%, 10%, 15%, 30%, 50%, 75%, 80%, 90%, or 100% in the subject. In one aspect, the composition increases indole 3-propionate production by at least about 1%, 5%, 10%, 15%, 30%, 50%, 75%, 80%, 90%, or 100% in the subject compared to a control subject that is not treated with the composition. In one aspect, the pharmaceutical composition is formulated for oral administration. In one aspect, the composition comprises at least 2 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least 3 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least 4 different microbial species selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least about $10^5$ colony forming units (CFU) of one or more microbes in said population of isolated and purified microbes. In one aspect, the population of isolated and purified microbes comprises a microbe that is an obligate anaerobe. In one aspect, the obligate anaerobe is oxygen stable.

In one aspect, the disclosure provides a method of treating a disorder in a subject in need thereof, the method comprising: administering a therapeutically-effective amount of a composition comprising a population of isolated and purified microbes, wherein said population of isolated and purified microbes comprises a microbe that modulates production of indole-3-propionate in the subject. In one aspect, a population of isolated and purified microbes comprises a microbe that modulates a gut-brain axis in the subject. In one aspect, a population of isolated and purified microbes comprises a microbe that modulates neurotransmitter production in the subject. In one aspect, a neurotransmitter is serotonin. In one aspect, a neurotransmitter is dopamine. In one aspect, a neurotransmitter is Gamma-aminobutyric acid (GABA). In one aspect, a population of isolated and purified microbes comprises a microbe that modulates production of a neuroactive metabolite in the subject. In one aspect, a neuroactive metabolite is selected from the group consisting of: branched chain and aromatic amino acids, p cresol, N acetyl putrescine, o cresol, phenol sulfate, kinurate, caproate, histamine, agmatine, or any combination thereof. In one aspect, a population of isolated and purified microbes comprises a microbe that modulates production of an inflammatory agent in the subject. In one aspect, an inflammatory agent is selected from the group consisting of: lipopolysaccharide, IL-1, IL-6, IL-8, TNF-alpha, CRP, or any combination thereof. In one aspect, a population of isolated and purified microbes comprises a microbe that modulates production of a steroid hormone in the subject. In one aspect, a steroid hormone is a corticosteroid. In one aspect, a corticosteroid is a glucocorticoid. In one aspect, a glucocorticoid is corticosterone. In one aspect, a glucocorticoid is cortisol. In one aspect, a population of isolated and purified microbes comprises a microbe that modulates a subject's thyroid homeostasis. In one aspect, a population of isolated and purified microbes comprises a microbe that modulates a subject's hypothalamus-pituitary-adrenal axis (HPA). In one aspect, a disorder is a neurological disorder. In one aspect, a disorder is a behavioral disorder. In one aspect, the neurological disorder is Alzheimer's disease. In one aspect, the disorder is stroke. In one aspect, the disorder is cerebral ischemia. In one aspect, the population of isolated and purified microbes comprises a microbe comprising at least about 85% sequence identity to a rRNA sequence of *Clostridium sporogenes*. In one aspect, a population of isolated and purified microbes comprises a microbe that modulates short-chain fatty acid production in the subject. In one aspect, a short-chain fatty acid is butyrate. In one aspect, a population of isolated and purified microbes comprises a microbe that encodes a polypeptide comprising a sequence that is at least about 85% identical to butyrate kinase. In one aspect, a subject has gut dysbiosis. In one aspect, the population of isolated and purified microbes is synergistic in the composition. In one aspect, the population of isolated and purified microbes comprises a first microbe that produces an intermediate molecule in a butyrate pathway. In one aspect, the population of isolated and purified microbes comprises a second microbe that converts the intermediate molecule to butyrate. In one aspect, the treating results in increased satiety in the subject. In one aspect, the treating results in reduced appetite in the subject. In one aspect, the treating results in improved behavior in the subject. In one aspect, the treating results in reduced body weight of the subject. In one aspect, the treating results in reduced adiposity in the subject. In one aspect, the treating results in improved glucose control in the subject. In one aspect, the treating results in improved insulin sensitivity in the subject. In one aspect, the composition further comprises a pharmaceutically-acceptable carrier. In one aspect, the subject is human. In one aspect, the method further comprises a companion diagnostic. In one aspect, the pharmaceutical composition is formulated as an enteric-coated pill. In one aspect, the pharmaceutical composition is delivered to the subject's ileum and/or colon region. In one aspect, the pharmaceutical composition is administered before food intake. In one aspect, the pharmaceutical composition is formulated for oral delivery. In one aspect, the pharmaceutical composition further comprises a prebiotic. In one aspect, a prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, *psyllium*, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In one aspect, a prebiotic is an oligosaccharide. In one aspect, a prebiotic is inulin. In one aspect, the pharmaceutical composition is administered after completion of an antibiotic regimen by the subject. In one aspect, the method further comprises determining the sequence of a population of the subject's microbiome by sequencing. In one aspect, treating results in a subject with an altered microbiome. In one aspect, at least one of the microorganisms is a microbe with a rRNA sequence that is at least about 85% identical to the rRNA sequence of a microbe selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition produces butyrate in the subject. In one aspect, the composition produces propionate in the subject. In one aspect, the composition produces indole 3-propionate in the subject. In one aspect, the indole 3-propionate can be detected in a blood sample of the subject. In one aspect, the composition increases butyrate production by at least about 1%, 5%, 10%, 15%, 30%, 50%, 75%, 80%, 90%, or 100% in the subject. In one aspect, the composition increases butyrate production by at least about 1%, 5%, 10%, 15%, 30%, 50%, 75%, 80%, 90%, or 100% in the subject compared to a control subject that is not treated with the composition. In one aspect, the composition increases indole 3-propionate production by at least about 1%, 5%, 10%, 15%, 30%, 50%, 75%, 80%, 90%, or 100% in the subject. In one aspect, the composition increases indole 3-propionate production by at least about 1%, 5%, 10%, 15%, 30%, 50%, 75%, 80%, 90%, or 100% in the subject compared to a control subject that is not treated with the composition. In one aspect, the pharmaceutical composition is formulated for oral administration. In one aspect, the composition comprises at least 2 different microbial species selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least 3 different microbial species selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least 4 different microbial species selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium*

*malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof. In one aspect, the composition comprises at least about $10^5$ colony forming units (CFU) of one or more microbes in said population of isolated and purified microbes. In one aspect, the population of isolated and purified microbes comprises a microbe that is an obligate anaerobe. In one aspect, the obligate anaerobe is oxygen stable.

In one aspect, the disclosure provides a method of treating a disorder in a subject in need thereof, the method comprising: administering a therapeutically-effective amount of a composition comprising a population of isolated and purified microbes, wherein said population of isolated and purified microbes comprises a microbe that modulates a nuclear receptor in the subject. In one aspect, a nuclear receptor is pregnane X receptor (PXR). In one aspect, a PXR receptor is located on an intestinal epithelial cell of the subject. In one aspect, a population of isolated and purified microbes comprises a microbe that modulates a gut-brain axis in the subject. In one aspect, a population of isolated and purified microbes comprises a microbe that modulates neurotransmitter production in the subject. In one aspect, a neurotransmitter is serotonin. In one aspect, a neurotransmitter is dopamine. In one aspect, a neurotransmitter is Gamma-aminobutyric acid (GABA). In one aspect, a population of isolated and purified microbes comprises a microbe that modulates production of a neuroactive metabolite in the subject. In one aspect, a neuroactive metabolite is selected from the group consisting of: branched chain and aromatic amino acids, p cresol, N acetyl putrescine, o cresol, phenol sulfate, kinurate, caproate, histamine, agmatine, or any combination thereof. In one aspect, a population of isolated and purified microbes comprises a microbe that modulates production of an inflammatory agent in the subject. In one aspect, an inflammatory agent is selected from the group consisting of: lipopolysaccharide, IL-1, IL-6, IL-8, TNF-alpha, CRP, or any combination thereof. In one aspect, a population of isolated and purified microbes comprises a microbe that modulates production of a steroid hormone in the subject. In one aspect, a steroid hormone is a corticosteroid. In one aspect, a corticosteroid is a glucocorticoid. In one aspect, a glucocorticoid is corticosterone. In one aspect, a glucocorticoid is cortisol. In one aspect, a population of isolated and purified microbes comprises a microbe that modulates a subject's thyroid homeostasis. In one aspect, a population of isolated and purified microbes comprises a microbe that modulates a subject's hypothalamus-pituitary-adrenal axis (HPA). In one aspect, a disorder is a neurological disorder. In one aspect, a disorder is a behavioral disorder. In one aspect, the neurological disorder is Alzheimer's disease. In one aspect, the disorder is stroke. In one aspect, the disorder is cerebral ischemia. In one aspect, the population of isolated and purified microbes comprises a microbe comprising at least about 85% sequence identity to a rRNA sequence of *Clostridium sporogenes*. In one aspect, a population of isolated and purified microbes comprises a microbe that modulates short-chain fatty acid production in the subject. In one aspect, a short-chain fatty acid is butyrate. In one aspect, a population of isolated and purified microbes comprises a microbe that encodes a polypeptide comprising a sequence that is at least about 85% identical to butyrate kinase. In one aspect, a subject has gut dysbiosis. In one aspect, the population of isolated and purified microbes is synergistic in the composition. In one aspect, the population of isolated and purified microbes comprises a first microbe that produces an intermediate molecule in a butyrate pathway. In one aspect, the population of isolated and purified microbes comprises a second microbe that converts the intermediate molecule to butyrate. In one aspect, the treating results in increased satiety in the subject. In one aspect, the treating results in reduced appetite in the subject. In one aspect, the treating results in improved behavior in the subject. In one aspect, the treating results in reduced body weight of the subject. In one aspect, the treating results in reduced adiposity in the subject. In one aspect, the treating results in improved glucose control in the subject. In one aspect, the treating results in improved insulin sensitivity in the subject. In one aspect, the composition further comprises a pharmaceutically-acceptable carrier. In one aspect, the subject is human. In one aspect, the method further comprises a companion diagnostic. In one aspect, the pharmaceutical composition is formulated as an enteric-coated pill. In one aspect, the pharmaceutical composition is delivered to the subject's ileum and/or colon region. In one aspect, the pharmaceutical composition is administered before food intake. In one aspect, the pharmaceutical composition is formulated for oral delivery. In one aspect, the pharmaceutical composition further comprises a prebiotic. In one aspect, a prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, *psyllium*, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, β-glucan, methylcellulose, and any combination thereof. In one aspect, a prebiotic is an oligosaccharide. In one aspect, a prebiotic is inulin. In one aspect, the pharmaceutical composition is administered after completion of an antibiotic regimen by the subject. In one aspect, the method further comprises determining the sequence of a population of the subject's microbiome by sequencing. In one aspect, treating results in a subject with an altered microbiome. In one aspect, at least one of the microorganisms is a microbe with a rRNA sequence that is at least about 85% identical to the rRNA sequence of a microbe selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas* nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition produces butyrate in the subject. In one aspect, the composition produces propionate in the subject. In one aspect, the composition produces indole 3-propionate in the subject. In one aspect, the indole 3-propionate can be detected in a blood sample of the subject. In one aspect, the composition increases butyrate production by at least about 1%, 5%, 10%, 15%, 30%, 50%, 75%, 80%, 90%, or 100% in the subject. In one aspect, the composition increases butyrate production by at least about 1%, 5%, 10%, 15%, 30%, 50%, 75%, 80%, 90%, or 100% in the subject compared to a control subject that is not treated with the composition. In one aspect, the composition increases indole 3-propionate production by at least about 1%, 5%, 10%, 15%, 30%, 50%, 75%, 80%, 90%, or 100% in the subject. In one aspect, the composition increases indole 3-propionate production by at least about 1%, 5%, 10%, 15%, 30%, 50%, 75%, 80%, 90%, or 100% in the subject compared to a control subject that is not treated with the composition. In one aspect, the pharmaceutical composition is formulated for oral administration. In one aspect, the composition comprises at least 2 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least 3 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof. In one aspect, the composition comprises at least 4 different microbial species selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, *Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof. In one aspect, the composition comprises at least about $10^5$ colony forming units (CFU) of one or more microbes in said population of isolated and purified microbes. In one aspect, the population of isolated and purified microbes comprises a microbe that is an obligate anaerobe. In one aspect, the obligate anaerobe is oxygen stable.

INCORPORATION BY REFERENCE

All publications, patents, and patent applications mentioned in this specification are herein incorporated by reference to the same extent as if each individual publication, patent, or patent application was specifically and individually indicated to be incorporated by reference.

The content of the International Nucleotide Sequence Database Collaboration (DDBJ/EMBL/GENBANK) accession number CP001071.1 for microbial strain *Akkermansia mucimphila,* culture collection ATCC BAA-835, is herein incorporated by reference in its entirety.

The content of DDBJ/EMBL/GENBANK accession number AJ518871.2 for microbial strain *Anaerofustis stercorihominis,* culture collection DSM 17244, is herein incorporated by reference in its entirety.

The content of DDBJ/EMBL/GENBANK accession number DS499744.1 for microbial strain *Anaerostipes caccae,* culture collection DSM 14662, is herein incorporated by reference in its entirety.

The content of DDBJ/EMBL/GENBANK accession number AJ270487.2 for microbial strain *Anaerostipes caccae,* butyrate-producing bacterium L1-92, is herein incorporated by reference in its entirety.

The content of DDBJ/EMBL/GENBANK accession number AY305319.1 for microbial strain *Anaerostipes hadrus,* butyrate-producing bacterium SS2/1, is herein incorporated by reference in its entirety.

The content of DDBJ/EMBL/GENBANK accession number AJ315980.1 for microbial strain *Anaerotruncus colihominis,* culture collection DSM 17241, is herein incorporated by reference in its entirety.

The content of DDBJ/EMBL/GENBANK accession number AP009256.1 for microbial strain, *Bifidobacterium adolescentis,* culture collection ATCC 15703, is herein incorporated by reference in its entirety.

The content of DDBJ/EMBL/GENBANK accession number CP001095.1 for microbial strain *Bifidobacterium longum* subsp. *infantis,* culture collection ATCC 15697, is herein incorporated by reference in its entirety.

The content of DDBJ/EMBL/GenBank accession number U41172.1 for microbial strain *Butyrivibrio fibrisolvens,* culture collection ATCC 19171, is herein incorporated by reference in its entirety.

The content of DDBJ/EMBL/GenBank accession number AJ250365.2 for microbial strain *Butyrivibrio fibrisolvens,* 16.4, is herein incorporated by reference in its entirety.

The content of DDBJ/EMBL/GenBank accession number U41168.1 for microbial strain *Butyrivibrio fibrisolvens,* OB156, is herein incorporated by reference in its entirety.

The content of DDBJ/EMBL/GenBank accession number AY305305.1 for microbial strain Butyrate-producing bacterium, A2-232, is herein incorporated by reference in its entirety.

The content of DDBJ/EMBL/GenBank accession number AY305316.1 for microbial strain Butyrate-producing bacterium, SS3/4, is herein incorporated by reference in its entirety.

The content of DDBJ/EMBL/GENBANK accession number AE001437.1 for microbial strain *Clostridium acetobutylicum,* culture collection ATCC 824, is herein incorporated by reference in its entirety.

The content of DDBJ/EMBL/GENBANK accession number X78070.1 for microbial strain *Clostridium acetobutylicum,* culture collection DSM 792, is herein incorporated by reference in its entirety.

The content of DDBJ/EMBL/GENBANK accession number CP000721.1 for microbial strain *Clostridium beijerinckii,* culture collection NCIMB 8052, is herein incorporated by reference in its entirety.

The content of DDBJ/EMBL/GENBANK accession number X68189.1 for microbial strain *Clostridium sporogenes,* is herein incorporated by reference in its entirety.

The content of DDBJ/EMBL/GENBANK accession number X74770.1 for microbial strain *Clostridium tetani,* is herein incorporated by reference in its entirety.

The content of DDBJ/EMBL/GENBANK accession number AJ270491.2 for microbial strain *Coprococcus,* butyrate-producing bacterium L2-50, is herein incorporated by reference in its entirety.

The content of DDBJ/EMBL/GENBANK accession number EF031543.1 for microbial strain *Coprococcus eutactus,* culture collection ATCC 27759, is herein incorporated by reference in its entirety.

The content of DDBJ/EMBL/GenBank accession number AY305306.1 for microbial strain *Eubacterium cylindroides,* butyrate-producing bacterium T2-87, is herein incorporated by reference in its entirety.

The content of DDBJ/EMBL/GenBank accession number AY305313.1 for microbial strain *Eubacterium cylindroides,* butyrate-producing bacterium SM7/11, is herein incorporated by reference in its entirety.

The content of DDBJ/EMBL/GenBank accession number L34682.2 for microbial strain *Eubacterium dolichum,* culture collection DSM 3991, is herein incorporated by reference in its entirety.

The content of DDBJ/EMBL/GenBank accession number AJ270490.2 for microbial strain *Eubacterium halii*, butyrate-producing bacterium L2-7, is herein incorporated by reference in its entirety.

The content of DDBJ/EMBL/GenBank accession number AY305318.1 for microbial strain *Eubacterium halii*, butyrate-producing bacterium SM6/1, is herein incorporated by reference in its entirety.

The content of DDBJ/EMBL/GenBank accession number L34621.2 for microbial strain *Eubacterium halii*, culture collection ATCC 27751, is herein incorporated by reference in its entirety.

The content of DDBJ/EMBL/GenBank accession number AJ270475.2 for microbial strain *Eubacterium rectale*, A1-86, is herein incorporated by reference in its entirety.

The content of DDBJ/EMBL/GENBANK accession number NC 012781.1 for microbial strain *Eubacterium rectale*, culture collection ATCC 33656, is herein incorporated by reference in its entirety.

The content of DDBJ/EMBL/GenBank accession number L34421.2 for microbial strain *Eubacterium ventriosum*, culture collection ATCC 27560, is herein incorporated by reference in its entirety.

The content of DDBJ/EMBL/GENBANK accession number AY305307.1 for microbial strain *Faecalibacterium prausnitzii*, butyrate producing bacterium M21/2, is herein incorporated by reference in its entirety.

The content of DDBJ/EMBL/GENBANK accession number FP929046.1 for microbial strain *Faecalibacterium prausnitzii* is herein incorporated by reference in its entirety.

The content of DDBJ/EMBL/GENBANK accession number GG697168.2 for microbial strain *Faecalibacterium prausnitzii* is herein incorporated by reference in its entirety.

The content of DDBJ/EMBL/GENBANK accession number CP002158.1 for microbial strain *Fibrobacter succinogenes* subsp. *succinogenes* is herein incorporated by reference in its entirety.

The content of DDBJ/EMBL/GENBANK accession number NZ_AUJN01000001.1 for microbial strain *Clostridium butyricum* is herein incorporated by reference in its entirety.

The content of DDBJ/EMBL/GENBANK accession number NZ_AZUI01000001.1 for microbial strain *Clostridium indolis*, culture collection DSM 755, is herein incorporated by reference in its entirety.

The content of DDBJ/EMBL/GENBANK accession number ACEP01000175.1 for microbial strain *Eubacterium hallii*, culture collection DSM 3353, is herein incorporated by reference in its entirety.

The content of DDBJ/EMBL/GenBank accession number AY305310.1 for microbial strain *Roseburia faecis*, M72/1, is herein incorporated by reference in its entirety.

The content of DDBJ/EMBL/GenBank accession number AJ270482.2 for microbial strain *Roseburia hominis*, type strain A2-183T, is herein incorporated by reference in its entirety.

The content of DDBJ/EMBL/GenBank accession number AJ312385.1 for microbial strain *Roseburia intestinalis*, L1-82, is herein incorporated by reference in its entirety.

The content of DDBJ/EMBL/GenBank accession number AJ270473.3 for microbial strain *Roseburia inulinivorans*, type strain A2-194T, is herein incorporated by reference in its entirety.

The content of DDBJ/EMBL/GENBANK accession number NZ_ACFY01000179.1 for microbial strain *Roseburia inulinivorans*, culture collection DSM 16841, is herein incorporated by reference in its entirety.

The content of DDBJ/EMBL/GENBANK accession number KI912489.1 for microbial strain *Ruminococcus flavefaciens*, culture collection ATCC 19208, is herein incorporated by reference in its entirety.

The content of DDBJ/EMBL/GENBANK accession number AAYG02000043.1 for microbial strain *Ruminococcus gnavus*, culture collection ATCC 29149, is herein incorporated by reference in its entirety.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

FIG. 9A illustrates the level of visceral motor reflex in a treated and control mouse IBS model, while FIG. 9B illustrates the activity of TRPV-1 ion channel response to capsaicin in CGRP-positive sensory neurons from both treated and control mouse systems.

DETAILED DESCRIPTION

Figure 1:
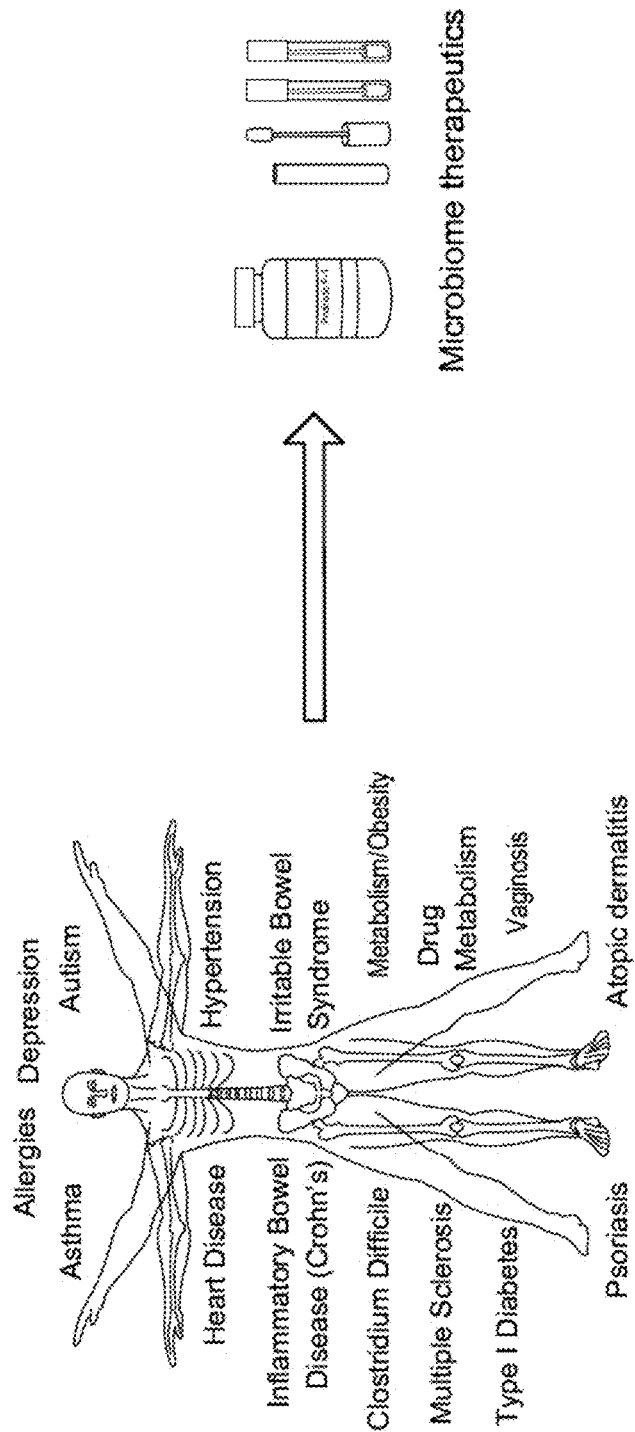
FIG. 1 depicts illustrative microbiome-related health conditions and diseases for which microbiome therapeutics and diagnostics of the disclosure can be used. These health conditions can include: skin health, acne, atopic dermatitis, psoriasis, vaginosis, preterm delivery, allergies, preterm labor, chronic fatigue syndrome, Type 2 diabetes mellitus, depression, autism, asthma, hypertension, irritable bowel syndrome, metabolism, obesity, drug metabolism, Type I diabetes mellitus, multiple sclerosis, *Clostridium difficile*, inflammatory bowel disease, crohn's disease, genitourinary disorders, and heart disease.

As used in the specification and claims, the singular forms "a", "an" and "the" include plural references unless the context clearly dictates otherwise. For example, the term "a sample" includes a plurality of samples, including mixtures thereof.

The terms "microbes" and "microorganisms" are used interchangeably herein and can refer to bacteria, archaea, eukaryotes (e.g. protozoa, fungi, yeast), and viruses, including bacterial viruses (i.e. phage).

The term "microbiome", "microbiota", and "microbial habitat" are used interchangeably herein and can refer to the ecological community of microorganisms that live on or in a subject's body. The microbiome can be comprised of commensal, symbiotic, and/or pathogenic microorganisms. Microbiomes can exist on or in many, if not most parts of the subject. Non-limiting examples of habitats of microbiome can include: body surfaces, body cavities, body fluids, the gut, the colon, skin, skin surfaces, skin pores, vaginal cavity, umbilical regions, conjunctival regions, intestinal regions, the stomach, the nasal cavities and passages, the gastrointestinal tract, the urogenital tracts, saliva, mucus, and feces.

The term "prebiotic" as used herein can be a general term to refer to chemicals and/or ingredients that can affect the growth and/or activity of microorganisms in a host. Prebiotics can allow for specific changes in the composition and/or activity in the microbiome. Prebiotics can confer a health benefit on the host. Prebiotics can be selectively fermented, e.g. in the colon. Non-limiting examples of prebiotics can include: complex carbohydrates, complex sugars, resistant dextrins, resistant starch, amino acids, peptides, nutritional compounds, biotin, polydextrose, oligosaccharides, polysaccharide, fructooligosaccharide (FOS), fructans, soluble fiber, insoluble fiber, fiber, starch, galactooligosaccharides (GOS), inulin, lignin, *psyllium*, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), locust bean gum, P-glucan, and methylcellulose. Prebiotics can be found in foods, for example, acacia gum, guar seeds, brown rice, rice bran, barley hulls, chicory root, Jerusalem artichoke, dandelion greens, garlic, leek, onion, asparagus, wheat bran, oat bran, baked beans, whole wheat flour, and banana. Prebiotics can be found in breast milk. Prebiotics can be administered in any suitable form, for example, capsule and dietary supplement.

The term "probiotic" as used herein can mean one or more microorganisms which, when administered appropriately, can confer a health benefit on the host or subject. Non-limiting examples of probiotics include, for example, *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Lactobacilli, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus,* and *Peptostreptococcus.*

The terms "determining", "measuring", "evaluating", "assessing," "assaying," and "analyzing" can be used interchangeably herein and can refer to any form of measurement, and include determining if an element is present or not (e.g., detection). These terms can include both quantitative and/or qualitative determinations. Assessing may be relative or absolute. These terms can include use of the algorithms and databases described herein. "Detecting the presence of" can include determining the amount of something present, as well as determining whether it is present or absent. The term "genome assembly algorithm" as used herein, refers to any method capable of aligning sequencing reads with each other (de novo) or to a reference (re-sequencing) under conditions that a complete sequence of the genome may be determined.

The term "genome" as used herein, can refer to the entirety of an organism's hereditary information that is encoded in its primary DNA sequence. The genome includes both the genes and the non-coding sequences. For example, the genome may represent a microbial genome. The genetic content of the microbiome can comprise: genomic DNA, RNA, and ribosomal RNA, the epigenome, plasmids, and all other types of genetic information found in the microbes that comprise the microbiome.

"Nucleic acid sequence" and "nucleotide sequence" as used herein refer to an oligonucleotide or polynucleotide, and fragments or portions thereof, and to DNA or RNA of genomic or synthetic origin which may be single- or double-stranded, and represent the sense or antisense strand. The nucleic acid sequence can be made up of adenine, guanine, cytosine, thymine, and uracil (A, T, C, G, and U) as well as modified versions (e.g. N6-methyladenosine, 5-methylcytosine, etc.).

The terms "homology" and "homologous" as used herein in reference to nucleotide sequences refer to a degree of complementarity with other nucleotide sequences. There may be partial homology or complete homology (i.e., identity). A nucleotide sequence which is partially complementary, i.e., "substantially homologous," to a nucleic acid sequence is one that at least partially inhibits a completely complementary sequence from hybridizing to a target nucleic acid sequence.

The term "sequencing" as used herein refers to sequencing methods for determining the order of the nucleotide bases—A, T, C, G, and U—in a nucleic acid molecule (e.g., a DNA or RNA nucleic acid molecule.

The term "biochip" or "array" can refer to a solid substrate having a generally planar surface to which an adsorbent is attached. A surface of the biochip can comprise a plurality of addressable locations, each of which location may have the adsorbent bound there. Biochips can be adapted to engage a probe interface, and therefore, function as probes. Protein biochips are adapted for the capture of polypeptides and can be comprise surfaces having chromatographic or biospecific adsorbents attached thereto at addressable locations. Microarray chips are generally used for DNA and RNA gene expression detection.

The term "barcode" as used herein, refers to any unique, non-naturally occurring, nucleic acid sequence that may be used to identify the originating genome of a nucleic acid fragment.

The terms "subject," "individual," "host," and "patient" can be used interchangeably herein and refer to any animal subject, including: humans, laboratory animals, livestock, and household pets. The subject can host a variety of microorganisms. The subject can have different microbiomes in various habitats on and in their body. The subject may be diagnosed or suspected of being at high risk for a disease. The subject may have a microbiome state that is contributing to a disease (i.e. dysbiosis). In some cases, the subject is not necessarily diagnosed or suspected of being at high risk for the disease. In some instances a subject may be suffering from an infection or at risk of developing or transmitting to others an infection.

The terms "treatment" or "treating" are used interchangeably herein. These terms can refer to an approach for obtaining beneficial or desired results including but not limited to a therapeutic benefit and/or a prophylactic benefit. A therapeutic benefit can mean eradication or amelioration of the underlying disorder being treated. Also, a therapeutic benefit can be achieved with the eradication or amelioration of one or more of the physiological symptoms associated with the underlying disorder such that an improvement is observed in the subject, notwithstanding that the subject may still be afflicted with the underlying disorder. A prophylactic effect includes delaying, preventing, or eliminating the appearance of a disease or condition, delaying or eliminating the onset of symptoms of a disease or condition, slowing, halting, or reversing the progression of a disease or condition, or any combination thereof. For prophylactic benefit, a subject at risk of developing a particular disease, or to a subject reporting one or more of the physiological symptoms of a disease may undergo treatment, even though a diagnosis of this disease may not have been made.

The terms "16S", "16S ribosomal subunit", and "16S ribosomal RNA (rRNA)" can be used interchangeably herein and can refer to a component of a small subunit (e.g., 30S) of a prokaryotic (e.g., bacteria, archaea) ribosome. The 16S rRNA is highly conserved evolutionarily among species of microorganisms. Consequently, sequencing of the 16S ribosomal subunit can be used to identify and/or compare microorganisms present in a sample (e.g., a microbiome).

The terms "23S", "23S ribosomal subunit", and "23S ribosomal RNA (rRNA)" can be used interchangeably herein and can refer to a component of a large subunit (e.g., 50S) of a prokaryotic (e.g., bacteria, archaea) ribosome. Sequencing of the 23S ribosomal subunit can be used to identify and/or compare microorganisms present in a sample (e.g., a microbiome).

The term "spore" can refer to a viable cell produced by a microorganism to resist unfavorable conditions such as high temperatures, humidity, and chemical agents. A spore can have thick walls that allow the microorganism to survive harsh conditions for extended periods of time. Under suitable environmental conditions, a spore can germinate to produce a living form of the microorganism that is capable of reproduction and all of the physiological activities of the microorganism. A composition of the disclosure can comprise a spore of a microbe. A composition of the disclosure can comprise a microbe capable of forming a spore.

Gut-brain axis can refer to a biochemical communication between the gastrointestinal tract and the central nervous system. The gut-brain axis can include the central nervous system, neuroendocrine and neuroimmune systems including the hypothalamic-pituitary-adrenal axis (HPA axis), sympathetic and parasympathetic arms of the autonomic nervous system including the enteric nervous system and the vagus nerve, and the gut microbiota. The gut-brain axis can be important for maintaining homeostasis. Compositions and methods of the disclosure can modulate a subject's gut-brain axis, for example, see FIG. 8.

Enteric nervous system can be a division of the nervous system. An enteric nervous system can include a system of neurons that can govern the function of the gastrointestinal system. The enteric nervous system can operate autonomously. It can communicate with the central nervous system (CNS) through, for example, the parasympathetic (e.g., via the vagus nerve) and sympathetic (e.g., via the prevertebral ganglia) nervous systems.

In some embodiments, the disclosure provides methods and compositions to treat a microbiome-associated disorder. In some embodiments, the disclosure provides methods and compositions to treat gut dysbiosis. In some embodiments, the disclosure provides methods and compositions to treat comorbidities associated with gut dysbiosis. In some embodiments, the disclosure provides therapeutic compositions (e.g., prebiotic and probiotics), companion diagnostics, and statistical methods for treating or reducing, for example, neurological conditions (e.g., food addiction) and metabolic conditions (e.g., metabolic syndrome).

Figure 8:
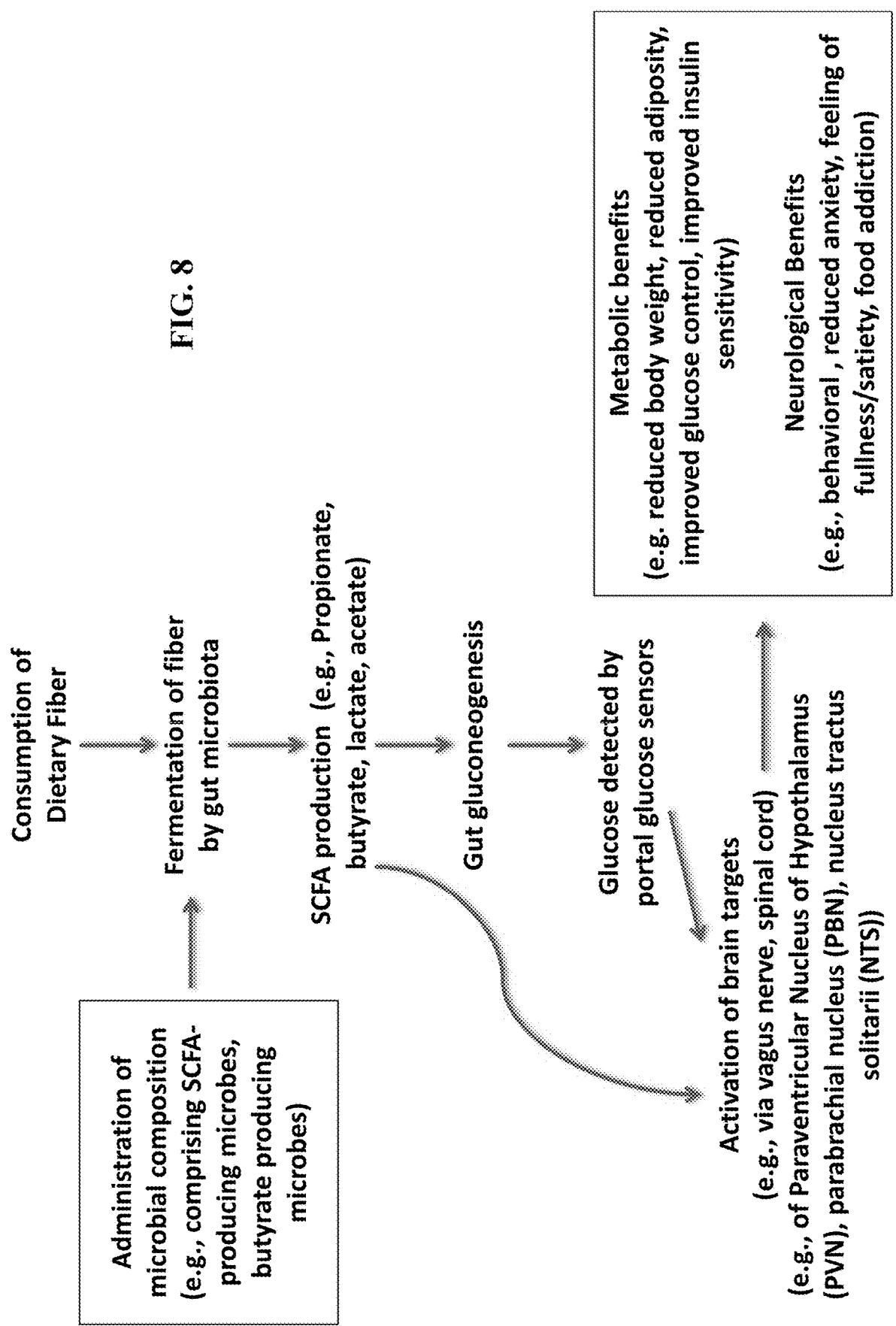
FIG. 8 illustrates role of gut microbiome and short-chain fatty acids (SCFAs) on gut-brain axis. Compositions of the disclosure (e.g., short-chain fatty acid producing such as butyrate-producing and/or propionate producing formulations) can modulate the gut-brain axis, which can lead to metabolic and neurological benefits.

In some embodiments, the disclosure provides methods and compositions to treat a disorder in a subject associated with and/or caused by altered (e.g, reduced) production of a short-chain fatty acid (e.g., butyrate). A composition of the disclosure can comprise one or more SCFA-producing (e.g., butyrate-producing) microbes. A composition of the disclosure can modulate a nervous system of the subject. The nervous system can be an enteric nervous system of the subject. The nervous system can be a central nervous system of the subject. A composition of the disclosure can modulate a gut-brain axis of the subject. As shown in FIG. 8, a composition of the disclosure can activate one or more brain targets in a subject, for example, Paraventricular Nucleus of Hypothalamus (PVN), parabrachial nucleus (PBN), and nucleus tractus solitarii (NTS). The brain targets can be activated by signal transmission from the gut, via, for example, vagus nerve and spinal cord.

Altered SCFA (e.g., butyrate) production can be caused by, for example, an alteration of a microbiome of the subject such as a reduced SCFA-producing microbial population in the gut, altered butyrate production pathway, and/or alteration of a substrate, cofactor, or prebiotic needed for SCFA production.

Compositions comprising microbes can confer a variety of beneficial effects on a subject. Examples of these beneficial effects can include immunomodulatory features, regulation of cell proliferation, the ability to promote normal physiologic development of the mucosal epithelium, and enhancement of human nutrition. Microbial-based compositions can be administered as a therapeutic to a subject suffering from a microbiome-related health condition or disorder.

The disclosure provides methods and compositions to modulate and/or restore (e.g., to a healthy state or to treat a health condition) one or more microbiomes of a subject. In some embodiments, the disclosure provides methods and compositions to modulate and/or restore the gut microbiome of a subject.

In some embodiments, the disclosure provides a diagnostic test to predict the likelihood or determine the status of a disorder in a subject. The diagnostic test can use personal characteristics, for example, age, weight, gender, medical history, risk factors, family history, or a combination thereof. The diagnostic assay can further use environmental factors such as geographic location, type of work, and use of hygiene products. The diagnostic test can be performed before and/or after treatment with methods and compositions of the disclosure.

Figure 14:
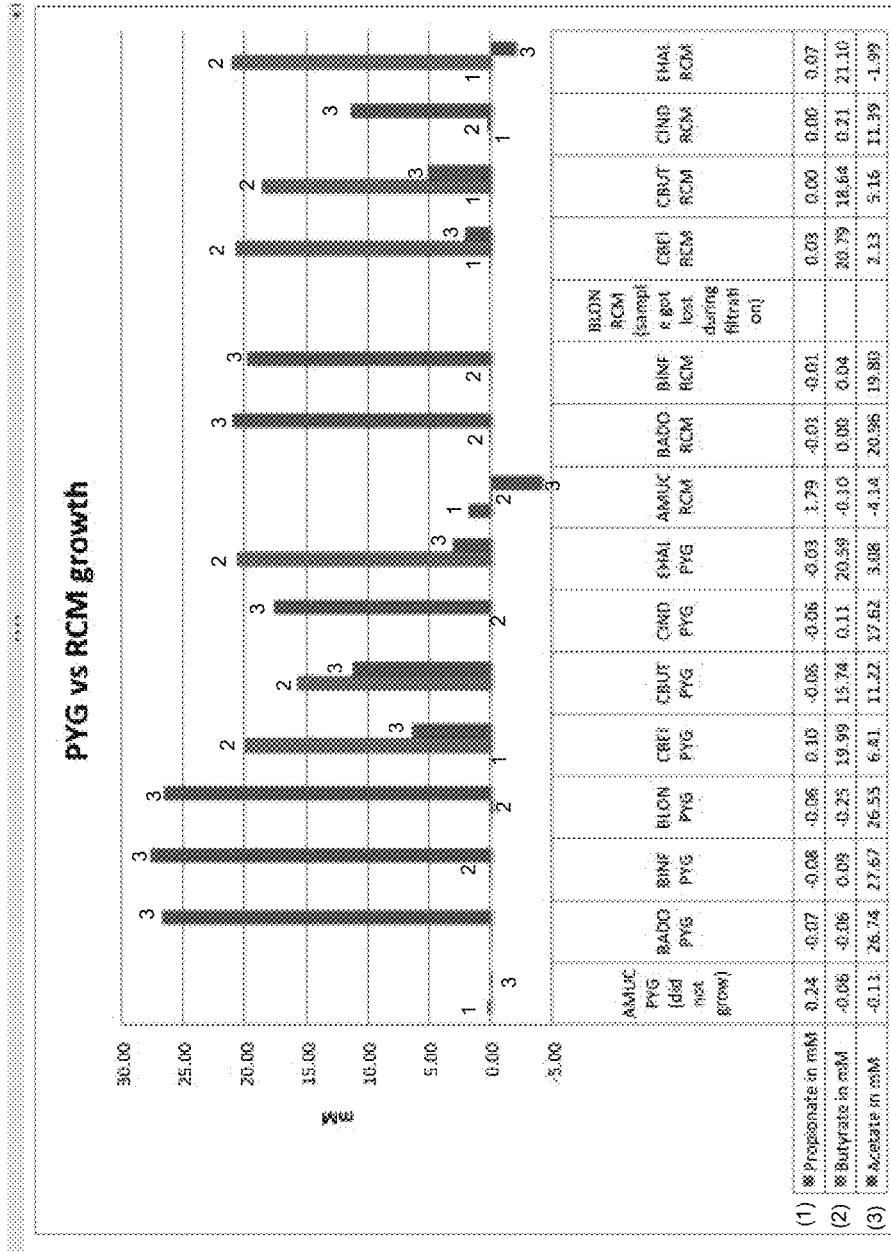
FIG. 14 illustrates in vitro short chain fatty acid production by strains grown in different media.
Figure 15:
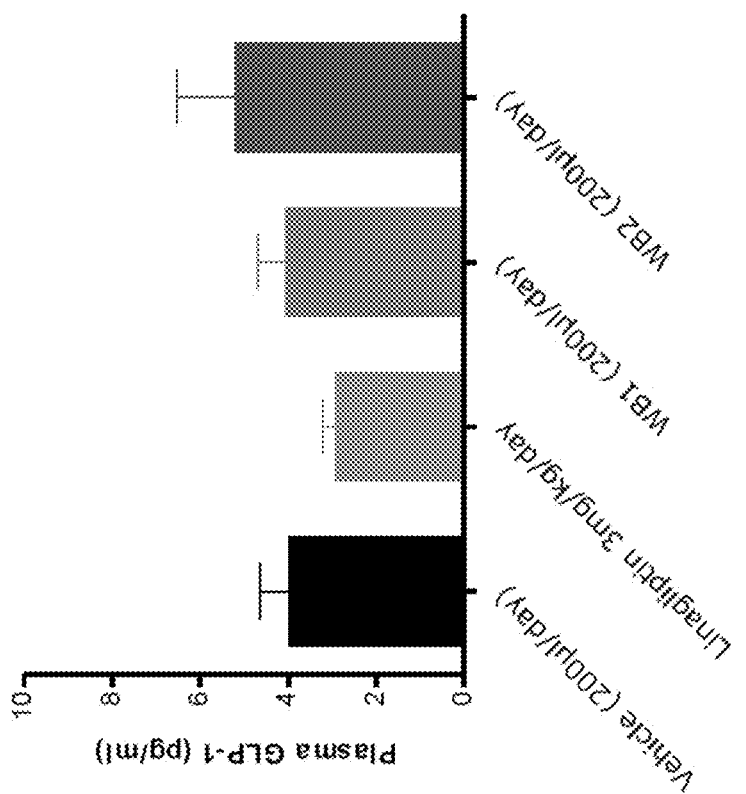
FIG. 15 illustrates GLP-1 production in a diet induced obese mouse model following administration of compositions described herein.

A composition of the disclosure can modulate SCFA production in a subject. A composition of the disclosure can increase SCFA production in a subject. A composition of the disclosure can decrease SCFA production in a subject. A composition of the disclosure can increase production of one SCFA and decrease production of a second SCFA. FIG. 14 illustrates in vitro SCFA production by strains described herein, when grown in different media (Peptone Yeast Glucose media (PYG) vs. Reinforced Clostridial media (RCM)).

SCFAs can be a subgroup of fatty acids with 6 or less carbons in their aliphatic tails. Non-limiting examples of SCFAs include acetate, propionate, isobutyrate, isovaleric acid, 3-methylbutanoic acid, valeric acid, pentanoic acid, delphinic acid, isopentanoic acid, and butyrate. In some embodiments, a SCFA is butyrate. In some embodiments, a SCFA is propionate.

SCFAs such as butyrate can play a central role in modulating various body functions. Alteration of a SCFA-producing microbiome in a subject can be associated with a disorder. For example, butyrate can protect the brain and enhance plasticity in neurological diseases. Butyrate can function as an anti-inflammatory factor. Butyrate can affect gut permeability. Low levels of butyrate producing microbes (e.g. *Clostridium* clusters XIVa and IV) and/or reduced lactate producing bacteria (e.g. *Bifidobacterium adolescentis*) can be correlated with, for example, gut dysbiosis, skin disorders, metabolic disorders, and behavioral/neurological disorders. Subsets of a formulation that comprise at least one primary fermenter and at least one secondary fermenter can be used for the treatment and/or mitigate progression of a disorder or condition.

A SCFA (e.g., butyrate) can be involved in immune system regulation. For example, a SCFA (e.g., butyrate) can activate receptors such as free fatty acid receptors (e.g., FFA-1, FFA-3), which in turn can activate leukocyte production and result in immune system activation.

A SCFA (e.g., butyrate) can promote satiety (e.g., feeling of fullness). A SCFA (e.g., butyrate) can reduce dietary intake. Activation of free fatty acid receptors by butyrate can lead to leptin production. Regulation of leptin can help with satiety and/or reduce dietary intake.

A SCFA (e.g., butyrate) can be used to reduce, prevent, and/or treat inflammation. For example, butyrate can inhibit NF-kappa B pathway, which can help reduce inflammation.

A SCFA (e.g., butyrate) can regulate gut permeability. For example, butyrate can inhibit ion (e.g., chlorine ion) transport in the colon. A SCFA (e.g., butyrate) can improve ion retention. A SCFA (e.g., butyrate) can improve resilience of the gut to pathogenic bacteria and their toxins.

A SCFA (e.g., butyrate) can be associated with cancer treatment and/or prevention. For example, butyrate can inhibit histone deacetylases (HDAC). Inhibition of HDAC can lead to P21 accumulation, which in turn can lead to G1 cell cycle arrest.

A SCFA (e.g., butyrate) can be absorbed by intestinal cells. In the colon, dietary fiber can be processed by butyrate-producing microorganisms to produce butyrate (i.e. butanoate). In turn, butyrate can initiate G-protein coupled receptor (GPCR) signaling, leading to, for example, glucagon-like peptide-1 (GLP-1) secretion. GLP-1 can result in, for example, increased insulin sensitivity. FIG. 14, for example, indicates an increased GLP-1 production in a mouse model employing diet induced obese mice using an administered composition including a consortia of microbial strains as described herein, and a prebiotic fiber source.

In some embodiments, the composition comprises a microbe with a butyrate kinase (e.g., EC 2.7.2.7; MetaCyc Reaction ID R11-RXN). Butyrate kinase is an enzyme belonging to a family of transferases, for example those transferring phosphorus-containing groups (e.g., phosphotransferases) with a carboxy group as acceptor. The systematic name of this enzyme class can be ATP:butanoate 1-phosphotransferase. Butyrate kinase can participate in butyrate metabolism. Butyrate kinase can catalyze the following reaction:

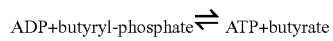

In some embodiments, the composition comprises a microbe with a Butyrate-Coenzyme A. Butyrate-Coenzyme A, also butyryl-coenzyme A, can be a coenzyme A-activated form of butyric acid. It can be acted upon by butyryl-CoA dehydrogenase and can be an intermediary compound in acetone-butanol-ethanol fermentation. Butyrate-Coenzyme A can be involved in butyrate metabolism.

In some embodiments, the composition comprises a microbe with a Butyrate-Coenzyme A transferase. Butyrate-Coenzyme A transferase, also known as butyrate-acetoacetate CoA-transferase, can belong to a family of transferases, for example, the CoA-transferases. The systematic name of this enzyme class can be butanoyl-CoA:acetoacetate CoA-transferase. Other names in common use can include butyryl coenzyme A-acetoacetate coenzyme A-transferase (e.g., EC 2.8.3.9; MetaCyc Reaction ID 2.8.3.9-RXN), and butyryl-CoA-acetoacetate CoA-transferase. Butyrate-Coenzyme A transferase can catalyze the following chemical reaction:

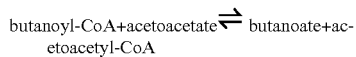

butanoyl-CoA+acetoacetate ⇌ butanoate+acetoacetyl-CoA

In some embodiments, the composition can comprise a microbe with an acetate Coenzyme A transferase (e.g., EC 2.8.3.1/2.8.3.8; MetaCyc Reaction ID BUTYRATE-KINASE-RXN).

In some embodiments, the composition comprises a microbe with a Butyryl-Coenzyme A dehydrogenase. Butyryl-CoA dehydrogenase can belong to the family of oxidoreductases, for example, those acting on the CH—CH group of donor with other acceptors. The systematic name of this enzyme class can be butanoyl-CoA:acceptor 2,3-oxidoreductase. Other names in common use can include butyryl dehydrogenase, unsaturated acyl-CoA reductase, ethylene reductase, enoyl-coenzyme A reductase, unsaturated acyl coenzyme A reductase, butyryl coenzyme A dehydrogenase, short-chain acyl CoA dehydrogenase, short-chain acyl-coenzyme A dehydrogenase, 3-hydroxyacyl CoA reductase, and butanoyl-CoA:(acceptor) 2,3-oxidoreductase. Non-limiting examples of metabolic pathways that butyryl-CoA dehydrogenase can participate in include: fatty acid metabolism; valine, leucine and isoleucine degradation; and butanoate metabolism. Butyryl-CoA dehydrogenase can employ one cofactor, FAD. Butyryl-CoA dehydrogenase can catalyze the following reaction:

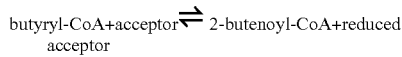

butyryl-CoA+acceptor ⇌ 2-butenoyl-CoA+reduced acceptor

In some embodiments, the composition comprises a microbe with a beta-hydroxybutyryl-CoA dehydrogenase. Beta-hydroxybutyryl-CoA dehydrogenase or 3-hydroxybutyryl-CoA dehydrogenase can belong to a family of oxidoreductases, for example, those acting on the CH—OH group of donor with NAD+ or NADP+ as acceptor. The systematic name of the enzyme class can be (S)-3-hydroxybutanoyl-CoA:NADP+ oxidoreductase. Other names in common use can include beta-hydroxybutyryl coenzyme A dehydrogenase, L(+)-3-hydroxybutyryl-CoA dehydrogenase, BHBD, dehydrogenase, L-3-hydroxybutyryl coenzyme A (nicotinamide adenine, dinucleotide phosphate), L-(+)-3-hydroxybutyryl-CoA dehydrogenase, and 3-hydroxybutyryl-CoA dehydrogenase. Beta-hydroxybutyryl-CoA dehydrogenase enzyme can participate in benzoate degradation via co-ligation. Beta-hydroxybutyryl-CoA dehydrogenase enzyme can participate in butanoate metabolism. Beta-hydroxybutyryl-CoA dehydrogenase can catalyze the following reaction:

(S)-3-hydroxybutanoyl-CoA+NADP ⇌ 3-acetoacetyl-CoA+NADPH+H⁺

In some embodiments, the composition comprises a microbe with a crotonase. Crotonase can comprise enzymes with, for example, dehalogenase, hydratase, isomerase activities. Crotonase can be implicated in carbon-carbon bond formation, cleavage, and hydrolysis of thioesters. Enzymes in the crotonase superfamily can include, for example, enoyl-CoA hydratase which can catalyse the hydration of 2-trans-enoyl-CoA into 3-hydroxyacyl-CoA; 3-2trans-enoyl-CoA isomerase or dodecenoyl-CoA isomerise (e.g., EC 5.3.3.8), which can shift the 3-double bond of the intermediates of unsaturated fatty acid oxidation to the 2-trans position; 3-hydroxybutyryl-CoA dehydratase (e.g., crotonase; EC 4.2.1.55), which can be involved in the butyrate/butanol-producing pathway; 4-Chlorobenzoyl-CoA dehalogenase (e.g., EC 3.8.1.6) which can catalyze the conversion of 4-chlorobenzoate-CoA to 4-hydroxybenzoate-CoA; dienoyl-CoA isomerase, which can catalyze the isomerisation of 3-trans,5-cis-dienoyl-CoA to 2-trans,4-trans-dienoyl-CoA; naphthoate synthase (e.g., MenB, or DHNA synthetase; EC 4.1.3.36), which can be involved in the biosynthesis of menaquinone (e.g., vitamin K2); carnitine racemase (e.g., gene caiD), which can catalyze the reversible conversion of crotonobetaine to L-carnitine in *Escherichia coli*; Methylmalonyl CoA decarboxylase (e.g., MMCD; EC 4.1.1.41); carboxymethylproline synthase (e.g., CarB), which can be involved in carbapenem biosynthesis; 6-oxo camphor hydrolase, which can catalyze the desymmetrization of bicyclic beta-diketones to optically active keto acids; the alpha subunit of fatty acid oxidation complex, a multi-enzyme complex that can catalyze the last three reactions in the fatty acid beta-oxidation cycle; and AUH protein, which can be a bifunctional RNA-binding homologue of enoyl-CoA hydratase.

In some embodiments, the composition comprises a microbe with a thiolase. Thiolases, also known as acetyl-coenzyme A acetyltransferases (ACAT), can convert two units of acetyl-CoA to acetoacetyl CoA, for example, in the mevalonate pathway. Thiolases can include, for example, degradative thiolases (e.g., EC 2.3.1.16) and biosynthetic thiolases (e.g., EC 2.3.1.9). 3-ketoacyl-CoA thiolase, also called thiolase I, can be involved in degradative pathways such as fatty acid beta-oxidation. Acetoacetyl-CoA thiolase, also called thiolase II, can be specific for the thiolysis of acetoacetyl-CoA and can be involved in biosynthetic pathways such as poly beta-hydroxybutyric acid synthesis or steroid biogenesis. A thiolase can catalyze the following reaction:

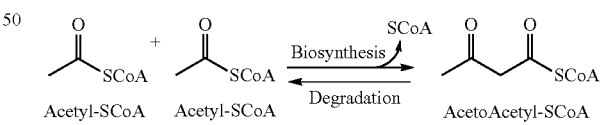

Acetyl-SCoA   Acetyl-SCoA         AcetoAcetyl-SCoA

Figure 13:
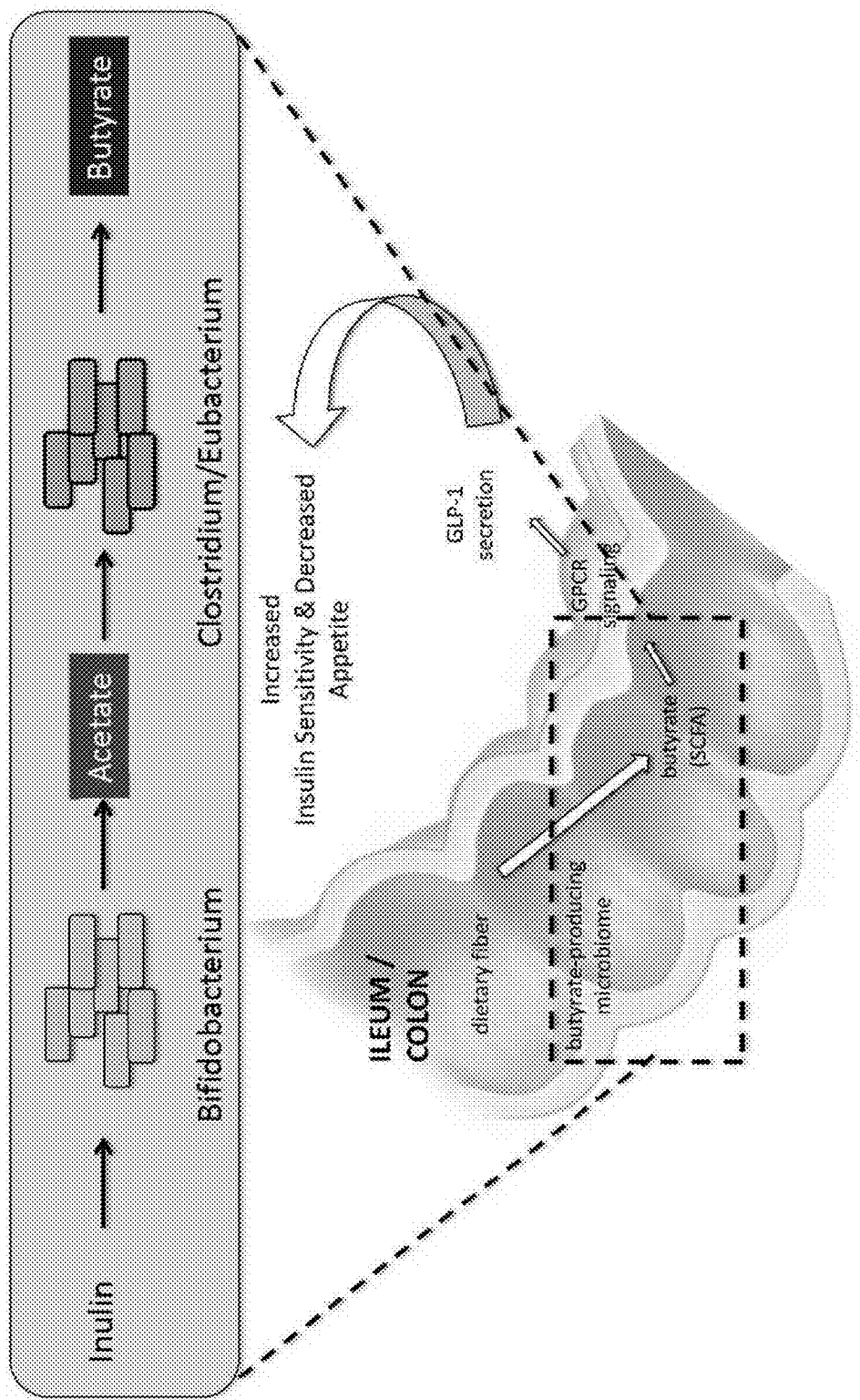
FIG. 13 depicts an illustrative microbiome mediated pathway involving SCFA production in a subject. A formulation comprising, for example, a prebiotic (e.g. inulin), a primary fermenter (e.g. a *Bifidobacterium*), and a secondary fermenter (e.g. *Clostridium* and/or *Eubacterium*) can be used for short-chain fatty acid (e.g., butyrate) production.

Production of butyrate can involve two major phases or microbes, for example, a primary fermenter microbe and a secondary fermenter microbe (see FIG. 13). The primary fermenter can produce intermediate molecules (e.g. lactate, acetate) when given an energy source (e.g. fiber). The secondary fermenter can convert the intermediate molecules produced by the primary fermenter into butyrate. Non-limiting examples of primary fermenter include *Akkermansia muciniphila*, *Bifidobacterium adolescentis*, *Bifidobacterium infantis* and *Bifidobacterium longum*. Non-limiting examples of secondary fermenter include *Clostridium beijerinckii*, *Clostridium butyricum*, *Clostridium indolis*,

*Eubacterium hallii*, and *Faecalibacterium prausnitzii*. A combination of primary and secondary fermenters can be used to produce butyrate in a subject. Subsets of a formulation that comprises at least one primary fermenter and at least one secondary fermenter can be used for the treatment and/or mitigate progression of a health condition. The formulation can additionally comprise a prebiotic.

In some embodiments, a therapeutic composition can comprise at least one primary fermenter and at least one secondary fermenter. In some embodiments, a therapeutic composition comprises at least one primary fermenter, at least one secondary fermenter, and at least one prebiotic. In one non-limiting example, a therapeutic composition can comprise *Bifidobacterium adolescentis, Clostridium indolis*, and inulin. In another non-limiting example, a therapeutic composition can comprise *Bifidobacterium longum, Faecalibacterium prausnitzii*, and starch. In another non-limiting example, a therapeutic composition can comprise *Bifidobacterium infantis, Clostridium beijerinckii, Clostridium butyricum*, and inulin. In another non-limiting example, a therapeutic composition can comprise *Bifidobacterium infantis, Clostridium beijerinckii, Clostridium butyricum, Akkermansia muciniphila*, and inulin. In another non-limiting example, a therapeutic composition can comprise *Bifidobacterium infantis, Clostridium beijerinckii, Clostridium butyricum, Akkermansia mucimphila, Eubacterium hallii*, and inulin.

Alterations in the relative abundance of SCFAs relative to each other can lead to a disorder. For example, altered fiber to acetate production pathway or acetate to butyrate production pathway can lead to metabolic disorders such as bloating.

*Akkermansia muciniphila* can be a gram negative, strict anaerobe that can play a role in mucin degradation. *Akkermansia mucimphila* can be associated with increased levels of endocannabinoids that control inflammation, the gut barrier, and gut peptide secretion. *Akkermansia mucimphila* can serve as a primary fermenter.

*Bifidobacterium adolescentis* can be a gram-positive anaerobe, which can be found in healthy human gut from infancy. *Bifidobacterium adolescentis* can synthesize B vitamins. *Bifidobacterium adolescentis* can serve as a primary fermenter.

*Bifidobacterium infantis* can be a gram-positive, catalase negative, micro-aerotolerant anaerobe. *Bifidobacterium infantis* can serve as a primary fermenter.

*Bifidobacterium longum* can be a gram-positive, catalase negative, micro-aerotolerant anaerobe. *Bifidobacterium longum* can serve as a primary fermenter.

*Clostridium beijerinckii* can be a gram-positive, strict anaerobe that belongs to Clostridial cluster I. *Clostridium beijerinckii* can serve as a secondary fermenter.

*Clostridium butyricum* can be a gram-positive, strict anaerobe that can serve as a secondary fermenter.

*Clostridium indolis* can be a gram-positive, strict anaerobe that belongs to Clostridial cluster XIVA. *Clostridium indolis* can serve as a secondary fermenter.

*Eubacterium hallii* can be a gram-positive, anaerobe that belongs to Arrangement A Clostridial cluster XIVA. *Eubacterium hallii* can serve as a secondary fermenter.

*Faecalibacterium prausnitzii* can be a gram-positive, anaerobe belonging to Clostridial cluster IV. *Faecalibacterium prausnitzii* can be one of the most common gut bacteria and the largest butyrate producer. *Faecalibacterium prausnitzii* can serve as a secondary fermenter.

*Clostridium sporogenes* can produce indole 3-propionate (or 3-indolepropionic acid). *C. sporogenes* can use tryptophan to synthesize 3-indolepropionic acid (IPA). *C. sporogenes* can produce stoichiometrically-significant amounts of indole 3-propionate in vivo, which can be measured in blood plasma. Indole can be produced from tryptophan by a microbe that expresses tryptophanase. *Clostridium sporogenes* can metabolize indole into IPA. IPA can function as an antioxidant and scavenge hydroxyl radicals. IPA can bind to pregnane X receptors (PXR) in intestinal cells, which can help mucosal homeostasis and barrier function. IPA can be absorbed from the *intestine* and be distributed to the brain. IPA can confer a neuroprotective effect against cerebral ischemia and Alzheimer's disease. IPA can, for example, regulate activation of glial cells and astrocytes, regulate levels of 4-hydroxy-2-nonenal (e.g., inhibit), reduce DNA damage, inhibit beta-amyloid fibril formation, regulate mucosal homeostasis, inhibit TNFalpha activity, increase junction protein coding mRNAs.

Non-limiting examples of genes and/or proteins involved in the generation of butyrate include: butyryl-CoA dehydrogenase, beta-hydroxybutyryl-CoA dehydrogenase or 3-hydroxybutyryl-CoA dehydrogenase, crotonase, electron transfer protein a, electron transfer protein b, and thiolase. In some embodiments, the composition comprises a microbe with a gene or protein involved in SCFA (e.g., butyrate) production.

Methods for Determining a Microbial Habitat

The present disclosure provides methods and compositions comprising microbial populations for the treatment of microbiome-related health conditions and/or disorders in a subject. Methods of the disclosure can include collection, stabilization and extraction of microbes for microbiome analysis. Methods of the disclosure can include determining the microbiome profile of any suitable microbial habitat of the subject. The composition of the microbial habitat can be used to diagnose a health condition of a subject, for example, to determine likelihood of a disorder and/or treatment course of the disorder.

An exemplary method of the disclosure can comprise at least one of the following steps: obtaining a sample from a subject, measuring a panel of microbes in the sample, comparing the panel of microbes in the sample with microbes found in a healthy sample, determining status of a disease upon the measuring, generating a report that provides information of disease status upon the results of the determining, and administering microbial-based compositions of the disclosure to the subject for treating a disorder such as a microbiome-based disorder, or the presence or absence of a microbe.

Methods for profiling a microbiome are discussed in U.S. patent application Ser. No. 14/437,133, which is incorporated herein by reference in its entirety for all purposes.

Detection methods, for example, long read sequencing, can be used to profile a microbiome and/or identify microbiome biomarkers.

Microbiomes from, for example, body cavities, body fluids, gut, colon, vaginal cavity, umbilical regions, conjunctival regions, intestinal regions, the stomach, the nasal cavities and passages, the gastrointestinal tract, the urogenital tracts, saliva, mucus, and feces, can be analyzed and compared with that of healthy subjects. An increased and/or decreased diversity of gut microbiome can be associated with a disorder. Subjects with a disorder can have a lower prevalence of butyrate-producing bacteria, for example, *C. eutactus*.

In some embodiments, methods of the disclosure can be used to determine microbial habitat of the gut or gastrointestinal tract of a subject. The gut comprises a complex microbiome including multiple species of microbes that can contribute to vitamin production and absorption, metabolism of proteins and bile acids, fermentation of dietary carbohydrates, and prevention of pathogen overgrowth. The composition of microbes within the gut can be linked to functional metabolic pathways in a subject. Non-limiting examples of metabolic pathways linked to gut microbiota include, energy balance regulation, secretion of leptin, lipid synthesis, hepatic insulin sensitivity, modulation of intestinal environment, and appetite signaling. Modification (e.g., dysbiosis) of the gut microbiome can increase the risk for health conditions such as diabetes, mental disorders, ulcerative colitis, colorectal cancer, autoimmune disorders, obesity, diabetes, and inflammatory bowel disease.

In some embodiments, methods of the disclosure are used to analyze microbial habitat of the gut.

In some embodiments, detection methods (e.g. sequencing) can be used to identify microbiome biomarkers associated with a disorder.

In some embodiments, detection methods of the disclosure (e.g., sequencing) can be used to analyze changes in microbiome composition over time, for example, during antibiotic treatment, microbiome therapies, and various diets. The microbiome can be significantly altered upon exposure to antibiotics and diets that deplete the native microbial population. Methods of the disclosure can be used to generate profiles of the subject before and after administration of a therapeutic to characterize differences in the microbiota.

In some embodiments, methods to visualize the microbiome based on sequencing signatures are provided. In some embodiments, methods are provided to visualize the microbiome over time based on sequencing information.

Methods of the disclosure can be used to detect, characterize and quantify microbial habitat of a subject. The microbial habit can be used to define the diversity and abundance of microbes in order to evaluate clinical significance and causal framework for a disorder. Microbiome profiles can be compared to determine microbes that can be used as biomarkers for predicting and/or treating a health condition.

A biological sample can be collected from a subject to determine the microbiome profile of the subject. The biological sample can be any sample type from any microbial habitat on the body of a subject. Non-limiting examples of microbial habitats include skin habitat, umbilical habitat, vaginal habitat, amniotic fluid habitat, conjunctival habitat, intestinal habitat, stomach habitat, gut habitat, oral habitat, nasal habitat, gastrointestinal tract habitat, respiratory habitat, and urogenital tract habitat.

Depending on the application, the selection of a biological sample can be tailored to the specific application. The biological sample can be for example, whole blood, serum, plasma, mucosa, saliva, cheek swab, urine, stool, cells, tissue, bodily fluid, lymph fluid, CNS fluid, and lesion exudates. A combination of biological samples can be used with the methods of the disclosure.

Sample preparation can comprise any one of the following steps or a combination of steps. A sterile swab is first dipped into a tube containing sterile phosphate buffered saline (PBS) to wet. The swab is swiped across the area of interest multiple times (e.g., 10-20 times) with enough vigor that the tissue is slightly pink/red colored afterwards. The swab is gently dipped into a buffer (e.g., a lysis buffer) in a sterile tube. The swab is left in the tube for shipping to a laboratory to be further analyzed as provided herein. The samples obtained can be shipped overnight at room temperature. Shipping microbial cells in buffers can introduce detection bias in the samples. Some microbes can continue propagating on the nutrients that come along with sample collection. Some microbes can undergo apoptosis in the absence of a specific environment. As a result, microbial samples shipped in this fashion can have an initial profiling/population bias associated with cellular integrity.

Methods can be used to enrich intact cells by first centrifuging the collected sample. The resulting pellet, formed from the intact cells within the sample, can then be used as a precursor for all of the downstream steps. In some embodiments, the methods of the disclosure further comprise a purification step to concentrate any DNA present in the supernatant (e.g. from already lysed cells). This DNA can be combined with DNA extracted from the standard pellet preparation. The combined DNA can form a more complete precursor to the downstream steps.

Cell lysis and/or extraction of nucleic acids from the cells can be performed by any suitable methods including physical methods, chemical methods, or a combination of both. Nucleic acids can be isolated from a biological sample using shearing methods, which preserve the integrity and continuity of genomic DNA.

A nucleic acid sample used with the present disclosure can include all types of DNA and/or RNA. The length of nucleic acids can be about 100, 200, 300, 400, 500, 600, 700, 800, 900, 1000, 2000, 3000, 4000, 5000, 6000, 7000, 8000, 9000, 10,000, 20,000, 30,000, 40,000, 50,000, 60,000, 70,000, 80,000, 90,000, 100,000, 200,000, 300,000, 400,000, 500,000, 600,000, 700,000, 800,000, 900,000, 1,000,000, 2,000,000, 3,000,000, 4,000,000, 5,000,000, 6,000,000, 7,000,000, 8,000,000, 9,000,000, or 10,000,000, nucleotides or base pairs in length.

An amplicon approach can be used to prepare DNA for microbiome profiling. This approach can comprise a number of steps, for example, PCR, sample quantification (e.g. Qubit, nanodrop, bioanalyzer, etc.), Blue Pippin size selection, 0.5× Ampure purification, sample quantification, DNA end repair, 0.5× Ampure purification, blunt end adaptor ligation, exo-nuclease treatment, two 0.5× Ampure purifications, and final Blue Pippen size selection.

In some embodiments, the method does not use an amplification step. Examples of such methods include preparation of samples for sequencing by Whole Genome Shotgun (WGS) sequencing. These approaches can provide a benefit by removing amplification bias that can skew microbial distributions. In addition, such approaches can allow for de novo discovery of pertinent elements, for example, bacterial plasmids, fungi and viruses.

The practice of the methods of the present disclosure can employ conventional techniques of immunology, biochemistry, chemistry, molecular biology, microbiology, cell biology, genomics and recombinant DNA, which are within the skill of the art. For example, preparation of a biological sample can comprise, e.g., extraction or isolation of intracellular material from a cell or tissue such as the extraction of nucleic acids, protein, or other macromolecules. Sample preparation which can be used with the methods of disclosure include but are not limited to, centrifugation, affinity chromatography, magnetic separation, immunoassay, nucleic acid assay, receptor-based assay, cytometric assay, colorimetric assay, enzymatic assay, electrophoretic assay, electrochemical assay, spectroscopic assay, chromatographic assay, microscopic assay, topographic assay, calorimetric assay, radioisotope assay, protein synthesis assay, histological assay, culture assay, and combinations thereof.

The present disclosure provides methods for generating or determining a microbiome profile of a subject. The present disclosure provides methods for measuring at least one microbe in a biological sample from at least one microbial habitat of a subject and determining a microbiome profile. A microbiome profile can be assessed using any suitable detection means that can measure or quantify one or more microbes (e.g., bacteria, fungi, viruses and archaea) that comprise a microbiome.

Figure 3:
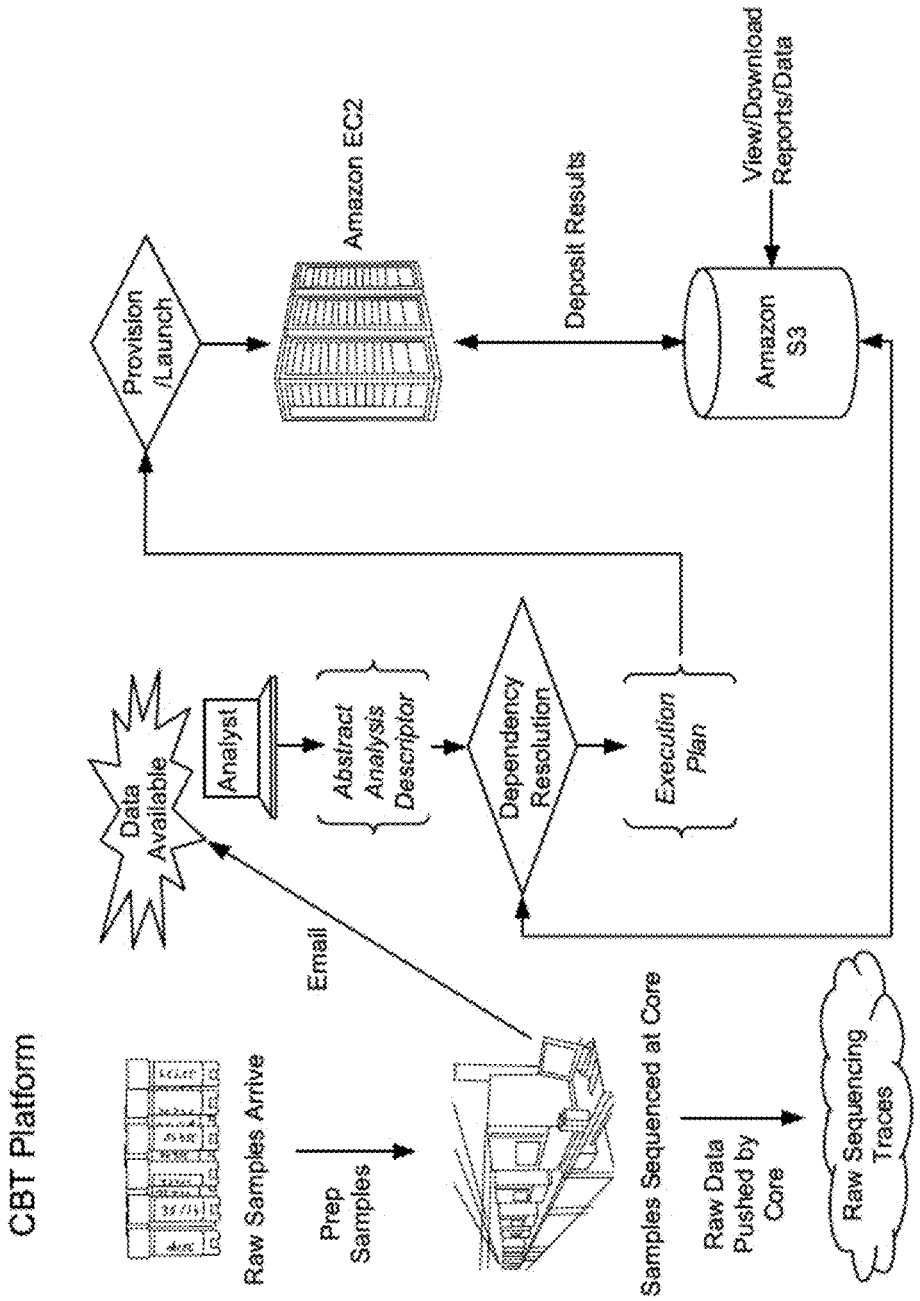
FIG. 3 is an illustration depicting an exemplary platform for a Complete Biome Test (CBT) (e.g. as a diagnostic test before or after treatment of a disorder or as a development tool to develop therapeutics). The specific microbiotic actionable targets starting with microbiotic strains obtained from, e.g. fecal matter transplants (FMT), the microorganism(s), the genus, and the presence/absence of microorganism strain(s) related to health conditions or diseases can be determined using the Complete Biome Test.

A Complete Biome Test (CBT) can generate microbiome profiles with, for example, strain-level resolution. A CBT can be performed using microbiome profiling methods described herein. FIG. 3 provides an illustration depicting an exemplary platform for a CBT (e.g. as a diagnostic test before or after treatment or as a development tool to develop therapeutics). The specific microbiotic actionable targets starting with microbiotic strains obtained from, e.g. fecal matter transplants (FMT), the microorganism(s), the genus, and the presence/absence of microorganism strain(s) related to health conditions or diseases can be determined using the CBT.

Figure 4A:
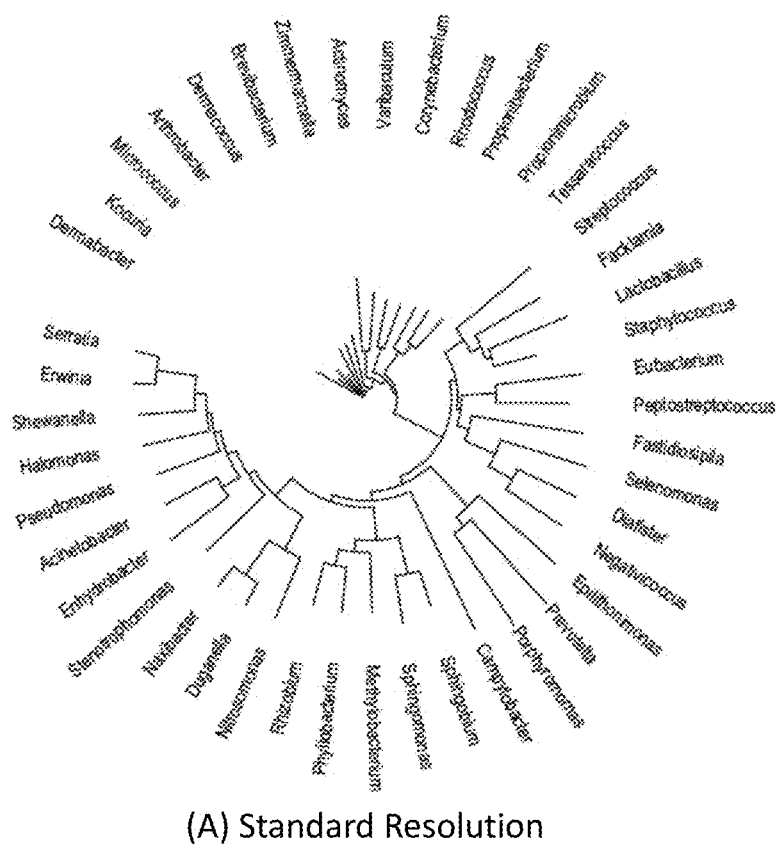
FIG. 4A depicts the microbiome strain resolution using standard tests and FIG. 4B depicts the increased microbiome strain resolution using a test of the disclosure, for example, a Complete Biome Test.
Figure 4B:
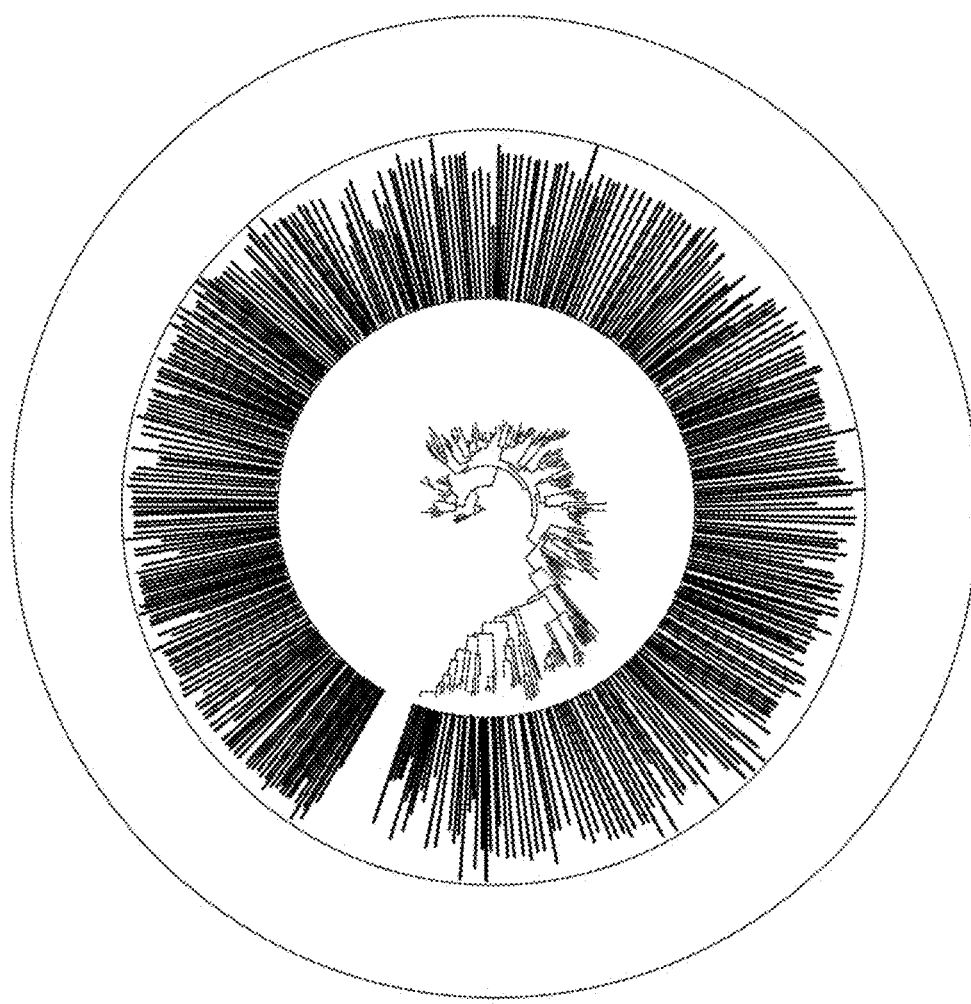
Figure 5:
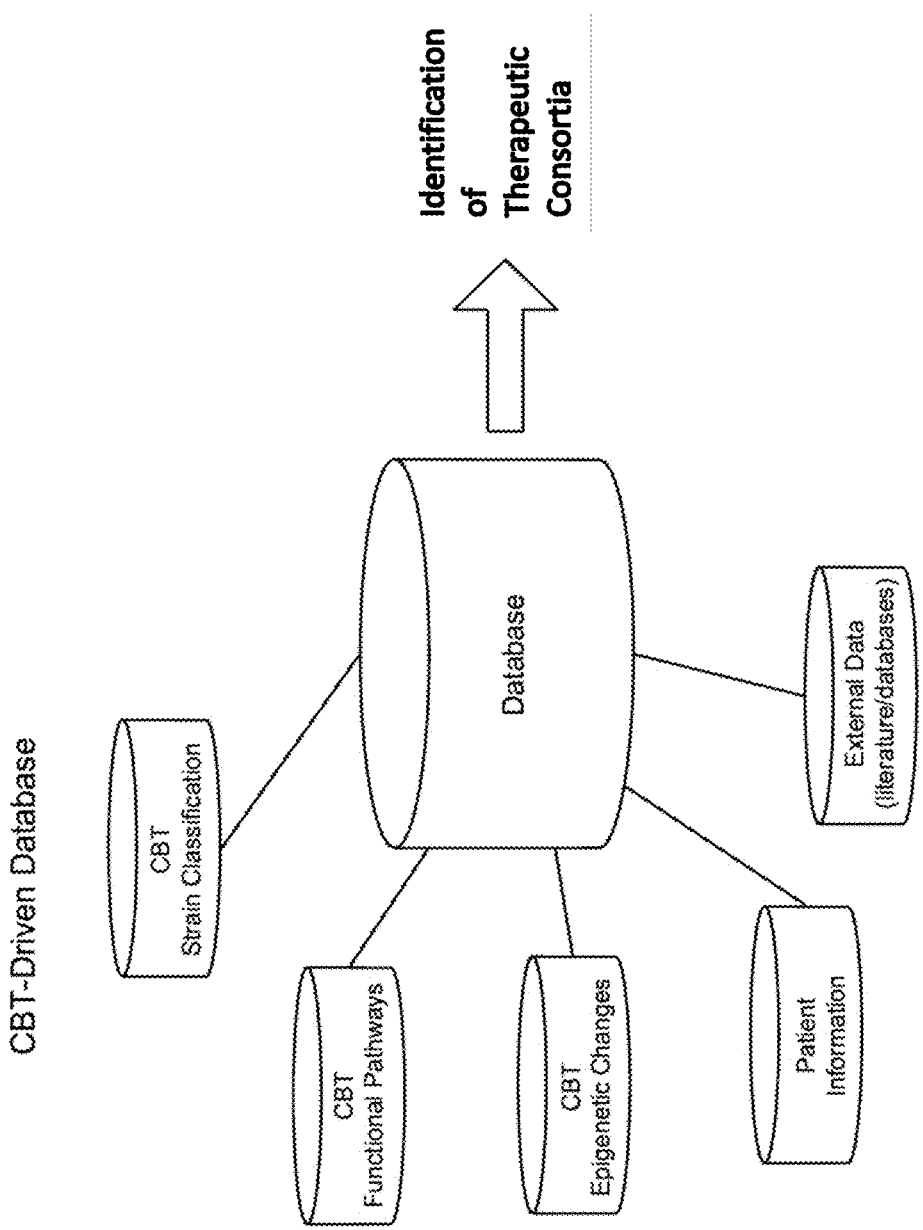
FIG. 5 depicts an illustrative process for generating a database using data obtained from the group consisting of: external data (e.g. scientific literature and/or databases), patient information, measured epigenetic changes, measured functional pathways, measured strain classification, and any combinations thereof. The database can be used, e.g. to drive identification of a therapeutic consortia (e.g. for treatment of health conditions or diseases).

FIG. 4A depicts the microbiome strain resolution using standard tests. FIG. 4B depicts the increased microbiome strain resolution using the CBT. FIG. 5 depicts an illustrative process for generating a database (e.g., a CBT driven-database using data obtained from the group consisting of: external data (e.g. scientific literature and/or databases), patient information, measured epigenetic changes, measured functional pathways, measured strain classification, and any combinations thereof. The database can be used, e.g. to drive identification of a therapeutic consortia (e.g. for treatment of health conditions or diseases).

Figure 6:
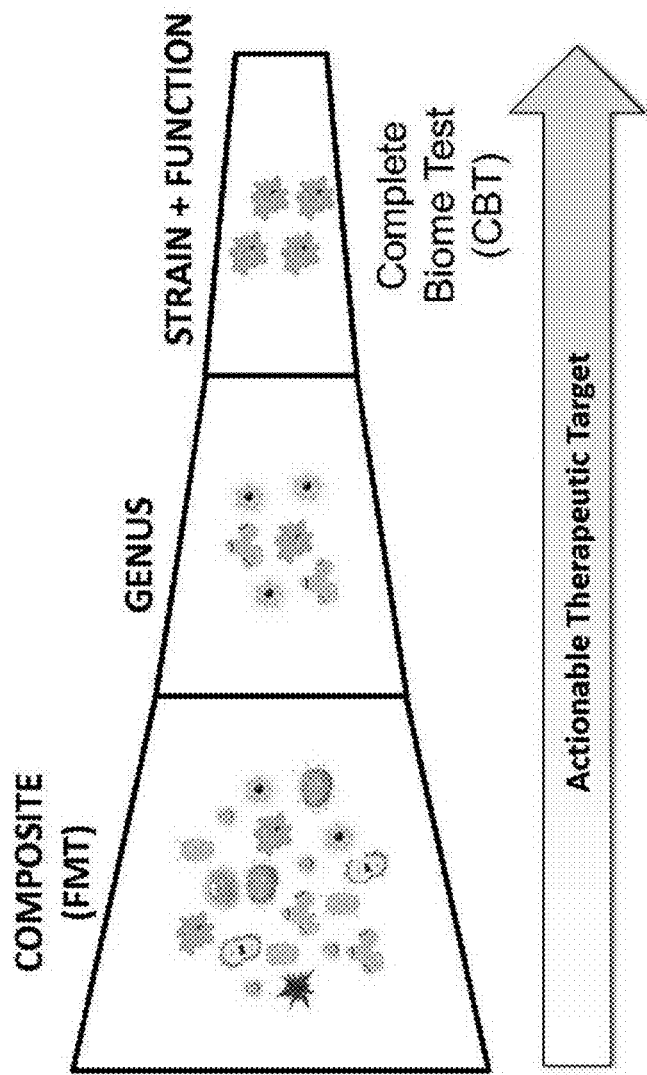
FIG. 6 depicts how both the diagnostic and therapeutic approach outlined herein can comprise a targeted microbe strain selection as compared to a composite fecal microbiome transplant.

FIG. 6 depicts how both the diagnostic and therapeutic approach outlined herein can comprise a targeted microbe strain selection or therapeutic consortia as compared to a composite fecal microbiome transplant.

Nucleic acid sample prepared from a biological sample can be subjected to a detection method to generate a profile of the microbiome associated with the sample. Profiling of a microbiome can comprise one or more detection methods.

Methods of the disclosure can be used to measure, for example, a 16S ribosomal subunit, a 23S ribosomal subunit, intergenic regions, and other genetic elements. Suitable detection methods can be chosen to provide sufficient discriminative power in a particular microbe in order to identify informative microbiome profiles.

In some applications, a ribosomal RNA (rRNA) operon of a microbe is analyzed to determine a subject's microbiome profile. In some applications, the entire genomic region of the 16S or 23S ribosomal subunit of the microbe is analyzed to determine a subject's microbiome profile. In some applications, the variable regions of the 16S and/or 23S ribosomal subunit of the microbe are analyzed to determine a subject's microbiome profile.

In some applications, the entire genome of the microbe is analyzed to determine a subject's microbiome profile. In other applications, the variable regions of the microbe's genome are analyzed to determine a subject's microbiome profile. For example, genetic variation in the genome can include restriction fragment length polymorphisms, single nucleotide polymorphisms, insertions, deletions, indels (insertions-deletions), microsatellite repeats, minisatellite repeats, short tandem repeats, transposable elements, randomly amplified polymorphic DNA, amplification fragment length polymorphism or a combination thereof.

In some embodiments, sequencing methods such as long-read length single molecule sequencing is used for detection. Long read sequencing can provide microbial classification down to the strain resolution of each microbe. Examples of sequencing technologies that can be used with the present disclosure for achieving long read lengths include the SMRT sequencing systems from Pacific Biosciences, long read length Sanger sequencing, long read ensemble sequencing approaches, e.g., Illumina/Moleculo sequencing and potentially, other single molecule sequencing approaches, such as Nanopore sequencing technologies.

Long read sequencing can include sequencing that provides a contiguous sequence read of for example, longer than 500 bases, longer than 800 bases, longer than 1000 bases, longer than 1500 bases, longer than 2000 bases, longer than 3000 bases, or longer than 4500 bases.

In some embodiments, detection methods of the disclosure comprise amplification-mode sequencing to profile the microbiome. In some embodiments, detection methods of the disclosure comprise a non-amplification mode, for example, Whole Genome Shotgun (WGS) sequencing, to profile the microbiome.

Primers used in the disclosure can be prepared by any suitable method, for example, cloning of appropriate sequences and direct chemical synthesis. Primers can also be obtained from commercial sources. In addition, computer programs can be used to design primers. Primers can contain unique barcode identifiers.

Microbiome profiling can further comprise use of for example, a nucleic acid microarray, a biochip, a protein microarray, an analytical protein microarray, reverse phase protein microarray (RPA), a digital PCR device, and/or a droplet digital PCR device.

In some embodiments, the microbial profile is determined using additional information such as age, weight, gender, medical history, risk factors, family history, or any other clinically relevant information. In some applications, a subject's microbiome profile can comprise of at least 1, 2, 3, 4, 5, 6, 7, 8, 9, 10, 11, 12, 13, 14, 15, 16, 17, 18, 19, 20 microbiomes.

A subject's microbiome profile can comprise of one microbe. In some applications, a subject's microbiome profile comprises of, for example, 2 microbes, 3 or fewer microbes, 4 or fewer microbes, 5 or fewer microbes, 6 or fewer microbes, 7 or fewer microbes, 8 or fewer microbes, 9 or fewer microbes, 10 or fewer microbes, 11 or fewer microbes, no more than 12 microbes, 13 or fewer microbes, 14 or fewer microbes, 15 or fewer microbes, 16 or fewer microbes, 18 or fewer microbes, 19 or fewer microbes, 20 or fewer microbes, 25 or fewer microbes, 30 or fewer microbes, 35 or fewer microbes, 40 or fewer microbes, 45 or fewer microbes, 50 or fewer microbes, 55 or fewer microbes, 60 or fewer microbes, 65 or fewer microbes, 70 or fewer microbes, 75 or fewer microbes, 80 or fewer microbes, 85 or fewer microbes, 90 or fewer microbes, 100 or fewer microbes, 200 or fewer microbes, 300 or fewer microbes, 400 or fewer microbe, 500 or fewer microbes, 600 or fewer microbes, 700 or fewer microbes, or 800 or fewer microbes.

The present disclosure provides algorithm-based methods for building a microbiome profile of a subject. Non-limiting examples of algorithms that can be used with the disclosure include elastic networks, random forests, support vector machines, and logistic regression.

The algorithms can transform the underlying measurements into a quantitative score or probability relating to, for example, disease risk, disease likelihood, presence or absence of disease, presence or absence of a microbe, treatment response, and/or classification of disease status. The algorithms can aid in the selection of important microbes.

A microbiome profile of a subject can be analyzed to determine information related to the health status of the subject. The information can include, for example, degree of likelihood of a disorder, presence or absence of a disease state, a poor clinical outcome, good clinical outcome, high risk of disease, low risk of disease, complete response, partial response, stable disease, non-response, and recommended treatments for disease management.

The analysis can be a part of a diagnostic assay to predict disease status of a subject or likelihood of a subject's response to a therapeutic. The diagnostic assay can use the quantitative score calculated by the algorithms-based methods described herein to perform the analysis.

In some applications, an increase in one or more microbes' threshold values or quantitative score in a subject's microbiome profile indicates an increased likelihood of one or more of: a poor clinical outcome, good clinical outcome, high risk of disease, low risk of disease, complete response, partial response, stable disease, non-response, and recommended treatments for disease management. In some embodiments, a decrease in the quantitative score indicates an increased likelihood of one or more of: a poor clinical outcome, good clinical outcome, high risk of disease, low risk of disease, complete response, partial response, stable disease, non-response, and recommended treatments for disease management.

In some applications, a decrease in one or more microbes' threshold values or quantitative score in a subject's microbiome profile indicates a decreased likelihood of one or more of: a poor clinical outcome, good clinical outcome, high risk of disease, low risk of disease, complete response, partial response, stable disease, non-response, and recommended treatments for disease management. In some embodiments, a decrease in the quantitative score indicates an increased likelihood of one or more of: a poor clinical outcome, good clinical outcome, high risk of disease, low risk of disease, complete response, partial response, stable disease, non-response, and recommended treatments for disease management.

In some applications, an increase in one or more microbes' threshold values or quantitative score in a subject's microbiome profile indicates an increased likelihood of one or more of: a poor clinical outcome, good clinical outcome, high risk of disease, low risk of disease, complete response, partial response, stable disease, non-response, and recommended treatments for disease management. In some applications, a decrease in one or more microbes' threshold values indicates an increased likelihood of one or more of: a poor clinical outcome, good clinical outcome, high risk of disease, low risk of disease, complete response, partial response, stable disease, non-response, and recommended treatments for disease management.

In some applications, an increase in one or more microbes' threshold values or quantitative score in a subject's microbiome profile indicates a decreased likelihood of one or more of: a poor clinical outcome, good clinical outcome, high risk of disease, low risk of disease, complete response, partial response, stable disease, non-response, and recommended treatments for disease management. In some applications, a decrease in one or more microbes' threshold values indicates an increased likelihood of one or more of: a poor clinical outcome, good clinical outcome, high risk of disease, low risk of disease, complete response, partial response, stable disease, non-response, and recommended treatments for disease management.

In some applications, a similar microbiome profile to a reference profile indicates an increased likelihood of one or more of: a poor clinical outcome, good clinical outcome, high risk of disease, low risk of disease, complete response, partial response, stable disease, non-response, and recommended treatments for disease management. In some applications, a dissimilar microbiome profile to a reference profile indicates one or more of: an increased likelihood of a poor clinical outcome, good clinical outcome, high risk of disease, low risk of disease, complete response, partial response, stable disease, non-response, and recommended treatments for disease management.

In some applications, a similar microbiome profile to a reference profile indicates a decreased likelihood of one or more of: a poor clinical outcome, good clinical outcome, high risk of disease, low risk of disease, complete response, partial response, stable disease, non-response, and recommended treatments for disease management. In some applications, a dissimilar microbiome profile to a reference profile indicates one or more of: an increased likelihood of a poor clinical outcome, good clinical outcome, high risk of disease, low risk of disease, complete response, partial response, stable disease, non-response, and recommended treatments for disease management.

In some applications, a dissimilar microbiome profile to a reference profile indicates an increased likelihood of one or more of: a poor clinical outcome, good clinical outcome, high risk of disease, low risk of disease, complete response, partial response, stable disease, non-response, and recommended treatments for disease management. In some applications, a dissimilar microbiome profile to a reference profile indicates one or more of: an increased likelihood of a poor clinical outcome, good clinical outcome, high risk of disease, low risk of disease, complete response, partial response, stable disease, non-response, and recommended treatments for disease management.

In some applications, a dissimilar microbiome profile to a reference profile indicates a decreased likelihood of one or more of: a poor clinical outcome, good clinical outcome, high risk of disease, low risk of disease, complete response, partial response, stable disease, non-response, and recommended treatments for disease management. In some applications, a dissimilar microbiome profile to a reference profile indicates one or more of: an increased likelihood of a poor clinical outcome, good clinical outcome, high risk of disease, low risk of disease, complete response, partial response, stable disease, non-response, and recommended treatments for disease management.

The methods provided herein can provide strain classification of a genera, species or sub-strain level of one or more microbes in a sample with an accuracy of greater than 1%, 20%, 30%, 40%, 50%, 55%, 60%, 65%, 70%, 75%, 80%, 85%, 90%, 95%, 96%, 97%, 98%, 99%, 99.2%, 99.5%, 99.7%, or 99.9%. The methods provided herein can provide strain quantification of a genera, species or sub-strain level of one or more microbes in a sample with an accuracy of greater than 1%, 20%, 30%, 40%, 50%, 55%, 60%, 65%, 70%, 75%, 80%, 85%, 90%, 95%, 96%, 97%, 98%, 99%, 99.2%, 99.5%, 99.7%, or 99.9%.

The microbial profile can have an accuracy of 70% or greater based on measurement of 15 or fewer microbes in the biological sample. Such profiling method can have at least an accuracy greater than 70% based on measurement of no more than 2 microbes, 3 or fewer microbes, 4 or fewer microbes, 5 or fewer microbes, 6 or fewer microbes, 7 or fewer microbes, 8 or fewer microbes, 9 or fewer microbes, 10 or fewer microbes, 11 or fewer microbes, no more than 12 microbes, 13 or fewer microbes, 14 or fewer microbes, 15 or fewer microbes, 16 or fewer microbes, 18 or fewer microbes, 19 or fewer microbes, 20 or fewer microbes, 25 or fewer microbes, 30 or fewer microbes, 35 or fewer microbes, 40 or fewer microbes, 45 or fewer microbes, 50 or fewer microbes, 55 or fewer microbes, 60 or fewer microbes, 65 or fewer microbes, 70 or fewer microbes, 75 or fewer microbes, 80 or fewer microbes, 85 or fewer microbes, 90 or fewer microbes, or 100 or fewer microbes, 200 or fewer microbes, 300 or fewer microbes, 400 or fewer microbes, 500 or fewer microbes, 600 or fewer microbes, 700 or fewer microbes, or 800 or fewer microbes.

The diagnostic methods provided by the present disclosure for the diseases provided herein can have at least one of a sensitivity of 70% or greater and specificity of greater than 70% based on measurement of 15 or fewer microbes in the biological sample. Such diagnostic method can have at least one of a sensitivity greater than 70% and specificity greater than 70% based on measurement of no more than 2 microbes, 3 or fewer microbes, 4 or fewer microbes, 5 or fewer microbes, 6 or fewer microbes, 7 or fewer microbes, 8 or fewer microbes, 9 or fewer microbes, 10 or fewer microbes, 11 or fewer microbes, no more than 12 microbes, 13 or fewer microbes, 14 or fewer microbes, 15 or fewer microbes, 16 or fewer microbes, 18 or fewer microbes, 19 or fewer microbes, 20 or fewer microbes, 25 or fewer microbes, 30 or fewer microbes, 35 or fewer microbes, 40 or fewer microbes, 45 or fewer microbes, 50 or fewer microbes, 55 or fewer microbes, 60 or fewer microbes, 65 or fewer microbes, 70 or fewer microbes, 75 or fewer microbes, 80 or fewer microbes, 85 or fewer microbes, 90 or fewer microbes, or 100 or fewer microbes, 200 or fewer microbes, 300 or fewer microbes, 400 or fewer microbes, 500 or fewer microbes, 600 or fewer microbes, 700 or fewer microbes or 800 or fewer microbes.

The methods provided herein can provide a health status of a subject with a specificity greater than 1%, 20%, 30%, 40%, 50%, 55%, 60%, 65%, 70%, 75%, 80%, 85%, 90%, 95%, 96%, 97%, 98%, 99%, 99.2%, 99.5%, 99.7%, or 99.9% receiver operating characteristic (ROC). The methods provided herein can provide a health status of a subject with a sensitivity lesser than 1%, 20%, 30%, 40%, 50%, 55%, 60%, 65%, 70%, 75%, 80%, 85%, 90%, 95%, 96%, 97%, 98%, 99%, 99.2%, 99.5%, 99.7%, or 99.9% ROC.

Computer Systems

Figure 7:
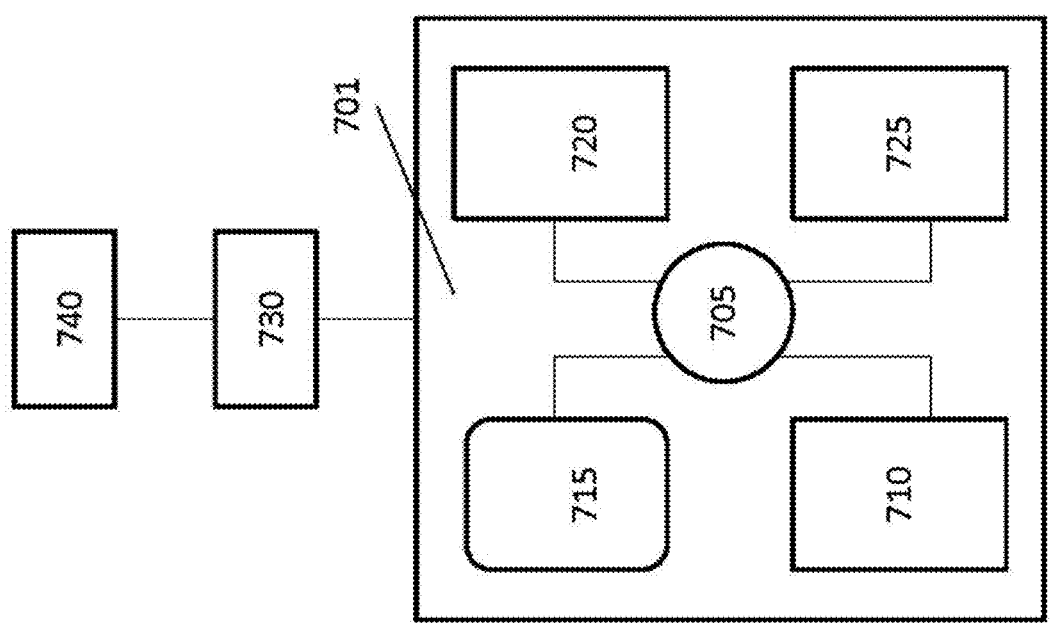
FIG. 7 depicts a system adapted to enable a user to detect, analyze, and process data (e.g. sequencing data, strain classification, functional pathways, epigenetic changes, patient information, external data, databases, microbiome strains; therapeutic consortia, etc.) using machine readable code.

The disclosure also provides a computer system that is configured to implement the methods of the disclosure. The system can include a computer server ("server") that is programmed to implement the methods described herein. FIG. 7 depicts a system 700 adapted to enable a user to detect, analyze, and process data (e.g. sequencing data; strain classification, functional pathways, epigenetic changes, patient information, external data, databases, microbiome strains; therapeutic consortia, etc.). The system 700 includes a central computer server 701 that is programmed to implement exemplary methods described herein. The server 701 includes a central processing unit (CPU, also "processor") 705 which can be a single core processor, a multi core processor, or plurality of processors for parallel processing, or cloud processors. The server 701 also includes memory 710 (e.g. random access memory, read-only memory, flash memory); electronic storage unit 715 (e.g. hard disk); communications interface 720 (e.g. network adaptor) for communicating with one or more other systems; and peripheral devices 725 which may include cache, other memory, data storage, and/or electronic display adaptors. The memory 710, storage unit 715, interface 720, and peripheral devices 725 are in communication with the processor 705 through a communications bus (solid lines), such as a motherboard. The storage unit 715 can be a data storage unit for storing data. The server 701 is operatively coupled to a computer network ("network") 730 with the aid of the communications interface 720. The network 730 can be the Internet, an intranet and/or an extranet, an intranet and/or extranet that is in communication with the Internet, a telecommunication or data network. The network 730 in some cases, with the aid of the server 701, can implement a peer-to-peer network, which may enable devices coupled to the server 701 to behave as a client or a server. Peripheral devices can include, e.g. sequencers 725 or remote computer systems 740.

The storage unit 715 can store files, (e.g. any aspect of data associated with the disclosure). In some instances cloud storage is used. Cloud storage can be a model of data storage where the digital data is stored in logical pools, wherein the physical storage can span multiple servers and, in some instances, one or more locations. In some embodiments, the physical environment is owned and managed by a hosting company. Cloud storage services may be accessed, e.g., through a co-located cloud compute service, a web service application programming interface (API) or by applications that utilize the API, such as cloud desktop storage, a cloud storage gateway or Web-based content management systems.

The server can communicate with one or more remote computer systems through the network 730. The one or more remote computer systems may be, for example, personal computers, laptops, tablets, telephones, Smart phones, or personal digital assistants.

In some situations the system 700 includes a single server 701. In other situations, the system includes multiple servers in communication with one another through an intranet, extranet and/or the Internet.

The server 701 can be adapted to store information. Such information can be stored on the storage unit 715 or the server 701 and such data can be transmitted through a network.

Methods as described herein can be implemented by way of machine (e.g., computer processor) computer readable medium (or software) stored on an electronic storage location of the server 701, such as, for example, on the memory 710, or electronic storage unit 715. During use, the code can be executed by the processor 705. In some cases, the code can be retrieved from the storage unit 715 and stored on the memory 710 for ready access by the processor 705. In some situations, the electronic storage unit 715 can be precluded, and machine-executable instructions are stored on memory 710. Alternatively, the code can be executed on a second computer system 740.

Aspects of the systems and methods provided herein, such as the server 701, can be embodied in programming Various aspects of the technology may be thought of as "products" or "articles of manufacture" typically in the form of machine (or processor) executable code and/or associated data that is carried on or embodied in a type of machine readable medium (e.g., computer readable medium). Machine-executable code can be stored on an electronic storage unit, such memory (e.g., read-only memory, random-access memory, flash memory) or a hard disk. "Storage" type media can include any or all of the tangible memory of the computers, processors or the like, or associated modules thereof, such as various semiconductor memories, tape drives, disk drives and the like, which may provide non-transitory storage at any time for the software programming. All or portions of the software may at times be communicated through the Internet or various other telecommunication networks. Such communications, for example, may enable loading of the software from one computer or processor into another, for example, from a management server or host computer into the computer platform of an application server. Thus, another type of media that may bear the software elements includes optical, electrical, and electromagnetic waves, such as used across physical interfaces between local devices, through wired and optical landline networks and over various air-links. The physical elements that carry such waves, such as wired or wireless likes, optical links, or the like, also may be considered as media bearing the software. As used herein, unless restricted to non-transitory, tangible "storage" media, terms such as computer or machine "readable medium" refer to any medium that participates in providing instructions to a processor for execution.

Hence, a machine readable medium, such as computer-executable code, may take many forms, including but not limited to, tangible storage medium, a carrier wave medium, or physical transmission medium. Non-volatile storage media can include, for example, optical or magnetic disks, such as any of the storage devices in any computer(s) or the like, such may be used to implement the system. Tangible transmission media can include: coaxial cables, copper wires, and fiber optics (including the wires that comprise a bus within a computer system). Carrier-wave transmission media may take the form of electric or electromagnetic signals, or acoustic or light waves such as those generated during radio frequency (RF) and infrared (IR) data communications. Common forms of computer-readable media therefore include, for example: a floppy disk, a flexible disk, hard disk, magnetic tape, any other magnetic medium, a CD-ROM, DVD, DVD-ROM, any other optical medium, punch cards, paper tame, any other physical storage medium with patterns of holes, a RAM, a ROM, a PROM and EPROM, a FLASH-EPROM, any other memory chip or cartridge, a carrier wave transporting data or instructions, cables, or links transporting such carrier wave, or any other medium from which a computer may read programming code and/or data. Many of these forms of computer readable media may be involved in carrying one or more sequences of one or more instructions to a processor for execution.

Methods for Treating a Subject

The disclosure provides methods and compositions for treating a subject. The disclosure provides methods and compositions for treating a microbiome-associated disorder. Altering and/or restoring the composition of a microbiome in a subject can have desired health consequences. Compositions of the disclosure can be administered as a therapeutic and/or a cosmetic for treating a health condition. Treatments designed to alter the host microbiome(s) can result in a reduction of patient symptoms, prevention of disease, and or treatment of the disease or health condition.

The methods, compositions, and kits of the disclosure can comprise a method to treat, prevent, arrest, reverse, or ameliorate a disorder. In some embodiments, the modulation is achieved by administering a therapeutically-effective amount of a microbial-based composition at any body site that shows a correlated link to disease onset. In some embodiments, the composition is delivered to the gut of a subject. In some embodiments, the composition is released in the gut of a subject.

FIG. 1 depicts some non-limiting heath conditions that can be affected by the microbiome. These health conditions can include, for example, Type 2 Diabetes Mellitus (T2DM), preterm labor, chronic fatigue syndrome, skin conditions such as acne, allergies, autism, asthma, depression, hypertension, irritable bowel syndrome, metabolic syndrome, obesity, lactose intolerance, oral thrush, ulcerative colitis, drug metabolism, vaginosis, atopic dermatitis, psoriasis, Type I Diabetes Mellitus (T1DM), diabetes, Multiple Sclerosis, neurological disorders such as Parkinson's disease, *Clostridium difficile* infection, Inflammatory Bowel Disease, Crohn's Disease, heart disease, diabetic foot ulcers, bacteremia, infantile colic, cancer, cystic fibrosis, multiple sclerosis, urinary tract infection, radiation enteropathy, drug metabolism, dental cavities, halitosis, metabolic disorder, gastrointestinal disorder, insulin insensitivity, metabolic syndrome, insulin deficiency, insulin resistance, glucose intolerance, Non Alcoholic Fatty Acid Liver Disease, Cardiovascular Disease, Hypertension, disorder associated with Cholesterol, disorder associated with Triglycerides, obesity, overweight, inflammation, infant formula feeding, appendicitis, atopic disease, ageing, fasting, obese pregnant women, dextran sodium sulfate-induced colitis, diarrhea, allergic diarrhea, and atherosclerosis.

The present disclosure can provide for a diagnostic assay of at least one microbiome that includes a report that gives guidance on health status or treatment modalities for the health conditions described herein. The present disclosure can also provide therapeutic and/or cosmetic formulations for treatment of health conditions described herein.

The disclosure provides methods for the restoration of a microbial habitat of a subject to a healthy state. The method can comprise microbiome correction and/or adjustment including for example, replenishing native microbes, removing pathogenic microbes, administering prebiotics, and growth factors necessary for microbiome survival. In some embodiments, the method also comprises administering antimicrobial agents such as antibiotics.

Based on the microbiome profile, the present disclosure provides methods for generalized-treatment recommendation for a subject as well as methods for subject-specific treatment recommendation. Methods for treatments can comprise one of the following steps: determining a first ratio of a level of a subject-specific microbiome profile to a level of a second microbiome profile in a biological sample obtained from at least one subject, detecting a presence or absence of a disease in the subject based upon the determining, and recommending to the subject at least one generalized or subject-specific treatment to ameliorate disease symptoms.

Microbiome-Associated Disorders

In some embodiments, the disorder is associated with and/or caused by an altered microbiome of the subject. In some embodiments, a disorder is associated with and/or caused by gut dysbiosis. In some embodiments, the disorder is associated with and/or caused by an altered production of one or more short chain fatty acids (SCFAs) in the subject. In some embodiments, the short chain fatty acid is butyrate. In some embodiments, the short chain fatty acid is propionate (e.g., indole 3-propionate). In some embodiments, the short chain fatty acid is acetate. In some embodiments, the disorder is caused by reduced butyrate production. For example, a patient can have reduced short-chain fatty acid producing (e.g. butyrate-producing) microbes. Altered SCFA production can be caused by, for example, an altered SCFA pathway (e.g., altered butyrate pathway), altered SCFA-producing microbes, or an increase or decrease in substrate or cofactors needed for the SCFA pathway or SCFA-producing microbes. Altered butyrate production can affect one or more downstream signaling pathways in a subject, which can lead to a disorder. Methods and compositions, for example, comprising probiotics to increase butyrate production can be used for treating a disorder.

Methods and compositions for diagnosis and treatment of disorders are described in U.S. Pat. No. 9,486,487, which is herein incorporated by reference in its entirety for all purposes.

A subject with a microbiome-associated disorder can have, for example, a reduced population of *Bacteroides, Eubacterium, Faecalibacterium, Ruminococcus*, or a combination thereof; an increase in *Actinomyces, Bifidobacterium*, or a combination thereof; a decrease in butyrate production pathway; a decrease in butyrate producing strains; a decrease in butyric acid concentration (e.g., in feces); an imbalance in intestinal microflora constitution, or a combination thereof. A microbiota signature of a disorder can be used as a diagnostic for determining a disorder.

A disorder or condition treated by a composition of the disclosure can include skin or dermatological disorders, metabolic disorders, neurological disorders, cancer, cardiovascular disorders, immune function disorders, inflammatory disorder, pulmonary disorder, metastasis, a chemotherapy or radiotherapy-induced condition, age-related disorder, a premature aging disorder, and a sleep disorders.

Alterations in gut microbiota can be implicated in the pathophysiology of a disorder, for example, skin or dermatological disorders, metabolic disorders, neurological disorders, cancer, cardiovascular disorders, immune function disorders, inflammation, inflammatory disorder, pulmonary disorder, metastasis, a chemotherapy or radiotherapy-induced condition, age-related disorder, a premature aging disorder, and a sleep disorders.

A subject with a metabolic disorder or metabolic syndrome can suffer from a comorbid condition that can include, for example, skin or dermatological disorders, neurological disorders, cancer, cardiovascular disorders, immune function disorders, inflammatory disorder, pulmonary disorder, metastasis, a chemotherapy or radiotherapy-induced condition, age-related disorder, a premature aging disorder, a sleep disorder, vaginal disorder, dental disorder, pregnancy-related disorder, or a combination thereof.

In some embodiments, the disorder is a neurological condition. In some embodiments, the disorder is a behavioral condition. Neurological conditions include, but are not limited to, neural activity disorders, anxiety, depression, food addiction, chronic fatigue syndrome, autism, autistic spectrum disorder, Asperger syndrome, Pervasive Developmental Disorder, Parkinson's disease, Alzheimer's disease, dementia, amyotrophic lateral sclerosis (ALS), bulbar palsy, pseudobulbar palsy, primary lateral sclerosis, motor neuron dysfunction (MND), mild cognitive impairment (MCI), Huntington's disease, ocular diseases, age-related macular degeneration, glaucoma, vision loss, presbyopia, cataracts, progressive muscular atrophy, lower motor neuron disease, spinal muscular atrophy (SMA), Werdnig-Hoffman Disease (SMA1), SMA2, Kugelberg-Welander Disease (SM3), Kennedy's disease, post-polio syndrome, and hereditary spastic paraplegia. Compositions of the disclosure can be used, for example, for stabilizing mood, improving mood, modulating excessive emotional distress, reducing anxiety, reducing stress, and combinations thereof. In some embodiments, the disorder is a behavioral condition. In some embodiments, the disorder is Parkinson's disease. In some embodiments, the disorder is food addiction. In some embodiments, the disorder is anxiety. In some embodiments, the disorder is depression.

Gut microbes can play a role in a subject's nervous system and behavior. Increasing SCFA production (e.g., by increasing butyrate producers) can, for example, improve brain development, motor activity, reduce anxiety, improve depression, increase immunoregulatory Treg cells, and improve psychological states.

Methods and compositions of the disclosure can regulate, for example, hypothalamus-pituitary-adrenal axis (HPA), immune systems, enteric nervous system, autonomic nervous system, central nervous system, production of neuroactive substances, production of short chain fatty acids (SCFAs), production of antibiotic active substances, and altered intestinal function (e.g, sensory-motor function, barrier function).

Methods and compositions of the disclosure can regulate behavior by, for example, regulation of cortisol, serotonin, dopamine, and/or GABA. Methods and compositions of the disclosure can be used to regulate appetite by, for example, regulation of insulin, leptin, ghrelin, and/or GLP-1.

Methods and compositions of the disclosure can regulate intestinal immune system by, for example, regulation of mast cell activation and/or inflammatory cytokine production.

Butyrate can activate intestinal gluconeogenesis in insulin-sensitive and insulin-insensitive states, which can promote glucose and energy homeostasis. Microbial compositions can alter activity in brain regions that control central processing of emotion and sensation.

In some embodiments, methods and compositions of the disclosure modulate (e.g., reduce) appetite in a subject. In some embodiments, methods and compositions of the disclosure modulate (e.g., improve) behavior of a subject. Methods and compositions of the disclosure modulate (e.g., promote) satiety in a subject.

Butyrate production by gut microbiome can decrease appetite, for example, via gut-brain connection. Obese subjects can have increased scores on food addition and food cravings scales when compared to lean subjects. Alterations in gut microbiota can be implicated in the pathophysiology of several brain disorders including anxiety, depression, and appetite. When fiber is ingested, gut microbes can metabolize the fiber into short chain fatty acids, including butyrate. Butyrate can bind to receptors, for example, G-protein coupled receptors. For example, butyrate can bind to G-protein coupled receptor GPR41 and trigger peptide tyrosine-tyrosine (PYY) and glucagon-like peptide 1 (GLP-1). PYY and GLP-1 can bind to receptors in the enteric nervous system, resulting in signaling to the brain via the vagus nerve that can result in reducing appetite. Similarly, administration of the microbial compositions to alter the gut microbiota, as described herein, can result in changes in the gastrointestinal system to influence, e.g., inhibit, sensory and other neuronal activities in the gut, as well as influence neurological characteristics, e.g., anxiety, depression and appetite, associated with such activities (See, e.g., Example 1, below).

In some embodiments, methods of the disclosure provide a synbiotic (e.g., comprising prebiotics and probiotics) intervention method, which can target a specific gut microbiome biochemical pathway linked to altered brain function and behavior. In some embodiments, the disclosure provides companion diagnostic for assessing efficacy of microbiome-based treatments of comorbid psychiatric disorders. In some embodiments, the disclosure provides extension of Boolean implications and application of co-inertia analysis as state-of-the-art statistical methods for exploratory data analysis and biomarker discovery.

Methods and compositions of the disclosure can alter levels of neurotransmitters substance (e.g., serotonin, dopamine, GABA), neuroactive metabolite (e.g., branched chain and aromatic amino acids, p cresol, N acetyl putrescine, o cresol, phenol sulfate, kinurate, caproate, histamine, agmatine), and inflammatory agents (e.g., lipopolysaccharide, IL-1, IL-6, IL-8, TNF-alpha, CRP) in a subject. The strains described herein have been found to carry genes for critical neurotransmitter production pathway enzymes, e.g., *A. muciniphila* glutamate decarboxylase, see, e.g., www.uniprot.org/uniprot/R6IYN9.

A microbial composition of the disclosure can produce or regulate production of propionate, for example, indole 3-propionate. Indole-3-propionate can function as an antioxidant. Indole-3-propionate can be associated with neurological disorders, e.g., Alzheimer's disease. Indole-3-propionate can protect neurons and neuroblastoma cells from beta-amyloid protein toxicity. Indole-3-propionate can be produced from, for example, dietary tryptophan by microbes such as *Clostridium sporogenes* in the gastrointestinal tract. A microbial composition of the disclosure comprising an isolated and purified population of a microbe comprising at least about 85% (e.g., 90%, 95%, 98%, 99% or 100%) sequence identity to a rRNA (e.g., 16S or 23S) sequence of *Clostridium sporogenes* can be used to treat a neurological disorder (e.g., Alzheimer's disease).

In some embodiments, the disclosure provides a method for treating a neurological disorder, for example, Parkinson's disease. The method can comprise administering (e.g., orally) a composition comprising a population of isolated and purified microbes. The population of isolated and purified microbes can comprise a microbe that produces a SCFA in the subject. The SCFA can be butyrate. The SCFA-producing composition can result in modulation (e.g., activation) of a Glucagon-like peptide-1 pathway (GLP-1) in a subject, which can result in increased production of GLP-1 in the subject (see FIG. 13). Increased GLP-1 production can result in a neuroprotective effect in the subject.

In some embodiments, the disorder is a metabolic disorder. In some embodiments, the disorder is a metabolic disorder in a non-obese subject. In some embodiments, the disorder is a comorbid condition of a metabolic disorder. Non-limiting examples of metabolic disorders include diabetes, Type I diabetes mellitus, Type II diabetes mellitus, gestational diabetes, juvenile diabetes, metabolic syndrome, inflammatory bowel disease (IBD), irritable bowel syndrome, obesity, overweight condition, ischemia-reperfusion injury such as hepatic ischemia-reperfusion injury, fatty liver disease, non-alcoholic fatty liver disease (NAFLD), non-alcoholic steatohepatitis (NASH), NAFLD in a non-obese subject (e.g., NAFLD not caused by or related to obesity or excess weight problems), NASH in a non-obese subject (e.g., NASH not caused or related to obesity or excess weigh problems), Crohn's disease, colitis, ulcerative colitis, Pseudomembranous colitis, renal dysfunction, nephrological pathology, glomerular disease, drug metabolism, lactose intolerance, insulin insensitivity, insulin deficiency, insulin resistance, glucose intolerance, diarrhea, allergic diarrhea, and dextran sodium sulfate-induced colitis.

In some embodiments, the disorder is Type I diabetes mellitus (T1DM). Patients with T1DM can have reduced bacterial diversity and reduced butyrate producing microbes. Increasing butyrate production, for example by administering a composition comprising *A. muciniphila*, can be used for T1DM treatment.

In some embodiments, the disorder is inflammatory bowel disease (IBD). Patients with IBD can have reduced butyrate production (e.g., due to reduced butyrate-producing microbes). Increasing butyrate production can result in decreased IBD. Butyrate can ameliorate colonic inflammation associated with IBD.

In some embodiments, the disorder is Crohn's disease. Butyrate can, for example, decrease cytokine (e.g., Tumor Necrosis Factor; proinflammatory cytokine mPRA) production; abolish lipopolysaccharide induced expression of cytokines; and abolish transmigration of NFkappaB (NF-kB) to the nucleus in blood cells. Butyrate can decrease proinflammatory cytokine expression, for example, via inhibition of NF-kB activation and IkappaBalpha (IdBa) degradation. Butyrate can inhibit inflammatory responses (e.g., in Crohn's disease) through NF kappa B inhibition.

In some embodiments, the disorder is non-alcoholic fatty liver disease (NAFLD). Subjects with NAFLD can have reduced butyrate production and/or butyrate-producing microbes. Administration of butyrate-producing microbes (e.g. *C. butyricum*) can reduce NAFLD progression, reduce hepatic lipid deposition, improve triglyceride content, improve insulin resistance, improve serum endotoxin levels, and improve hepatic inflammatory indexes. Altered gut microbiome can independently cause obesity, which can be one of the most important risk factor for NAFLD. This capability can be attributed to short-chain fatty acids (SCFAs), which are gut microbial fermentation products. SCFAs can account for a large portion of caloric intake of the host. SCFAs can enhance intestinal absorption by activating GLP-2 signaling. Elevated SCFAs can be an adaptive measure to suppress colitis, which could be a higher priority than imbalanced calorie intake. The microbiome of non-alcoholic steatohepatitis (NASH) patients can feature an elevated capacity for alcohol production. The pathomechanisms for alcoholic steatohepatitis can apply to NASH. NAFLD/NASH can be associated with elevated Gram-negative microbiome and endotoxemia. NASH patients can exhibit normal serum endotoxin indicating that endotoxemia may not be required for the pathogenesis of NASH. Microbial compositions of the disclosure can benefit NAFLD/NASH patients.

In some embodiments, the disorder is total hepatic ischemia reperfusion injury. Butyrate preconditioning can improve hepatic function and histology following ischemia-reperfusion injury. Inflammatory factors levels, macrophages activation, TLR4 expression and neutrophil infiltration can be attenduated by butyrate.

In some embodiments, the disorder is gestational diabetes.

In some embodiments, the disorder is an immune system disorder. In some embodiments, the disorder is an inflammatory condition.

Non-limiting examples of immune system related disorders include allergies, inflammation, inflammatory disorder, anaphylactic shock, autoimmune diseases, rheumatoid arthritis, systemic lupus erythematosus (SLE), scleroderma, diabetes, Autoimmune enteropathy, Coeliac disease, Crohn's disease, Microscopic colitis, ulcerative colitis, osteoarthritis, osteoporosis, oral mucositis, inflammatory bowel disease, kyphosis, herniated intervertebral disc, ulcerative asthma, renal fibrosis, liver fibrosis, pancreatic fibrosis, cardiac fibrosis, skin wound healing, and oral submucous fibrosis.

In some embodiments, the disclosure provides methods for treating or reducing the likelihood of conditions resulting from a host immune response to an organ transplant in a subject in need thereof. Non-limiting examples of an organ transplant include a kidney organ transplant, a bone marrow transplant, a liver transplant, a lung transplant, and a heart transplant. In some embodiments, the disclosure provides methods for treating graft-vs-host disease in a subject in need thereof.

Microbial metabolites can play a role in development of the immune system. Gut microbiome can play a role in the development of allergies. Microbes can mediate immunomodulation. Based on the immunomodulating capacities of bacteria, probiotics can be used for treating eczema, for example, *Bifidobacterium bifidum*, *Bifidobacterium animalis* subsp. *Lactis*, and *Lactococcus lactis*. Lower amounts of metabolites, SCFAs, succinate, phenylalanine, and alanine can be found in faecal samples of subjects (e.g., children) later developing skin disorders (e.g, eczema), whereas the amounts of glucose, galactose, lactate and lactose can be higher compared to the subjects not developing skin disorders. Supplementation of multispecies probiotics can induce higher levels of lactate and SCFAs, and lower levels of lactose and succinate.

Administration of compositions comprising SCFA or SCFA-producing microbes can increase immunoregulatory cells.

In some embodiments, the disorder is a dermatological disorder. Dermatological conditions include, but are not limited to, acne, psoriasis, eczema, rashes, rhytides, pruritis, dysesthesia, papulosquamous disorders, erythroderma, lichen planus, lichenoid dermatosis, atopic dermatitis, eczematous eruptions, eosinophilic dermatosis, reactive neutrophilic dermatosis, pemphigus, pemphigoid, immunobullous dermatosis, fibrohistiocytic proliferations of skin, cutaneous lymphomas, and cutaneous lupus In some embodiments, the disorder is atopic dermatitis. In some embodiments, the disorder is eczema.

Patients with skin disorders (e.g, atopic dermatitis) can have, for example, reduced butyrate producing microbes, lower diversity of the phylum Bacteriodetes, altered diversity of gut microbiome, and altered abundance of *C. eutactus*.

In some embodiments, the disorder is a cardiovascular disorder. Non-limiting examples of cardiovascular conditions, include, but are not limited to angina, arrhythmia, atherosclerosis, cardiomyopathy, congestive heart failure, coronary artery disease (CAD), carotid artery disease, endocarditis, heart attack, coronary thrombosis, myocardial infarction (MI), high blood pressure/hypertension, aortic aneurysm, brain aneurysm, cardiac fibrosis, cardiac diastolic dysfunction, hypercholesterolemia/hyperlipidemia, heart disease, mitral valve prolapse, peripheral vascular disease, peripheral artery disease (PAD), cardiac stress resistance, stroke, a disorder associated with altered cholesterol levels, and a disorder associated with altered triglycerides.

In some embodiments, the disorder is a pulmonary condition or disorder. Pulmonary conditions include, but are not limited to, idiopathic pulmonary fibrosis (IPF), chronic obstructive pulmonary disease (COPD), asthma, cystic fibrosis, bronchiectasis, and emphysema.

In some embodiments, the subject has been exposed to environmental pollutants, for example, silica. A subject can be exposed to an occupational pollutant, for example, dust, smoke, asbestos, or fumes. In some embodiments, the subject has smoked cigarettes.

In some embodiments, the subject has a connective tissue disease. The connective tissue disease can be, for example, rheumatoid arthritis, systemic lupus erythematosus, scleroderma, sarcoidosis, or Wegener's granulomatosis. In some embodiments, the subject has an infection. In some embodiments, the subject has taken or is taking medication or has received radiation therapy to the chest. The medication can be, for example, amiodarone, bleomycin, busufan, methotrexate, or nitrofurantoin.

In some embodiments, the disorder is cancer. Non-limiting examples of cancers include: colorectal cancer, acute lymphoblastic leukemia, acute myeloid leukemia, adrenocortical carcinoma, AIDS-related cancers, AIDS-related lymphoma, anal cancer, appendix cancer, astrocytomas, neuroblastoma, basal cell carcinoma, bile duct cancer, bladder cancer, bone cancers, brain tumors, such as cerebellar astrocytoma, cerebral astrocytoma/malignant glioma, ependymoma, medulloblastoma, supratentorial primitive neuroectodermal tumors, visual pathway and hypothalamic glioma, breast cancer, bronchial adenomas, Burkitt lymphoma, carcinoma of unknown primary origin, central nervous system lymphoma, cerebellar astrocytoma, cervical cancer, childhood cancers, chronic lymphocytic leukemia, chronic myelogenous leukemia, chronic myeloproliferative disorders, colon cancer, cutaneous T-cell lymphoma, desmoplastic small round cell tumor, endometrial cancer, ependymoma, esophageal cancer, Ewing's sarcoma, germ cell tumors, gallbladder cancer, gastric cancer, gastrointestinal carcinoid tumor, gastrointestinal stromal tumor, gliomas, hairy cell leukemia, head and neck cancer, heart cancer, hepatocellular (liver) cancer, Hodgkin lymphoma, Hypopharyngeal cancer, intraocular melanoma, islet cell carcinoma, Kaposi sarcoma, kidney cancer, laryngeal cancer, lip and oral cavity cancer, liposarcoma, liver cancer, lung cancers, such as non-small cell and small cell lung cancer, lymphomas, leukemias, macroglobulinemia, malignant fibrous histiocytoma of bone/osteosarcoma, medulloblastoma, melanomas, mesothelioma, metastatic squamous neck cancer with occult primary, mouth cancer, multiple endocrine neoplasia syndrome, myelodysplastic syndromes, myeloid leukemia, nasal cavity and paranasal sinus cancer, nasopharyngeal carcinoma, neuroblastoma, non-Hodgkin lymphoma, non-small cell lung cancer, oral cancer, oropharyngeal cancer, osteosarcoma/malignant fibrous histiocytoma of bone, ovarian cancer, ovarian epithelial cancer, ovarian germ cell tumor, pancreatic cancer, pancreatic cancer islet cell, paranasal sinus and nasal cavity cancer, parathyroid cancer, penile cancer, pharyngeal cancer, pheochromocytoma, pineal astrocytoma, pineal germinoma, pituitary adenoma, pleuropulmonary blastoma, plasma cell neoplasia, primary central nervous system lymphoma, prostate cancer, rectal cancer, renal cell carcinoma, renal pelvis and ureter transitional cell cancer, retinoblastoma, rhabdomyosarcoma, salivary gland cancer, sarcomas, skin cancers, skin carcinoma merkel cell, small intestine cancer, soft tissue sarcoma, squamous cell carcinoma, stomach cancer, T-cell lymphoma, throat cancer, thymoma, thymic carcinoma, thyroid cancer, trophoblastic tumor (gestational), cancers of unknown primary site, urethral cancer, uterine sarcoma, vaginal cancer, vulvar cancer, Waldenström macroglobulinemia, Wilms tumor, and cancer that has metastasized.

In some embodiments, the disorder is colorectal cancer.

Subjects with cancer can have altered butyrate production, for example, due to reduced butyrate-producing microbes. Methods and compositions of the disclosure can be used for tumor treatment and reduction, for example, by delivering butyrate producing microbes to the subject.

Most cell types in the body can utilize glucose as their primary energy source, while normal colonocytes can rely on butyrate for about 60-70% of their energy. Butyrate can undergo beta-oxidation in the mitochondria, which can support energy homeostasis for rapid cell proliferation of the colonic epithelium. In contrast, tumor cells (e.g., colorectal tumor cells) can switch to glucose utilization and aerobic glycolysis. As a result of this metabolic shift, butyrate may not metabolize in the mitochondria of tumor cells to the same extent and can accumulate in the nucleus. In the nucleus, butyrate can function as a histone deacetylase (HDAC) inhibitor to epigenetically regulate gene expression. Patients with colitis can have, for example, up to a 10-fold increase of colorectal cancer.

Methods and compositions of the disclosure can increase levels of butyrate, which can serve as an endogenous HDAC inhibitor. Since bioavailability of butyrate can be primarily restricted to the colon, butyrate may not have adverse effects associated with synthetic HDAC inhibitors such as those used in chemotherapy. Butyrate can target tumor cells, for example, because of the Warburg effect.

Dietary risk of cancer (e.g., colon cancer) can be mediated by dysbiosis of gut microbiota and their metabolites (e.g., SCFAs such as butyrate). Dietary fiber and/or complex carbohydrates can promote saccharolytic fermentation, which can yield anti-inflammatory and antiproliferative SCFAs such as butyrate. Red meat can generate inflammatory and genotoxic metabolites by promoting proteolytic fermentation, hydrogen sulfide production from the sulfur-rich amino acid content of red meat, and expose colonic mucosa to carcinogenic constituents.

Dietary fiber intake can promote a healthy gut microbiome, which in turn can enhance SCFA (e.g., butyrate, acetate, propionate) production Enhanced SCFA production can result in, for example, reduced food intake, increased energy levels, better colon health, promote healthy gut intestinal barrier, reduce colon content transit time and exposure to carcinogens, cancer cell cycle arrest and apoptosis, inhibition of cancer cell migration and invasion, inhibition of early colon lesion, inhibition of adenoma formation, inhibition of colon adenoma, inhibition of tumor progression, and inhibition of colon carcinoma.

In some embodiments, the disorder is a vaginal condition. Non-limiting examples of vaginal conditions, include, but are not limited to vaginosis, bacterial vaginosis, Viral vaginosis, Vulvovaginitis, Yeast infection, preterm labor, Fertility-associated conditions (e.g., low fertility), *Trichomonas*, vulvar vestibulitis, and Vulvodynia.

In some embodiments, the compositions disclosed herein, are used after an individual has performed vaginal douching. In some embodiments, the individual has vulvodynia.

In some embodiments, the disorder is a dental condition. Non-limiting examples of dental conditions, include, but are not limited to dental cavities and halitosis.

In some embodiments, the disorder is a pregnancy-related condition. Non-limiting examples of pregnancy-related conditions, include, but are not limited to preterm delivery, preterm labor, obesity during pregnancy, and gestational diabetes.

In some embodiments, the compositions disclosed herein are administered to a pregnant woman carrying an infant to be born via C-section. In some embodiments, the compositions disclosed herein are administered to an infant born via C-section.

A disorder can be, for example, multiple sclerosis, *Clostridium difficile* infection, genitourinary disorders, oral thrush, diabetic foot ulcers, bacteremia, infantile colic, urinary tract infection, radiation enteropathy, infant formula feeding, appendicitis, atopic disease, ageing, age-related disorder, premature aging disorder, fasting, comorbidities, metastasis, a chemotherapy or radiotherapy-induced condition, and sleep disorders. In some embodiments, a disorder is multiple sclerosis.

Methods and compositions of the disclosure can modulate and/or restore SCFA production (e.g., butyrate production) in a subject. For example, the SCFA (e.g., butyrate) production can be increased in a subject. The butyrate production can be increased, for example, by at least about: 0.01%, 0.02%, 0.03%, 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1%, 1.5%, 2%, 2.5%, 5%, 10%, 15%, 20%, 25%, 30%, 35%, 40%, 45%, 50%, 60%, 70%, 80%, 90%, or 100% in a subject by a composition of the disclosure. The butyrate production can be decreased, for example, by at least about: 0.01%, 0.02%, 0.03%, 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1%, 1.5%, 2%, 2.5%, 5%, 10%, 15%, 20%, 25%, 30%, 35%, 40%, 45%, 50%, 60%, 70%, 80%, 90%, or 100%.

Methods and compositions of the disclosure can be used to modulate the weight of a subject. The weight can be increased or decreased. A subject can lose or gain at least about: 0.01%, 0.02%, 0.03%, 0.04%, 0.05%, 0.06%, 0.07%, 0.08%, 0.09%, 0.1%, 0.2%, 0.3%, 0.4%, 0.5%, 0.6%, 0.7%, 0.8%, 0.9%, 1%, 1.5%, 2%, 2.5%, 5%, 10%, 15%, 20%, 25%, 30%, 35%, 40%, 45%, 50% of the body weight.

Figure 2:
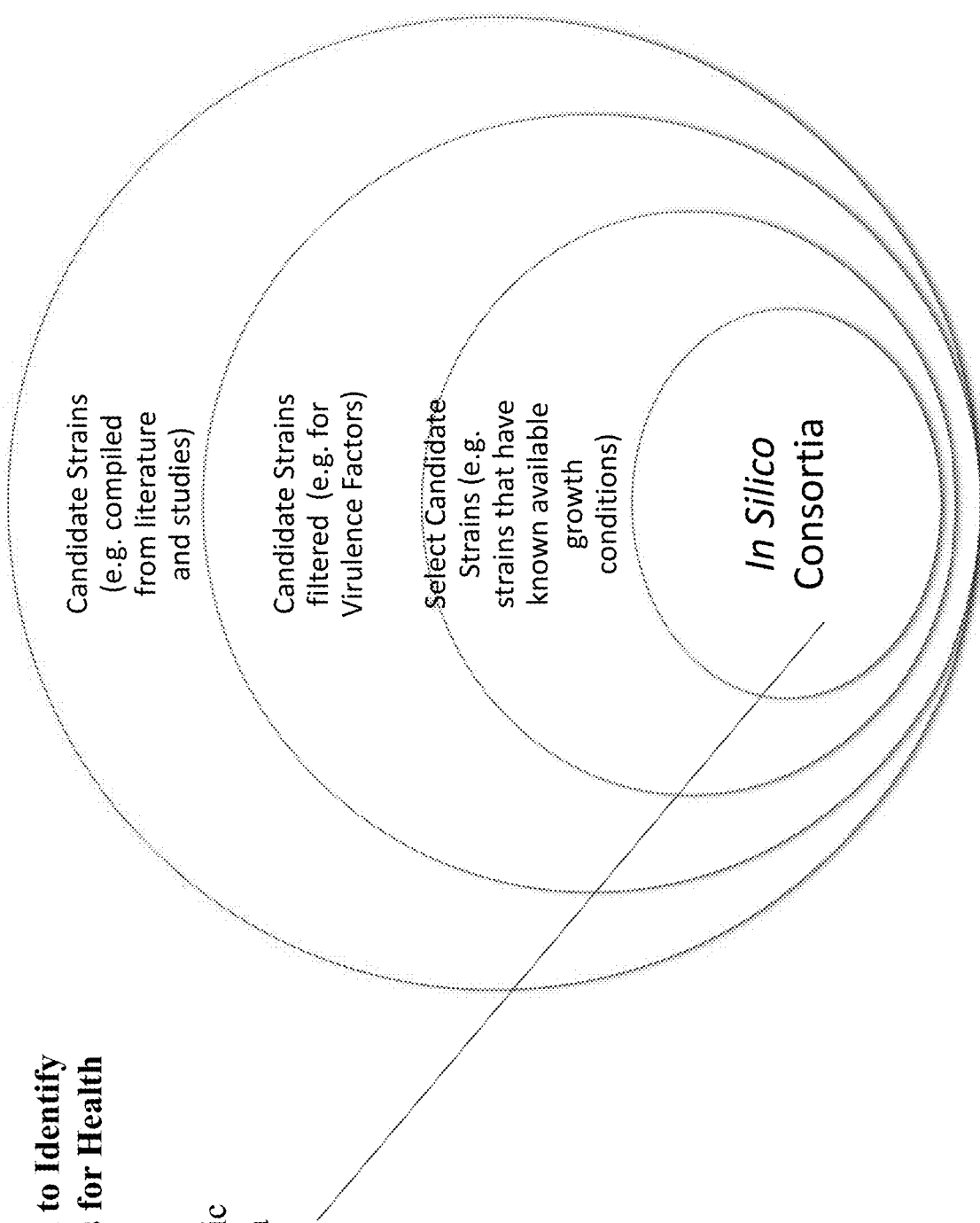
FIG. 2 depicts an exemplary process used to identify strains related to a health condition such as to identify therapeutic consortia.

FIG. 2 depicts an illustrative method to identify microorganism strains for use in the treatment of a health condition. A multi-tiered approach can be used to identify one or more microorganism strains for use as a therapeutic. Candidate strains can be found in scientific literature and studies. Candidate strains can be found by analyzing healthy and unhealthy hosts. Candidate strains can be filtered and/or selected for the ability to be administered to a patient (e.g. biosafety level, availability to be manufactured, growth conditions).

A therapeutic or strain consortia can comprise one or more microorganisms selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus* bifidus, Lactobacillus johnsonii, Akkermansia, Bifidobacteria, Clostridia, Eubacteria, Verrucomicrobia, Firmicutes. vinegar-producing bacteria, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof.

A therapeutic or strain consortia can comprise microorganisms from a phylum selected from the group consisting of: Actinobacteria, Bacteroidetes, Cyanobacteria, Firmicutes, Fusobacteria, Proteobacteria, Spirochaetes, Tenericutes, Verrucomicrobia, and any combination thereof.

A therapeutic or strain consortia can comprise microorganisms from a family selected from the group consisting of: Alcaligenaceae, Bifidobacteriaceae, Bacteroidaceae, Clostridiaceae, Coriobacteriaceae, Enterobacteriaceae, Enterococcaceae, Erysipelotricaceae, Eubacteriaceae, Incertae-Cedis-XIII, Incertae-Sedis-XIV, Lachnospiraceae, Lactobacillaceae, Pasturellaceae, Peptostreptococcaceae, Porphyromonadaceae, Prevotellaceae, Rikenellaceae, Ruminococcaceae, Streptococcaceae, Veillonellaceae, Verrucomicrobiaceae, and any combination thereof.

A therapeutic or strain consortia can comprise microorganisms from a genus selected from the group consisting of: Akkermansia, Clostridium, Eubacterium, Bifidobacterium, Faecalibacterium, and any combination thereof.

A therapeutic or strain consortia can comprise one or more microorganisms with at least about: 70%, 75%, 80%, 85%, 87%, 90%, 91%, 92%, 93%, 94%, 95%, 96%, 97%, 98%, 99%, 99.5%, or 100% sequence identity to the rRNA (e.g. 16SrRNA and/or 23S rRNA) of a microorganism selected from the group consisting of: Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Akkermansia, Bifidobacteria, Clostridia, Eubacteria, Verrucomicrobia, Firmicutes. vinegar-producing bacteria, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof.

A composition of the disclosure can comprise a therapeutically-effective amount of a population of isolated and purified microbes, wherein the population of isolated and purified microbes comprises one or more microbes with a rRNA (e.g., 16SrRNA and/or 23S rRNA) sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence from a microbe selected from the group consisting of: Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Akkermansia, Bifidobacteria, Clostridia, Eubacteria, Verrucomicrobia, Firmicutes. vinegar-producing bacteria, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus, and any combination thereof.

In some embodiments, provided are pharmaceutical compositions to treat a disorder comprising a therapeutically-effective amount of a population of isolated and purified microbes, wherein the population of isolated and purified microbes comprises one or more microbes with a rRNA (e.g., 16SrRNA and/or 23S rRNA) sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence from a microbe selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Lactobacillus johnsonii, Akkermansia,* Bifidobacteria, Clostridia, Eubacteria, Verrucomicrobia, Firmicutes. vinegar-producing bacteria, *Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus,* and any combination thereof.

In one embodiment, a pharmaceutical composition comprises a therapeutically-effective amount of an isolated and/or purified microbe with a rRNA (e.g., 16S rRNA and/or 23 S rRNA) sequence comprising at least about: 85%, 87%, 90%, 92%, 95%, 96%, 97%, 98%, 99%, 99.5%, or 100% sequence identity to a rRNA sequence from a *Lactobacillus* species.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from an *Akkermansia*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from a *Bifidobacterium*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from a *Clostridium*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from a *Eubacterium*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from a *Verrucomicrobium*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from a *Firmicute*.

In some embodiments, provided are pharmaceutical microbial compositions comprising a therapeutically-effective amount of a population of isolated and purified microbes, wherein the population of isolated and purified microbes comprises one or more microbes with a rRNA (e.g., 16SrRNA and/or 23S rRNA) sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence from a microbe selected from the group consisting of: *Lactobacillus reuteri* (e.g., *Lactobacillus reuteri* RC-14, *Lactobacillus reuteri* L22), *Streptococcus mutans, Stenotrophomonas nitritireducens,* and any combination thereof.

In some embodiments, provided are pharmaceutical microbial compositions comprising a therapeutically-effective amount of a population of isolated and purified microbes, wherein the population of isolated and purified microbes comprises one or more microbes with a rRNA (e.g., 16SrRNA and/or 23S rRNA) sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence from a microbe selected from the group consisting of: *Lactobacillus rhamnosus, Faecalibacterium prausnitzii, Oscillospira guilliermondii, Clostridium orbiscindens, Clostridium colinum, Clostridium aminophilum, Ruminococcus obeum,* and any combination thereof.

In some embodiments, provided are pharmaceutical microbial compositions comprising a therapeutically-effective amount of a population of isolated and purified microbes, wherein the population of isolated and purified microbes comprises one or more microbes with a rRNA (e.g., 16SrRNA and/or 23S rRNA) sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence from a microbe selected from the group consisting of: *Akkermansia mucimphila, Bifidobacterium adolescentis, Bifidobacterium infantis, Bifidobacterium longum, Clostridium beijerinckii, Clostridium butyricum, Clostridium indolis, Eubacterium hallii,* and any combination thereof.

In some embodiments, provided are pharmaceutical microbial compositions comprising a therapeutically-effective amount of a population of isolated and purified microbes, wherein the population of isolated and purified microbes comprises one or more microbes with a rRNA (e.g., 16SrRNA and/or 23S rRNA) sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence from a microbe selected from the group consisting of: *Akkermansia mucimphila, Bifidobacterium adolescentis, Bifidobacterium infantis, Bifidobacterium longum, Clostridium beijerinckii, Clostridium butyricum, Clostridium indolis, Eubacterium hallii, Faecalibacterium prausnitzii*, and any combination thereof.

In some embodiments, provided are pharmaceutical microbial compositions comprising a therapeutically-effective amount of a population of isolated and purified microbes, wherein the population of isolated and purified microbes comprises a microbe with a rRNA (e.g., 16SrRNA and/or 23S rRNA) sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence from a microbe selected from the group consisting of: *Akkermansia mucimphila, Clostridium beijerinckii, Clostridium butyricum, Eubacterium hallii*, and any combination thereof.

In some embodiments, provided are pharmaceutical microbial compositions comprising a therapeutically-effective amount of a population of isolated and purified microbes, wherein the population of isolated and purified microbes comprises a microbe with a rRNA (e.g., 16SrRNA and/or 23S rRNA) sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence from a microbe selected from the group consisting of: *Clostridium beijerinckii, Clostridium butyricum, Bifidobacterium infantis*, or any combination thereof.

In some embodiments, provided are pharmaceutical microbial compositions comprising a therapeutically-effective amount of a population of isolated and purified microbes, wherein the population of isolated and purified microbes comprises a microbe with a rRNA (e.g., 16SrRNA and/or 23S rRNA) sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence from a microbe selected from the group consisting of: *Clostridium beijerinckii, Clostridium butyricum, Bifidobacterium infantis, Eubacterium hallii, Akkermansia mucimphila*, or any combination thereof.

A composition can comprise a population of isolated and purified microbes selected from the group consisting of *Clostridium beijerinckii, Clostridium butyricum, Bifidobacterium infantis, Eubacterium hallii, Akkermansia mucimphila*, and any combination thereof.

In some embodiments, provided are pharmaceutical microbial compositions comprising a therapeutically-effective amount of a population of isolated and purified microbes, wherein said population of isolated and purified microbes comprises at least 2, 3, 4, 5, 6, 7, 8, 9, 10, 11, 12, 13, 14, or 15 different microbial strains or species. The microbial strains can comprise a rRNA sequence comprising at least about: 70%, 75%, 80%, 85%, 87%, 90%, 91%, 92%, 93%, 94%, 95%, 96%, 97%, 98%, 99%, 99.5%, or 100% sequence identity to a rRNA sequence of a microbe selected from the group consisting of: *Akkermansia mucimphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium indolis, Clostridium orbiscindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Akkermansia muciniphila*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Anaerostipes caccae*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Bifidobacterium adolescentis*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Bifidobacterium bifidum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Bifidobacterium infantis*

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Bifidobacterium longum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Butyrivibrio fibrisolvens*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium acetobutylicum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium aminophilum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium beijerinckii*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium butyricum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium colinum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium coccoides*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium indolis*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium nexile*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium orbiscindens*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium propionicum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium xylanolyticum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Enterococcus faecium*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Eubacterium hallii*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Eubacterium rectale*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Faecalibacterium prausnitzii*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Fibrobacter succinogenes*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus acidophilus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus brevis*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus bulgaricus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus casei*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus caucasicus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus fermentum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus helveticus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus lactis*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus plantarum*

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus reuteri*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus rhamnosus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Oscillospira guilliermondii*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Roseburia cecicola*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Roseburia inulinivorans*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Ruminococcus flavefaciens*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Ruminococcus gnavus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Ruminococcus obeum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Stenotrophomonas nitritireducens*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Streptococcus cremoris*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Streptococcus* faecium.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Streptococcus infantis*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Streptococcus mutans*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Streptococcus thermophilus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Anaerofustis stercorihominis*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Anaerostipes hadrus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Anaerotruncus colihominis*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium sporogenes*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Clostridium tetani*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Coprococcus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Coprococcus eutactus*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Eubacterium cylindroides*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Eubacterium dolichum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Eubacterium ventriosum*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Roseburia faeccis*

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Roseburia hominis*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Roseburia intestinalis*.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from a vinegar-producing microbe.

In one embodiment, a pharmaceutical composition comprises a therapeutically-effective amount of an isolated and/or purified microbe with a rRNA (e.g., 16S rRNA and/or 23S rRNA) sequence comprising at least about: 85%, 87%, 90%, 92%, 95%, 96%, 97%, 98%, 99%, 99.5%, or 100% sequence identity to a rRNA sequence from *Lactobacillus bifidus*.

In one embodiment, a pharmaceutical composition comprises a therapeutically-effective amount of an isolated and/or purified microbe with a rRNA (e.g., 16S rRNA and/or 23 S rRNA) sequence comprising at least about: 85%, 87%, 90%, 92%, 95%, 96%, 97%, 98%, 99%, 99.5%, or 100% sequence identity to a rRNA sequence from *Lactobacillus johnsonii*

A therapeutic composition can comprise at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 45, or at least 50, or at least 75, or at least 100 different microbes (e.g, strains, species, phyla, classes, orders, families, or genuses of microbes). A therapeutic composition can comprise at most 1, at most 2, at most 3, at most 4, at most 5, at most 6, at most 7, at most 8, at most 9, at most 10, at most 11, at most 12, at most 13, at most 14, at most 15, at most 16, at most 17, at most 18, at most 19, at most 20, at most 21, at most 22, at most 23, at most 24, at most 25, at most 26, at most 27, at most 28, at most 29, at most 30, at most 31, at most 32, at most 33, at most 34, at most 35, at most 36, at most 37, at most 38, at most 39, at most 40, at most 45, or at most 50, or at most 75, or at most 100 different microbes (e.g., strains, species, phyla, classes, orders, families, or genuses of microbes).

In some embodiments, combining one or more microbes in a therapeutic composition or consortia increases or maintains the stability of the microbes in the composition compared with the stability of the microbes alone. A therapeutic consortium of microbes can provide a synergistic stability compared with the individual strains.

In some embodiments, combining one or more microbes in a therapeutic composition or consortia can provide a synergistic effect when administered to the individual. For example, administration of a first microbe may be beneficial to a subject and administration of a second microbe may be beneficial to a subject but when the two microbes are administered together to a subject, the benefit is greater than the either benefit alone.

Different types of microbes in a therapeutic composition can be present in the same amount or in different amounts. For example, the ratio of two bacteria in a therapeutic composition can be about 1:1, 1:2, 1:5, 1:10, 1:25, 1:50, 1:100, 1:1000, 1:10,000, or 1:100,000.

Compositions of the disclosure can include one or more *Lactobacillus* species. Non-limiting examples of *lactobacillus* species include, for example, *L. acetotolerans*, *L. acidifarinae*, *L. acidipiscis*, *L. acidophilus*, *L. agilis*, *L. algidus*, *L. alimentarius*, *L. amylolyticus*, *L. amylophilus*, *L. amylotrophicus*, *L. amylovorus*, *L. animalis*, *L. antri*, *L. apodemi*,

*L. aviarius, L. bifermentans, L. bifidus, L. brevis, L. buchneri, L. bulgaricus, L. camelliae, L. casei, L. catenaformis, L. ceti, L. coleohominis, L. collinoides, L. composti, L. concavus, L. coryniformis, L. crispatus, L. crustorum, L. curvatus, L. delbrueckii* subsp. *bulgaricus, L. delbrueckii* subsp. *delbrueckii, L. delbrueckii* subsp. *lactis, L. dextrinicus, L. diolivorans, L. equi, L. equigenerosi, L. farraginis, L. farciminis, L. fermentum, L. fornicalis, L. fructivorans, L. frumenti, L. fuchuensis, L. gallinarum, L. gasseri, L. gastricus, L. ghanensis, L. graminis, L. hammesii, L. hamsteri, L. harbinensis, L. hayakitensis, L. helveticus, L. hilgardii, L. homohiochii, L. iners, L. ingluviei, L. intestinalis, L. jensenii, L. johnsonii, L. kalixensis, L. kefiranofaciens, L. kefiri, L. kimchii, L. kitasatonis, L. kunkeei, L. leichmannii, L. lindneri, L. malefermentans, L. mall, L. manihotivorans, L. mindensis, L. mucosae, L. murinus, L. nagelii, L. namurensis, L. nantensis, L. oligofermentans, L. oris, L. panis, L. pantheris, L. parabrevis, L. parabuchneri, L. paracasei, L. paracollinoides, L. parafarraginis, L. parakefiri, L. paralimentarius, L. paraplantarum, L. pentosus, L. perolens, L. plantarum, L. pontis, L. protectus, L. psittaci, L. rennini, L. reuteri, L. rhamnosus, L. rimae, L. rogosae, L. rossiae, L. ruminis, L. saerimneri, L. sakei, L. salivarius, L. sanfranciscensis, L. satsumensis, L. secaliphilus, L. sharpeae, L. siliginis, L. spicheri, L. suebicus, L. thailandensis, L. ultunensis, L. vaccinostercus, L. vaginalis, L. versmoldensis, L. vini, L. vitulinus, L. zeae,* and *L. zymae.*

The compositions can include metabolites for example, to assist in the initial efficacy of the therapeutic before the microbes can produce their own metabolites. Metabolites can include short-chain fatty acids, which can be a subgroup of fatty acids with 6 or less carbons in their aliphatic tails, for example, acetate, propionate, isobutyrate, isovaleric acid, 3-methylbutanoic acid, valeric acid, pentanoic acid, delphinic acid, isopentanoic acid, and butyrate.

The composition can include one or more prebiotics. In one non-limiting example, the prebiotic is an oligosaccharide.

In some embodiments, the prebiotic and probiotic consortia are chosen to create an entirely self-sufficient system that does not require any external input. A combination of probiotics and prebiotics can provide a complete system for producing amino acids, polyphenols, vitamins, and other compounds of nutritive value in a subject. A subject can be treated with a combination of SCFA-producing probiotics and prebiotics comprising dietary fiber and other agents required for the activity of the SCFA-producing probiotics. In this manner, the prebiotic and probiotic form a self-sufficient system, wherein the probiotic converts the prebiotic dietary fiber to SCFAs (e.g., butyrate, acetate, propionate), which can trigger downstream signaling for controlling a disorder in the subject.

In some embodiments, a pharmaceutical composition comprises a therapeutically-effective amount of an isolated and/or purified microbe with a butyrate kinase sequence (e.g., amino acid or nucleotide sequence) comprising at least about: 85%, 87%, 90%, 92%, 95%, 96%, 97%, 98%, 99%, 99.5%, or 100% sequence identity to a butyrate kinase of a microbe disclosed herein. The sequence (e.g., amino acid or nucleotide sequence) can comprise at least about: 85%, 87%, 90%, 92%, 95%, 96%, 97%, 98%, 99%, 99.5%, or 100% sequence identity to, for example, butyrate kinase (e.g., EC 2.7.2.7; MetaCyc Reaction IDR11-RXN).

In some embodiments, a pharmaceutical composition comprises a therapeutically-effective amount of an isolated and/or purified microbe with a butyrate-coenzyme A sequence (e.g., amino acid or nucleotide sequence) comprising at least about: 85%, 87%, 90%, 92%, 95%, 96%, 97%, 98%, 99%, 99.5%, or 100% sequence identity to the butyrate-coenzyme A of a microbe disclosed herein.

In some embodiments, a pharmaceutical composition comprises a therapeutically-effective amount of an isolated and/or purified microbe with a butyrate-coenzyme A transferase or butyryl-Coenzyme A:acetoacetate CoenzymeA transferase sequence comprising at least about: 85%, 87%, 90%, 92%, 95%, 96%, 97%, 98%, 99%, 99.5%, or 100% sequence identity to the butyrate-coenzyme A transferase of a microbe disclosed herein. The sequence (e.g., amino acid or nucleotide sequence) can comprise at least about: 85%, 87%, 90%, 92%, 95%, 96%, 97%, 98%, 99%, 99.5%, or 100% sequence identity to, for example, butyryl-Coenzyme A:acetoacetate CoenzymeA transferase (e.g., EC 2.8.3.9; MetaCyc Reaction ID 2.8.3.9-RXN).

In some embodiments, a pharmaceutical composition comprises a therapeutically-effective amount of an isolated and/or purified microbe with a acetate Coenzyme A transferase sequence comprising at least about: 85%, 87%, 90%, 92%, 95%, 96%, 97%, 98%, 99%, 99.5%, or 100% sequence identity to acetate Coenzyme A transferase of a microbe disclosed herein. The sequence (e.g., amino acid or nucleotide sequence) can comprise at least about: 85%, 87%, 90%, 92%, 95%, 96%, 97%, 98%, 99%, 99.5%, or 100% sequence identity to, for example, acetate Coenzyme A transferase (e.g., EC 2.8.3.1/2.8.3.8; MetaCyc Reaction ID BUTYRATE-KINASE-RXN)

In some embodiments, a pharmaceutical composition comprises a therapeutically-effective amount of an isolated and purified microbe comprising a protein involved in a butyrate-pathway (e.g, butyrate producing enzyme).

Non-limiting examples of a phylum of a microbe that can be present in a composition include Bacteroidetes, Cyanobacteria, Fusobacteria, Proteobacteria, Spirochaetes, Tenericutes, Verrucomicrobia, *Firmicute*, and Actinobacteria.

Non-limiting examples of a family of a microbe that can be present in a composition include Alcaligenaceae, Bifidobacteriaceae, Bacteroidaceae, Clostridiaceae, Coriobacteriaceae, Enterobacteriaceae, Enterococcaceae, Erysipelotricaceae, Eubacteriaceae, Incertae-Cedis-XIII, Incertae-Sedis-XIV, Lachnospiraceae, Lactobacillaceae, Pasturellaceae, Peptostreptococcaceae, Porphyromonadaceae, Prevotellaceae, Rikenellaceae, Ruminococcaceae, Streptococcaceae, Veillonellaceae, Verrucomicrobiaceae.

Non-limiting examples of a genus of a microbe that can be present in a composition include *Akkermansia, Clostridium, Eubacterium, Bifidobacterium,* and *Faecalibacterium.* A microbe can be an obligate anaerobe. A microbe can be an obligate anaerobe that is oxygen stable.

Pharmaceutical Compositions

Provided herein are compositions that may be administered as therapeutics and/or cosmetics. One or more microorganisms described herein can be used to create a pharmaceutical formulation comprising an effective amount of the composition for treating a subject. The microorganisms can be in any suitable formulation. Some non-limiting examples can include topical, capsule, pill, enema, liquid, injection, and the like. In some embodiments, the one or more strains disclosed herein may be included in a food or beverage product, cosmetic, or nutritional supplement.

A pharmaceutical composition of the disclosure can be a combination of any microorganisms described herein with other components, such as carriers, stabilizers, diluents, dispersing agents, suspending agents, thickening agents, and/or excipients. The pharmaceutical composition can facilitate administration of the microorganisms to a subject.

Pharmaceutical compositions can be administered in therapeutically-effective amounts as pharmaceutical compositions by various forms and routes including, for example, oral, topical, rectal, transdermal, mucosal, and vaginal administration. A combination of administration routes can be utilized. The pharmaceutical composition can be administered as therapeutics and/or cosmetics.

The composition can be administered by a suitable method to any suitable body part or body surface of the subject, for example, that shows a correlation with a disorder.

In some embodiments, the composition is administered to a part of the gastrointestinal tract of a subject. Non-limiting examples of parts of gastrointestinal tract include oral cavity, mouth, esophagus, stomach, duodenum, small *intestine* regions including duodenum, jejunum, ileum, and large *intestine* regions including cecum, colon, rectum, and anal canal. In some embodiments, the composition is formulated for delivery to the ileum and/or colon regions of the gastrointestinal tract. In some embodiments, the composition is administered to multiple body parts or surfaces, for example, skin and gut.

The composition can include one or more active ingredients. Active ingredients can be selected from the group consisting of: metabolites, bacteriocins, enzymes, anti-microbial peptides, antibiotics, prebiotics, probiotics, glycans (as decoys that would limit specific bacterial/viral binding to the intestinal wall), bacteriophages, and microorganisms.

In some embodiments, the formulation comprises a prebiotic. In some embodiments, the prebiotic is inulin. In some embodiments, the prebiotic is a fiber. The prebiotic, for example, inulin can serve as an energy source for the microbial formulation.

A microbial composition of the disclosure can further comprise: inulin, sucrose, trehalose, glycerin, maltodextrin, hydroxypropyl methylcellulose, or a combination thereof. A microbial composition of the disclosure can further comprise at least one of inulin, sucrose, trehalose, glycerin, maltodextrin, hydroxypropyl methylcellulose.

The compositions can be administered topically. The compositions can be formulated as a topically administrable composition, such as solutions, suspensions, lotions, gels, pastes, medicated sticks, balms, creams, ointments, liquid, wrap, adhesive, or patch. The compositions can contain solubilizers, stabilizers, tonicity enhancing agents, buffers and preservatives.

The compositions can be administered orally, for example, through a capsule, pill, powder, tablet, gel, or liquid, designed to release the composition in the gastrointestinal tract.

In some embodiments, administration of a formulation occurs by injection, for example, for a formulation comprising, for example, butyrate, propionate, acetate, and short-chain fatty acids. In some embodiments, administration of a formulation occurs by a suppository and/or by enema. In some embodiments, a combination of administration routes is utilized.

Microbial compositions can be formulated as a dietary supplement. Microbial compositions can be incorporated with vitamin supplements. Microbial compositions can be formulated in a chewable form such as a probiotic gummy. Microbial compositions can be incorporated into a form of food and/or drink. Non-limiting examples of food and drinks where the microbial compositions can be incorporated include, for example, bars, shakes, juices, infant formula, beverages, frozen food products, fermented food products, and cultured dairy products such as yogurt, yogurt drink, cheese, *acidophilus* drinks, and kefir.

A formulation of the disclosure can be administered as part of a fecal transplant process. A formulation can be administered to a subject by a tube, for example, nasogastric tube, nasojejunal tube, nasoduodenal tube, oral gastric tube, oral jejunal tube, or oral duodenal tube. A formulation can be administered to a subject by colonoscopy, endoscopy, sigmoidoscopy, and/or enema.

In some embodiments, the microbial composition is formulated such that the one or more microbes can replicate once they are delivered to the target habitat (e.g. gut). In some embodiments, the microbial composition is formulated such that the one or more microbes are viable in the target habitat (e.g., gut). In one non-limiting example, the microbial composition is formulated in a pill, such that the pill has a shelf life of at least about: 1, 2, 3, 4, 5, 6, 7, 8, 9, 10, 11, or 12 months. In another non-limiting example, the storage of the microbial composition is formulated so that the microbes can reproduce in the target habitat, e.g, gut. In some embodiments, other components may be added to aid in the shelf life of the microbial composition. In some embodiments, one or more microbes may be formulated in a manner that it is able to survive in a non-natural environment. For example, a microbe that is native to the gut may not survive in an oxygen-rich environment. To overcome this limitation, the microbe may be formulated in a pill that can reduce or eliminate the exposure to oxygen. Other strategies to enhance the shelf-life of microbes may include other microbes (e.g. if the bacterial consortia comprises a composition whereby one or more strains is helpful for the survival of one or more strains).

In some embodiments, a microbial composition is lyophilized (e.g., freeze-dried) and formulated as a powder, tablet, enteric-coated capsule (e.g. for delivery to the gut such as ileum and/or colon region), or pill that can be administered to a subject by any suitable route. The lyophilized formulation can be mixed with a saline or other solution prior to administration.

In some embodiments, a microbial composition is formulated for oral administration, for example, as an enteric-coated capsule or pill, for delivery of the contents of the formulation to the ileum and/or colon regions of a subject.

In some embodiments, the microbial composition is formulated for oral administration. In some embodiments, the microbial composition is formulated as an enteric-coated pill or capsule for oral administration. In some embodiments, the microbial composition is formulated for delivery of the microbes to the ileum region of a subject. In some embodiments, the microbial composition is formulated for delivery of the microbes to the colon region (e.g. upper colon) of a subject. In some embodiments, the microbial composition is formulated for delivery of the microbes to the ileum and colon (e.g., upper colon) regions of a subject.

An enteric-coating can protect the contents of a formulation, for example, oral formulation such as pill or capsule, from the acidity of the stomach. An enteric-coating can provide delivery to the ileum and/or upper colon regions. A microbial composition can be formulated such that the contents of the composition may not be released in a body part other than the gut region, for example, ileum and/or colon region of the subject. Non-limiting examples of enteric coatings include pH sensitive polymers (e.g., eudragit FS30D), methyl acrylate-methacrylic acid copolymers, cellulose acetate succinate, hydroxy propyl methyl cellulose phthalate, hydroxy propyl methyl cellulose acetate succinate (e.g., hypromellose acetate succinate), polyvinyl acetate phthalate (PVAP), methyl methacrylate-methacrylic acid copolymers, shellac, cellulose acetate trimellitate, sodium alginate, zein, other polymers, fatty acids, waxes, shellac, plastics, and plant fibers. In some embodiments, the enteric coating is formed by a pH sensitive polymer. In some embodiments, the enteric coating is formed by eudragit FS30D.

The enteric coating can be designed to dissolve at any suitable pH. In some embodiments, the enteric coating is designed to dissolve at a pH greater than from about pH 6.5 to about pH 7.0. In some embodiments, the enteric coating is designed to dissolve at a pH greater than about pH 6.5. In some embodiments, the enteric coating is designed to dissolve at a pH greater than about pH 7.0. The enteric coating can be designed to dissolve at a pH greater than about: 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, or 7.5 pH units. The enteric coating can be designed to dissolve in the gut, for example, ileum and/or colon region. The enteric coating can be designed to not dissolve in the stomach.

The formulation can be stored in cold storage, for example, at a temperature of about −80° C., about −20° C., about −4° C., or about 4° C. Compositions provided herein can be stored at any suitable temperature. The storage temperature can be, for example, about 0° C., about 1° C., about 2° C., about 3° C., about 4° C., about 5° C., about 6° C., about 7° C., about 8° C., about 9° C., about 10° C., about 12° C., about 14° C., about 16° C., about 20° C., about 22° C., or about 25° C. In some embodiments, the storage temperature is between about 2° C. to about 8° C. Storage of microbial compositions at low temperatures, for example from about 2° C. to about 8° C., can keep the microbes alive and increase the efficiency of the composition. The cooling conditions can also provide soothing relief to patients. Storage at freezing temperature, below 0° C., with a cryoprotectant can further extend stability.

A composition of the disclosure can be at any suitable pH. The pH of the composition can range from about 3 to about 12. The pH of the composition can be, for example, from about 3 to about 4, from about 4 to about 5, from about 5 to about 6, from about 6 to about 7, from about 7 to about 8, from about 8 to about 9, from about 9 to about 10, from about 10 to about 11, or from about 11 to about 12 pH units. The pH of the composition can be, for example, about 3, about 4, about 5, about 6, about 7, about 8, about 9, about 10, about 11, or about 12 pH units. The pH of the composition can be, for example, at least 3, at least 4, at least 5, at least 6, at least 7, at least 8, at least 9, at least 10, at least 11 or at least 12 pH units. The pH of the composition can be, for example, at most 3, at most 4, at most 5, at most 6, at most 7, at most 8, at most 9, at most 10, at most 11, or at most 12 pH units. The pH of the composition can be, for example, about 2.0, about 2.1, about 2.2, about 2.3, about 2.4, about 2.5, about 2.6, about 2.7, about 2.8, about 2.9, about 3.0, about 3.1, about 3.2, about 3.3, about 3.4, about 3.5, about 3.6, about 3.7, about 3.8, about 3.9, about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, about 6.0, about 6.1, about 6.2, about 6.3, about 6.4, about 6.5, about 6.6, about 6.7, about 6.8, about 6.9, or about 7.0 pH units. If the pH is outside the range desired by the formulator, the pH can be adjusted by using sufficient pharmaceutically-acceptable acids and bases. In some embodiments, the pH of the composition is from about 4 to about 6 pH units. In some embodiments, the pH of the composition is about 5.5 pH units.

Microbial compositions can be formulated as a dietary supplement. Microbial compositions can be incorporated with vitamin supplements. Microbial compositions can be formulated in a chewable form such as a probiotic gummy. Microbial compositions can be incorporated into a form of food and/or drink. Non-limiting examples of food and drinks where the microbial compositions can be incorporated include, for example, bars, shakes, juices, infant formula, beverages, frozen food products, fermented food products, and cultured dairy products such as yogurt, yogurt drink, cheese, *acidophilus* drinks, and kefir.

A composition of the disclosure can be administered as part of a fecal transplant process. A composition can be administered to a subject by a tube, for example, nasogastric tube, nasojejunal tube, nasoduodenal tube, oral gastric tube, oral jejunal tube, or oral duodenal tube. A composition can be administered to a subject by colonoscopy, endoscopy, sigmoidoscopy, and/or enema.

In some embodiments, a microbial composition is lyophilized (freeze-dried) and formulated as a powder, tablet, enteric-coated capsule, or pill that can be administered to a subject by any suitable route, for example, oral, enema, suppository, injection. The lyophilized composition can be mixed with a saline or other solution prior to administration.

In some embodiments, the administration of a composition of the disclosure can be preceded by, for example, colon cleansing methods such as colon irrigation/hydrotherapy, enema, administration of laxatives, dietary supplements, dietary fiber, enzymes, and magnesium.

In some embodiments, the microbes are formulated as a population of spores. Spore-containing compositions can be administered by any suitable route described herein. Orally administered spore-containing compositions can survive the low pH environment of the stomach. The amount of spores employed can be, for example, from about 1% w/w to about 99% w/w of the entire composition.

Compositions provided herein can include the addition of one or more agents to the therapeutics or cosmetics in order to enhance stability and/or survival of the microbial composition. Non-limiting example of stabilizing agents include genetic elements, glycerin, ascorbic acid, skim milk, lactose, tween, alginate, xanthan gum, carrageenan gum, mannitol, palm oil, and poly-L-lysine (POPL).

In some embodiments, a composition comprises recombinant microbes or microbes that have been genetically modified. In some embodiments, the composition comprises microbes that can be regulated, for example, a microbe comprising an operon to control microbial growth.

A composition can be customized for a subject. A custom composition can comprise, for example, a prebiotic, a probiotic, an antibiotic, or a combination of active agents described herein. Data specific to the subject comprising for example age, gender, and weight can be combined with an analysis result to provide a therapeutic agent customized to the subject. For example, a subject's microbiome found to be low in a specific microbe relative to a sub-population of healthy subjects matched for age and gender can be provided with a therapeutic and/or cosmetic composition comprising the specific microbe to match that of the sub-population of healthy subjects having the same age and gender as the subject.

In some embodiments, a composition is administered before, during, and/or after treatment with an antimicrobial agent such as an antibiotic. For example, the composition can be administered at least 1 hour, 2 hours, 5 hours, 12 hours, 1 day, 3 days, 1 week, 2 weeks, 1 month, 6 months, or 1 year before and/or after treatment with an antibiotic.

The composition can be administered at most 1 hour, 2 hours, 5 hours, 12 hours, 1 day, 3 days, 1 week, 2 weeks, 1 month, 6 months, or 1 year before and/or after treatment with an antibiotic.

In some embodiments, the formulation is administered after treatment with an antibiotic. For example, the formulation can be administered after the entire antibiotic regimen or course is complete. In some embodiments, the formulation is administered concurrently with an antibiotic.

In some embodiments, a formulation is administered before, during, and/or after food intake by a subject. In some embodiments, the formulation is administered with food intake by the subject. In some embodiments, the formulation is administered with (e.g., simultaneously) with food intake.

In some embodiments, the formulation is administered before food intake by a subject. In some embodiments, the formulation is more effective or potent at treating a microbial condition when administered before food intake. For example, the formulation can be administered about 1 minute, about 2 minutes, about 3 minutes, about 5 minutes, about 10 minutes, about 15 minutes, about 30 minutes, about 45 minutes, about 1 hour, about 2 hours, about 3 hours, about 4 hours, about 5 hours, about 6 hours, about 7 hours, about 8 hours, about 9 hours, about 10 hours, about 12 hours, or about 1 day before food intake by a subject. For example, the formulation can be administered at least about 1 minute, about 2 minutes, about 3 minutes, about 5 minutes, about 10 minutes, about 15 minutes, about 30 minutes, about 45 minutes, about 1 hour, about 2 hours, about 3 hours, about 4 hours, about 5 hours, about 6 hours, about 7 hours, about 8 hours, about 9 hours, about 10 hours, about 12 hours, or about 1 day before food intake by a subject. For example, the formulation can be administered at most about 1 minute, about 2 minutes, about 3 minutes, about 5 minutes, about 10 minutes, about 15 minutes, about 30 minutes, about 45 minutes, about 1 hour, about 2 hours, about 3 hours, about 4 hours, about 5 hours, about 6 hours, about 7 hours, about 8 hours, about 9 hours, about 10 hours, about 12 hours, or about 1 day before food intake by a subject.

In some embodiments, the formulation is administered after food intake by the subject. In some embodiments, the formulation is more effective or potent at treating a microbial condition when administered after food intake. For example, the formulation can be administered at least about 1 minute, 2 minutes, 3 minutes, 5 minutes, 10 minutes, 15 minutes, 30 minutes, 45 minutes, 1 hour, 2 hours, 3 hours, 5 hours, 10 hours, 12 hours, or 1 day after food intake by a subject. For example, the formulation can be administered at most about 1 minute, 2 minutes, 3 minutes, 5 minutes, 10 minutes, 15 minutes, 30 minutes, 45 minutes, 1 hour, 2 hours, 3 hours, 5 hours, 10 hours, 12 hours, or 1 day after food intake by a subject.

Formulations provided herein can include those suitable for oral including buccal and sub-lingual, intranasal, topical, transdermal, transdermal patch, pulmonary, vaginal, rectal, suppository, mucosal, systemic, or parenteral including intramuscular, intraarterial, intrathecal, intradermal, intraperitoneal, subcutaneous, and intravenous administration or in a form suitable for administration by aerosolization, inhalation or insufflation.

A therapeutic or cosmetic composition can include carriers and excipients (including but not limited to buffers, carbohydrates, lipids, mannitol, proteins, polypeptides or amino acids such as glycine, antioxidants, bacteriostats, chelating agents, suspending agents, thickening agents and/ or preservatives), metals (e.g., iron, calcium), salts, vitamins, minerals, water, oils including those of petroleum, animal, vegetable or synthetic origin, such as peanut oil, soybean oil, mineral oil, sesame oil and the like, saline solutions, aqueous dextrose and glycerol solutions, flavoring agents, coloring agents, detackifiers and other acceptable additives, adjuvants, or binders, other pharmaceutically acceptable auxiliary substances as required to approximate physiological conditions, such as pH buffering agents, tonicity adjusting agents, emulsifying agents, wetting agents and the like. Examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like.

Non-limiting examples of pharmaceutically-acceptable excipients suitable for use in the disclosure include granulating agents, binding agents, lubricating agents, disintegrating agents, sweetening agents, glidants, anti-adherents, anti-static agents, surfactants, anti-oxidants, gums, coating agents, coloring agents, flavouring agents, dispersion enhancer, disintegrant, coating agents, plasticizers, preservatives, suspending agents, emulsifying agents, plant cellulosic material and spheronization agents, and any combination thereof.

Non-limiting examples of pharmaceutically-acceptable excipients can be found, for example, in *Remington: The Science and Practice of Pharmacy*, Nineteenth Ed (Easton, Pa.: Mack Publishing Company, 1995); Hoover, John E., *Remington's Pharmaceutical Sciences*, Mack Publishing Co., Easton, Pa. 1975; Liberman, H. A. and Lachman, L., Eds., *Pharmaceutical Dosage Forms*, Marcel Decker, New York, N.Y., 1980; and *Pharmaceutical Dosage Forms and Drug Delivery Systems*, Seventh Ed. (Lippincott Williams & Wilkins 1999), each of which is incorporated by reference in its entirety.

A composition can be substantially free of preservatives. In some applications, the composition may contain at least one preservative.

A composition can be encapsulated within a suitable vehicle, for example, a liposome, a microspheres, or a microparticle. Microspheres formed of polymers or proteins can be tailored for passage through the gastrointestinal tract directly into the blood stream. Alternatively, the compound can be incorporated and the microspheres, or composite of microspheres, and implanted for slow release over a period of time ranging from days to months.

A composition can be formulated as a sterile solution or suspension. The therapeutic or cosmetic compositions can be sterilized by conventional techniques or may be sterile filtered. The resulting aqueous solutions may be packaged for use as is, or lyophilized. The lyophilized preparation of the microbial composition can be packaged in a suitable form for oral administration, for example, capsule or pill.

The compositions can be administered topically and can be formulated into a variety of topically administrable compositions, such as solutions, suspensions, lotions, gels, pastes, medicated sticks, balms, creams, and ointments. Such pharmaceutical compositions can contain solubilizers, stabilizers, tonicity enhancing agents, buffers and preservatives.

The compositions can also be formulated in rectal compositions such as enemas, rectal gels, rectal foams, rectal aerosols, suppositories, jelly suppositories, or retention enemas, containing conventional suppository bases such as cocoa butter or other glycerides, as well as synthetic polymers such as polyvinylpyrrolidone, PEG, and the like. In suppository forms of the compositions, a low-melting wax such as a mixture of fatty acid glycerides, optionally in combination with cocoa butter, can be used.

Microbial compositions can be formulated using one or more physiologically-acceptable carriers comprising excipients and auxiliaries, which facilitate processing of the microorganisms into preparations that can be used pharmaceutically. Compositions can be modified depending upon the route of administration chosen. Compositions described herein can be manufactured in a conventional manner, for example, by means of conventional mixing, dissolving, granulating, dragee-making, levigating, encapsulating, entrapping, emulsifying or compression processes.

Pharmaceutical compositions containing microbes described herein can be administered for prophylactic and/or therapeutic treatments. In therapeutic applications, the compositions can be administered to a subject already suffering from a disease or condition, in an amount sufficient to cure or at least partially arrest the symptoms of the disease or condition, or to cure, heal, improve, or ameliorate the condition. Microbial compositions can also be administered to lessen a likelihood of developing, contracting, or worsening a condition. Amounts effective for this use can vary based on the severity and course of the disease or condition, previous therapy, the subject's health status, weight, and response to the drugs, and the judgment of the treating physician.

Multiple therapeutic agents can be administered in any order or simultaneously. If simultaneously, the multiple therapeutic agents can be provided in a single, unified form, or in multiple forms, for example, as multiple separate pills. The composition can be packed together or separately, in a single package or in a plurality of packages. One or all of the therapeutic agents can be given in multiple doses. If not simultaneous, the timing between the multiple doses may vary to as much as about a month.

Compositions described herein can be administered before, during, or after the occurrence of a disease or condition, and the timing of administering the composition can vary. For example, the microbial composition can be used as a prophylactic and can be administered continuously to subjects with a propensity to conditions or diseases in order to lessen a likelihood of the occurrence of the disease or condition. The microbial compositions can be administered to a subject during or as soon as possible after the onset of the symptoms. The administration of the microbial compositions can be initiated within the first 48 hours of the onset of the symptoms, within the first 24 hours of the onset of the symptoms, within the first 6 hours of the onset of the symptoms, or within 3 hours of the onset of the symptoms. The initial administration can be via any route practical, such as by any route described herein using any composition described herein. A microbial composition can be administered as soon as is practicable after the onset of a disease or condition is detected or suspected, and for a length of time necessary for the treatment of the disease, such as, for example, from about 1 month to about 3 months. The length of treatment can vary for each subject.

Compositions of the disclosure can be administered in combination with another therapy, for example, immunotherapy, chemotherapy, radiotherapy, anti-inflammatory agents, anti-viral agents, anti-microbial agents, and anti-fungal agents.

Compositions of the disclosure can be packaged as a kit. In some embodiments, a kit includes written instructions on the administration/use of the composition. The written material can be, for example, a label. The written material can suggest conditions methods of administration. The instructions provide the subject and the supervising physician with the best guidance for achieving the optimal clinical outcome from the administration of the therapy. The written material can be a label. In some embodiments, the label can be approved by a regulatory agency, for example the U.S. Food and Drug Administration (FDA), the European Medicines Agency (EMA), or other regulatory agencies.

For example, the composition is formulated for administration via pH-dependent release delivery, microbially-triggered delivery, time-controlled delivery, osmotically-regulated delivery, pressure-controlled delivery, multi matrix systems delivery, bioadhesion delivery, or multiparticulate delivery. The composition can also be formulated for release in the small or large intestine, colon, rectum, stomach, anus, or esophagus.

The appropriate quantity of a therapeutic or cosmetic composition to be administered, the number of treatments, and unit dose can vary according to a subject and/or the disease state of the subject.

Pharmaceutical compositions described herein can be in unit dosage forms suitable for single administration of precise dosages. In unit dosage form, the formulation can be divided into unit doses containing appropriate quantities of one or more microbial compositions. The unit dosage can be in the form of a package containing discrete quantities of the formulation. Non-limiting examples are liquids in vials or ampoules. Aqueous suspension compositions can be packaged in single-dose non-reclosable containers. The composition can be in a multi-dose format. Multiple-dose reclosable containers can be used, for example, in combination with a preservative. Formulations for parenteral injection can be presented in unit dosage form, for example, in ampoules, or in multi-dose containers with a preservative.

The dosage can be in the form of a solid, semi-solid, or liquid composition. Non-limiting examples of dosage forms suitable for use in the disclosure include feed, food, pellet, lozenge, liquid, elixir, aerosol, inhalant, spray, powder, tablet, pill, capsule, gel, geltab, nanosuspension, nanoparticle, microgel, suppository troches, aqueous or oily suspensions, ointment, patch, lotion, dentifrice, emulsion, creams, drops, dispersible powders or granules, emulsion in hard or soft gel capsules, syrups, phytoceuticals, nutraceuticals, dietary supplement, and any combination thereof.

A microbe can be present in any suitable concentration in a pharmaceutical composition. The concentration of a microbe can be for example, from about $10^1$ to about $10^{18}$ colony forming units (CFU). The concentration of a microbe can be, for example, about $10^1$, about $10^2$, about $10^3$, about $10^4$, about $10^5$, about $10^6$, about $10^7$, about $10^8$, about $10^9$, about $10^{10}$, about $10^{11}$, about $10^{12}$, about $10^{13}$, about $10^{14}$, about $10^{15}$, about $10^{16}$, about $10^{17}$, or about $10^{18}$ CFU. The concentration of a microbe can be, for example, at least about $10^1$, at least about $10^2$, at least about $10^3$, at least about $10^4$, at least about $10^5$, at least about $10^6$, at least about $10^7$, at least about $10^8$, at least about $10^9$, at least about $10^{10}$, at least about $10^{11}$, at least about $10^{12}$, at least about $10^{13}$, at least about $10^{14}$, at least about $10^{15}$, at least about $10^{16}$, at least about $10^{17}$, or at least about $10^{18}$ CFU. The concentration of a microbe can be, for example, at most about $10^1$, at most about $10^2$, at most about $10^3$, at most about $10^4$, at most about $10^5$, at most about $10^6$, at most about $10^7$, at most about $10^8$, at most about $10^9$, at most about $10^{10}$, at most about $10^{11}$, at most about $10^{12}$, at most about $10^{13}$, at most about $10^{14}$, at most about $10^{15}$, at most about $10^{16}$, at most about $10^{17}$, or at most about $10^{18}$ CFU. In some embodiments, the concentration of a microbe is from about $10^8$ CFU to about $10^9$ CFU. In some embodiments, the concentration of a microbe is about $10^8$ CFU. In some embodiments, the concentration of a microbe is about $10^9$ CFU. In some embodiments, the concentration of a microbe is about $10^{10}$ CFU. In some embodiments, the concentration of a microbe is at least about $10^8$ CFU. In some embodiments, the concentration of a microbe is at least about $10^9$ CFU.

The concentration of a microbe in a formulation can be equivalent to, for example, about: 1, 1.5, 2, 2.5, 3, 3.5, 4, 4.5, 5, 5.5, 6, 6.5, 7, 7.5, 8, 8.5, 9, 9.5, 10, 11, 12, 13, 14, 15, 16, 17, 18, 19, 20, 25, 30, 35, 40, 45, 50, 55, 60, 70, 80, 90, or 100 OD units. The concentration of a microbe in a formulation can be equivalent to, for example, at least about: 1, 1.5, 2, 2.5, 3, 3.5, 4, 4.5, 5, 5.5, 6, 6.5, 7, 7.5, 8, 8.5, 9, 9.5, 10, 11, 12, 13, 14, 15, 16, 17, 18, 19, 20, 25, 30, 35, 40, 45, 50, 55, 60, 70, 80, 90, or 100 OD units. The concentration of a microbe in a formulation can be equivalent to, for example, at most about: 1, 1.5, 2, 2.5, 3, 3.5, 4, 4.5, 5, 5.5, 6, 6.5, 7, 7.5, 8, 8.5, 9, 9.5, 10, 11, 12, 13, 14, 15, 16, 17, 18, 19, 20, 25, 30, 35, 40, 45, 50, 55, 60, 70, 80, 90, or 100 OD units.

Pharmaceutical compositions of the disclosure can be formulated with any suitable therapeutically-effective concentration of an active ingredient. For example, the therapeutically-effective concentration of a prebiotic can be at least about 1 mg/ml, about 2 mg/ml, about 3 mg/ml, about 4 mg/ml, about 5 mg/ml, about 10 mg/ml, about 15 mg/ml, about 20 mg/ml, about 25 mg/ml, about 30 mg/ml, about 35 mg/ml, about 40 mg/ml, about 45 mg/ml, about 50 mg/ml, about 55 mg/ml, about 60 mg/ml, about 65 mg/ml, about 70 mg/ml, about 75 mg/ml, about 80 mg/ml, about 85 mg/ml, about 90 mg/ml, about 95 mg/ml, about 100 mg/ml, about 110 mg/ml, about 125 mg/ml, about 130 mg/ml, about 140 mg/ml, or about 150 mg/ml. For example, the therapeutically-effective concentration of a prebiotic can be at most about 1 mg/ml, about 2 mg/ml, about 3 mg/ml, about 4 mg/ml, about 5 mg/ml, about 10 mg/ml, about 15 mg/ml, about 20 mg/ml, about 25 mg/ml, about 30 mg/ml, about 35 mg/ml, about 40 mg/ml, about 45 mg/ml, about 50 mg/ml, about 55 mg/ml, about 60 mg/ml, about 65 mg/ml, about 70 mg/ml, about 75 mg/ml, about 80 mg/ml, about 85 mg/ml, about 90 mg/ml, about 95 mg/ml, about 100 mg/ml, about 110 mg/ml, about 125 mg/ml, about 130 mg/ml, about 140 mg/ml, or about 150 mg/ml. For example, the therapeutically-effective concentration of a prebiotic can be about 1 mg/ml, about 2 mg/ml, about 3 mg/ml, about 4 mg/ml, about 5 mg/ml, about 10 mg/ml, about 15 mg/ml, about 20 mg/ml, about 25 mg/ml, about 30 mg/ml, about 35 mg/ml, about 40 mg/ml, about 45 mg/ml, about 50 mg/ml, about 55 mg/ml, about 60 mg/ml, about 65 mg/ml, about 70 mg/ml, about 75 mg/ml, about 80 mg/ml, about 85 mg/ml, about 90 mg/ml, about 95 mg/ml, about 100 mg/ml, about 110 mg/ml, about 125 mg/ml, about 130 mg/ml, about 140 mg/ml, or about 150 mg/ml. In some embodiments, the concentration of a prebiotic in a pharmaceutical composition is about 70 mg/ml. In some embodiments, the prebiotic is inulin.

Pharmaceutical compositions of the disclosure can be administered, for example, 1, 2, 3, 4, 5, or more times daily. Pharmaceutical compositions of the disclosure can be administered, for example, daily, every other day, three times a week, twice a week, once a week, or at other appropriate intervals for treatment of the condition. Pharmaceutical compositions of the disclosure can be administered, for example, for 1, 2, 3, 4, 5, 6, 7, or more days. Pharmaceutical compositions of the disclosure can be administered, for example, for 1, 2, 3, 4, 5, 6, 7, or more weeks. Pharmaceutical compositions of the disclosure can be administered, for example, for 1, 2, 3, 4, 5, 6, 7, or more months.

In practicing the methods of treatment or use provided herein, therapeutically-effective amounts of the compounds described herein are administered in pharmaceutical compositions to a subject having a disease or condition to be treated. A therapeutically-effective amount can vary widely depending on the severity of the disease, the age and relative health of the subject, the potency of the compounds used, and other factors.

Subjects can be, for example, mammal, humans, pregnant women, elderly adults, adults, adolescents, pre-adolescents, children, toddlers, infants, newborn, or neonates. A subject can be a patient. In some embodiments, a subject is a human. In some embodiments, a subject is a child (i.e. a young human being below the age of puberty). In some embodiments, a subject is an infant. A subject can be an individual enrolled in a clinical study. A subject can be a laboratory animal, for example, a mammal, or a rodent. In some embodiments, the subject is an obese or overweight subject. In some embodiments, the subject is a formula-fed infant.

EXAMPLES

Example 1: Modulation of Nervous System Function and Behavior by Butyrate Producing Microbial Strains Introduction:

A composition that comprised a population of butyrate producing bacterial strains was used to study its effects on the gut-brain axis including colorectal hyperalgesia and psychological behavior. A mouse IBS model system was used to observe behavioral characteristics in the study, while neurons extracted from these rats were use to observe electrophysiological characteristics.

Methods:

A synbiotic comprised of a consortia of microbial strains that included two primary fermenters and three secondary fermenters and a prebiotic fiber source was tested in a mouse model of IBS. A negative control which contains all of the manufacturing ingredients and the prebiotic fibers, but excludes the bacterial strains was also used. A validated IBS model was generated by colorectal infusion of 0.5% acetic acid (AA, "IBS mice") or saline at postnatal day 10 of C57B/6 mice. At adult age, the synbiotic and the control were administrated orally for 2 weeks. Anxiety-like behavior was assessed by elevated plus maze (EPM) followed by visceral motor reflex (VMR) responses to colorectal distention (CRD). Sensory neuronal responses were also tested separately in CGRP-GFP transgenic mice treated with symbiotic or control for 2 weeks followed by 1 week withdraw of the treatment. DRG neurons from these mice were dissociated and electrophysiological responses recorded using patch clamping.

Figures 9A, 9B:
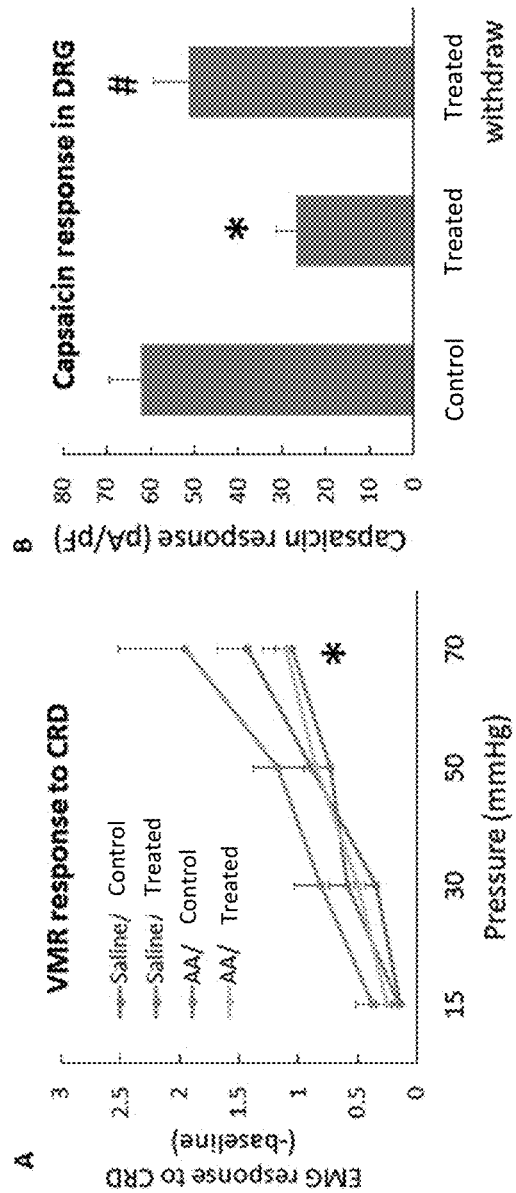
FIG. 9A and FIG. 9B illustrates a reduction in sensory neuronal responses in response to treatment with formulations described herein.

Results:

The IBS mice showed significantly increased VMR response to CRD, which was reversed by the treatment of synbiotics as revealed by 3-way ANOVA (FIG. 9A). As shown, The synbiotic treatment reversed hyperalgesia in the IBS mice as assessed by VMR response to CRD. Data are presented as mean±SEM (n=6-8 mice). Three-way ANOVA showed the main effect of IBS model $P<0.05$; the main effect of synbiotic $P<0.05$ and the main effect of pressure $P<0.001$. *: Significantly different from AA/Control group at same pressure by Student Newman-keuls post hoc test.

Symbiotic treatment also significantly inhibited the TRPV1 response to capsaicin in CORP-positive sensory neurons (FIG. 9B). As shown, TRPV1 currents in sensory neurons are inhibited by synbiotic treatment and returned to normal one week after withdrawal of treatment. Data are presented as mean±SEM (n=22-29 cells). *: significantly different from the control group by t-Test P<0.05; #significantly different from the treated group by t-Test P<0.05.

Figure 10:
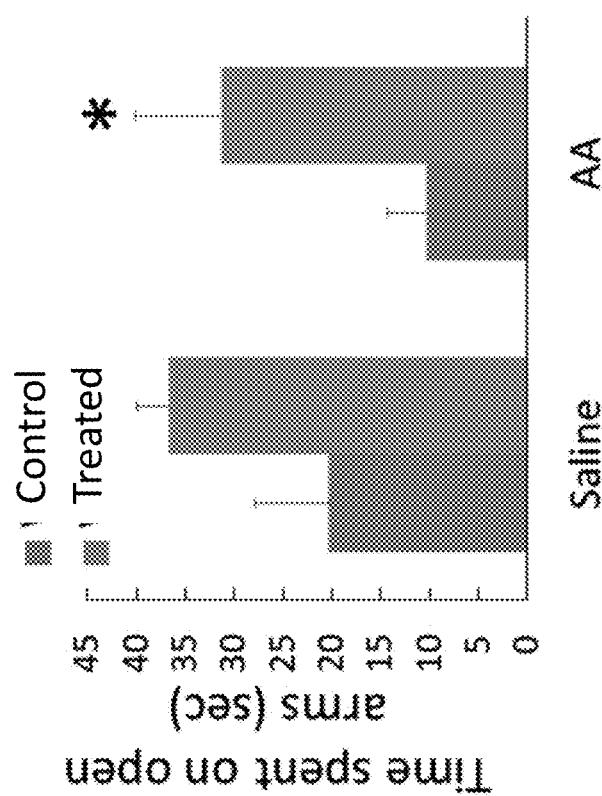
FIG. 10 illustrates assessment of anxiety-like behavior in both the treated and control mouse IBS model using a elevated plus maze (EPM).

Finally, treatment with the synbiotic significantly reduced anxiety-like behavior in IBS mice (FIG. 10). Two-way ANOVA reveals significant effect of synbiotic treatment (P<0.05). Data are presented as mean±SEM (n=6-8 mice). *: significantly different from AA/WBF-13, P<0.05 by Student Newman-keuls post hoc.

These results demonstrated that the butyrate-producing synbiotics are able to reduce the hyperalgesia in the IBS mouse model, which appears to be mediated by the selective inhibition of TRPV1 channels in the DRG sensory neurons. Furthermore, the results demonstrated the effects of the symbiotic on affective behavior.

Example 2: Methods for Treating Behavioral Conditions (e.g., Food Addiction, Depression, Anxiety)

Objective:

A longitudinal study is performed to identify therapeutic effects of administering butyrate-producing formulations of the disclosure to patients with a disorder, for example, metabolic syndrome and food addiction. Statistical methods are applied to comprehensive multi-omics datasets collected during a placebo-controlled longitudinal study. The study identifies key microbial players and pathways that can drive behavioral and metabolic outcomes.

Significance:

Patients with metabolic syndrome can suffer from psychiatric comorbidities, such as food addiction, depression, and anxiety. Changes to the gut microbiota composition can be associated with improvements in brain-centric diseases (e.g., neurological disorders, behavioral disorders). Butyrate can have beneficial effects on metabolic and behavioral conditions via gut-brain neural circuits. The disclosure provides a butyrate-producing formulation designed to treat human patients from manifestations of metabolic syndrome and associated psychiatric comorbidities.

Figure 11:
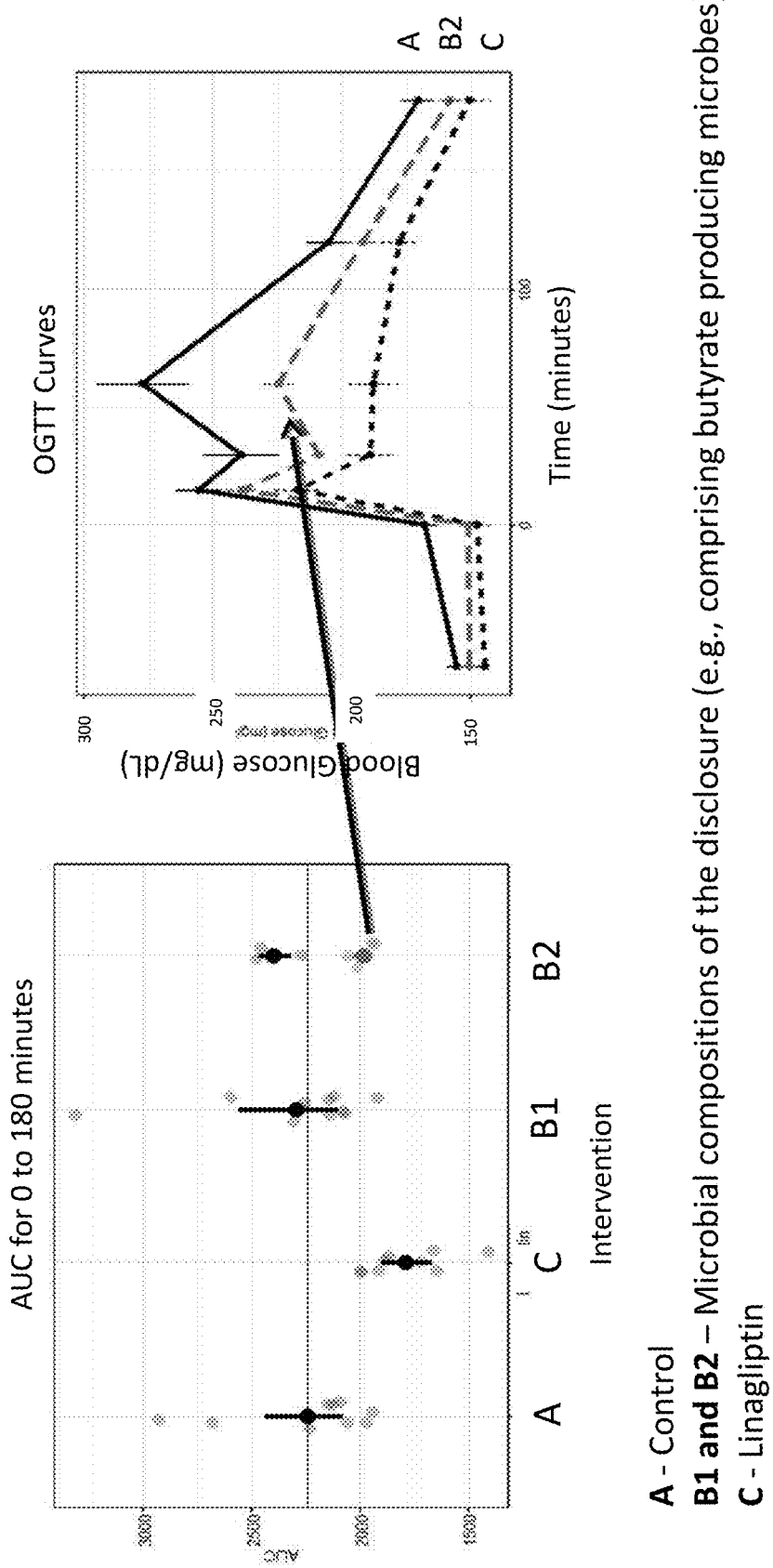
FIG. 11 depicts an example data set from an oral glucose tolerance test. In a C57Bl/6 diet-induced obese mouse study, a formulation of the disclosure (labeled B2 in the figure), had significant glucose lowering efficacy in a subset of mice, with an oral glucose tolerance test profile between standard treatment linagliptin and control.
Figure 12:
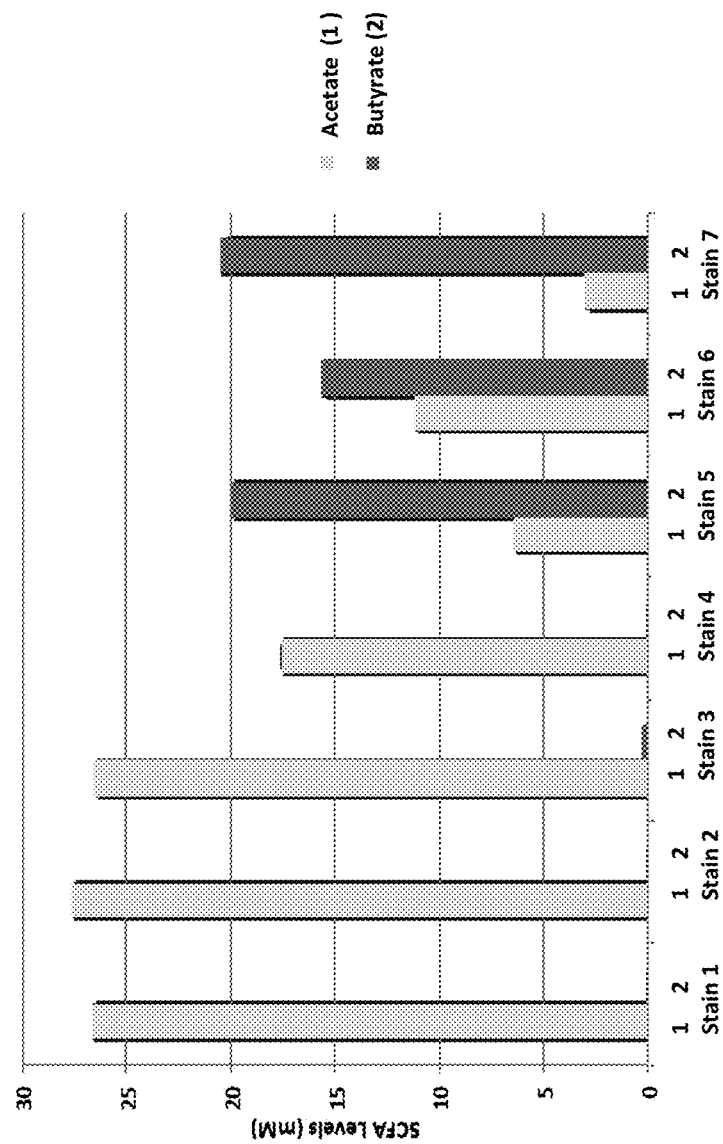
FIG. 12 illustrates measurements of two SCFAs, acetate and butyrate, across seven strains.
Figure 12:
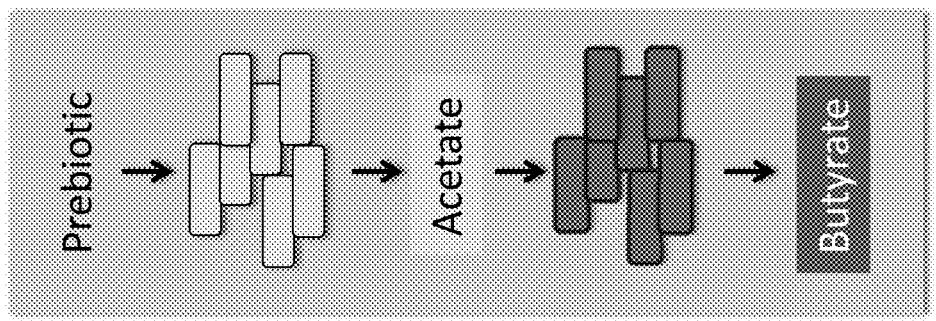

A microbial composition of the disclosure can specifically target and increase the critical butyrate biochemical pathway implicated in metabolic syndrome and food addiction/cravings. The microbial composition can improve glucose metabolism, metabolic syndrome, and behavioral traits. A microbial composition of the disclosure can improves glucose metabolism as illustrated in FIG. 11. In this study, an intervention is performed by delivering a butyrate-producing formulation to metabolic syndrome subjects with behavioral surveys and neuroactive metabolite measurements.

In a longitudinal study, administration of a SCFA-producing formulation (e.g., which increases butyrate production) to patients with metabolic syndrome and psychiatric comorbidities can, for example, 1) Improve behavior, including food addiction, cravings, and symptoms of anxiety and depression; and 2) Provide data and insights that can contribute to development of companion diagnostics and interventions impacting the gut-brain axis.

The approach to designing and validating Boolean Implications method and companion diagnostic is to instrument the benchmarking and validation code first, so that prototypes can be incrementally improved, and target accuracy is achieved.

Results:

The butyrate-producing formulations have a statistically positive impact on patient behavior, including addiction, cravings, anxiety and/or depression. Relationships and correlations between the microbiome, neurological signaling and behavioral scores are identified. Biomarkers that indicate an individual's likely responsiveness to a butyrate-producing microbiota intervention and the statistical relevance of those biomarkers for companion diagnostics are identified.

Example 3: Study to Evaluate Impact of a Butyrate Producing Formulation on Behavioral Measures Synbiotics (e.g., food ingredients or dietary supplements combining probiotics and prebiotics in a form of synergism) therapies can be used for targeting metabolic syndrome and related psychiatric comorbidities.

For this study, measure the clinical impact of a butyrate-producing formulation on food addiction, cravings, anxiety, and depression symptoms in metabolic syndrome patients using comprehensive and validated assessment instruments. The gut-brain axis is also analyzed.

Synbiotic intervention for metabolic syndrome (e.g., administration of microbial compositions) is carried out in conjunction with the collection of comprehensive questionnaire and neuroimaging data to assess the potential of this intervention to positively affect common psychiatric comorbidities of metabolic syndrome.

Methods and Analysis:

The study targets patients with metabolic syndrome along with healthy controls. This is a longitudinal cross-over study where data is collected twice at baseline (2 weeks), four times during first intervention (8 weeks), once during first washout (4 weeks), four times during the second intervention (8 weeks), and once during the last washout (4 weeks). There are two arms of 75 patients, where the first arm has the butyrate-producing microbial composition (e.g., comprising isolated, purified, and cultured population of *Akkermansia muciniphila, Clostridium beijerinckii, Clostridium butyricum, Bifidobacterium infantis, Eubacterium hallii*, or any combination thereof) during the first intervention period, and a placebo during the second intervention period, and vice-versa for the second arm. Patient data, bloodwork and clinical diagnostic tests are performed. De-identified stool samples are shipped directly for analyses, which include, for example, 16S primer assays, metabolite screening and biochemical assays. Multiple data types are analyzed to elucidate the impacts of the intervention and the biochemical pathways which respond to microbiota changes. In this study, a set of questionnaires are administered, for food addiction to study participants, and provide the results for analysis and interpretation. Questionnaires include, for example, Reward-based Eating Drive (RED) Scale, the Three-Factor Eating Questionnaire (TFEQ-R21), the Yale Food Addiction Scale (YFAS) 2.0, and the Hospital Anxiety and Depression (HAD). A high level of compliance on questionnaire data is seen when data is collected via electronic forms.

In follow-on study for dosing guidance, resting state functional magnetic resonance imaging (rs fMRI), grey and white matter brain neuroimaging data are collected before and after the synbiotic intervention, focusing on the reward circuitry, which can be activated upon exposure to palatable food cues. The reward circuitry can be found in the following brain regions: the nucleus accumbens, hippocampus, orbital frontal cortex, ventral medial prefrontal cortex, orbitofrontal cortex, anterior cingulate cortex, amygdala, insula, ventral tegmental area and regions of the striatum (caudate, putamen and pallidum).

Results:

The data shows a statistically-significant improvement in behavioral traits in response to the butyrate-producing microbial intervention.

Example 4: Study to Identify Gut Microbial Biomarkers Correlated with Behavioral Trait Modification For this, measure gut microbiota strains, short chain fatty acid (SCFA) production, neuroactive molecular markers from stool and blood samples, and markers of systemic inflammation related to gut microbiota. Using a Boolean implication and co-inertia analysis methods, asymmetric relationships and correlations between gut microbial metabolites, and behavioral questionnaire scores are determined. This is used for the development of therapeutic compositions and diagnostics for disorders associated with gut-brain axis.

Metabolomics data covering neurotransmitters and neuroactive substances from subject stool and blood samples is collected, along with markers of inflammation. Measurements with significant relationships with the clinical outcome are identified by using Boolean Implications to find asymmetric relationships in addition to correlations.

Methods and Analysis.

A Shimadzu™ GC-2010 Plus High-end gas chromatograph is used to collect mass-spectrometry data for detecting neurotransmitters substances (e.g., serotonin, dopamine, GABA) and neuroactive metabolites (e.g., branched chain and aromatic amino acids, p cresol, N acetyl putrescine, o cresol, phenol sulfate, kinurate, caproate, histamine, agmatine) from subject stool and blood samples. An inflammatory marker panel (e.g., lipopolysaccharide, IL-1, IL-6, IL-8, TNF-alpha, CRP) is also collected from study subjects.

To enable multi-Omics analysis of these different kinds of mechanistic markers, two exploratory data analysis methods are employed: Boolean implications and co-inertia analysis. Boolean Implications (BI) can be a rigorous statistical method for finding significant relationships between pairs of measurement variables. BI can detect asymmetric relationships, such as If A, then B, where the converse is not true. Thus BI can be more sensitive to finding relationships between measurement variables that may otherwise be missed by merely using correlation. The BI method is used to handle multiple condition datasets, so that one can separate associations found across all samples from associations that are found differentially between the case and control conditions. An improved BI is used to find markers that have significant differential associations between case and control subjects in terms of questionnaire scores and neuroimaging data.

A complementary method for analyzing multi-Omics data can be used based on "multitable analysis" (e.g., "partial triadic analysis" in statistics), and related methods. The minimal-complexity method in this class is co-inertia analysis (COIA), which is extended to series of paired tables on the same samples/specimens. These methods can allow for a robust non-parametric unsupervised exploration of multivariate data from heterogenous sources that can be useful in the high-throughput setting where many cross-domain patterns can be undiscovered. These multi-table analysis methods can be adapted to the challenge of paired neuroimaging and microbiota measurements, toward an elucidation of high-level relationships between the two sources of data. Differences in clinical outcomes are analyzed via supervised learning methods for the detection of biomarkers associated with health or disease. The power of disparate data types to predict patient outcomes can be useful to generate more precise hypotheses. Algorithms used for the analysis can include regularized logistic regression, support vector machines and sparse partial least squares discriminant analysis.

The intervention has measurable effects on the microbiota and metabolites. An untargeted metabolomics screen of a random subset of subjects is performed following, for example, acute doses of the butyrate producing formulation, to screen for biomarker metabolites in blood as candidate neuroactive metabolites.

The intervention significantly affects neuroactive metabolites in the patient population. In some cases, the intervention can exert a modulatory effect on the brain via a reduction in the low grade systemic inflammation associated with the metabolic syndrome. To test this modulatory effect, the effect of microbial intervention on inflammatory biomarkers is assessed and changes are correlated with clinical outcomes.

Example 5: Study to Identify Companion Diagnostic Treatment Predictors

For this, perform statistical analyses using machine-learning methods to discover biomarkers that can predict efficacy of butyrate-producing microbiome compositions, on food addiction, cravings, depression and/or anxiety in patients.

A subset of subjects can show a detectable response to the intervention, while the remainder may not respond (see FIG. 11 mouse study). An effective response can be predicated on determining the correct dosing level for a specific subject. A companion diagnostic is designed using machine learning methods to assess whether an individual is likely to respond favorably to the microbial intervention, and to guide dosing.

Methods and Analysis.

A large feature set (including 16S survey data of stool samples, clinical measures of glucose tolerance, metabolomics and inflammatory markers) is used to construct machine-learning classifiers to predict outcome variables, such as questionnaire scores and neuroimaging data. The response diagnostic is designed using classifier tools in the R programming environment, such as generalized linear models and random forests. For the dosing companion diagnostic, a follow-up study is performed to assess the effect of various concentrations on patient response.

A dosing companion diagnostic is developed. Neuroimaging data is collected and integrated into the diagnostics and the Boolean Implication methods, followed by validation.

Example 6: Synbiotic Human Intervention Study

A clinical intervention study is performed in patients with metabolic syndrome. The pateints can additionally suffer from neurological comorbidities of a metabolic disorder.

Human studies to evaluate the impact of the intervention in healthy patients and patients with metabolic syndrome are designed.

The study comprises about 30 healthy control subjects with Body Mass Index (BMI) less than 25 and approximately 120 subjects with BMI between 30 and 40 who exhibit a metabolic syndrome. A metabolic syndrome can be characterized by, for example, presence of the following characteristics: abdominal obesity, fasting hypertriglyceridemia, low HDL cholesterol, hypertension impaired glucose tolerance, and any combination thereof. In some aspects, a metabolic syndrome can be characterized by, for example, presence of at least three of the following characteristics: abdominal obesity, fasting hypertriglyceridemia, low HDL cholesterol, hypertension and impaired glucose tolerance.

A formulation of the disclosure that enhances the ability of the gut microbiome to produce SCFAs is administered to the patients. The formulation can comprise butyrate producers with, for example, in vitro activity, in vivo activity (e.g., in C57Bl/6 diet-induced obese mice and Harlan Sprague Dawley healthy rats), or both.

The intervention can treat metabolic disorders and improve behavioral symptoms associated with metabolic syndrome. Data obtained from the study indicates that microbiota-targeted interventions can modulate the gut-brain axis.

Example 7: Treatment of a Neurological Disorder with a Microbial Composition A subject with a neurological disorder, for example, food addiction, depression, anxiety, or a combination thereof, will seek a medical professional for treatment.

The medical professional will prescribe a microbial-based oral composition comprising, for example, purified, isolated, and cultured microbial strains that can increase production of a SCFA (e.g., butyrate) in the subject. The composition can comprise purified, isolated, and cultured microbial strains: *Clostridium butyricum, Clostridium beijerinckii, Bifidobacterium infantis, Akkermansia muciniphila, Eubacterium hallii*, and any combination thereof. A microbial strain can be present in a range of about $10^7$ to about $10^{12}$ CFU in the composition. The composition can additionally comprise a prebiotic such as inulin at a concentration of about 70 mg/mL. The delivery form of the oral composition can be an enteric-coated (e.g., pH sensitive polymer) pill or capsule comprising a desiccant that can protect against stomach acidity and deliver to the ileum/upper colon region of the subject. The enteric coating is designed to dissolve at a pH greater than about 6.5-7. The oral composition can be administered as a pill or capsule comprising a powdered microbial composition.

In some cases, the subject can be administered the composition orally before food intake (e.g., 1 hour before meals), for example, twice daily for fourteen consecutive days.

The microbial composition can alter the microbial habitat of the gut of the subject to that of a healthy subject. The subject's neurological function improves. The subject's neurological condition, for example, food addiction and/or anxiety, can be treated by the composition.

Example 8: Treatment of Parkinson's Disease with a Microbial Composition

A subject with Parkinson's disease will seek a medical professional for treatment.

The medical professional will prescribe a microbial-based oral composition comprising, for example, purified, isolated, and cultured microbial strains that can increase production of a SCFA (e.g., butyrate) in the subject. The composition can comprise purified, isolated, and cultured microbial strains *Clostridium butyricum, Clostridium beijerinckii, Bifidobacterium infantis, Akkermansia muciniphila, Eubacterium hallii*, and any combination thereof. Each strain can be present in a range of about $10^7$ to about $10^{12}$ CFU in the composition. The composition can additionally comprise a prebiotic such as inulin, for example, at a concentration of about 70 mg/mL. The delivery form of the oral composition is an enteric-coated (e.g., pH sensitive polymer) capsule or pill that can protect against stomach acidity and deliver to the ileum/upper colon region of the subject. The enteric coating can be designed to dissolve at a pH greater than about 6.5-7. In some embodiments, the oral composition can be administered as a capsule comprising a powdered microbial composition.

In some cases, the subject can be administered the composition orally before food intake (e.g., 1 hour before meals), for example, twice daily for fourteen consecutive days.

The microbial composition can alter the microbial habitat of the gut and the subject's neurological functioning improves.

Example 9: Study to Evaluate Microbial Compositions in Treating Parkinson's Disease Objective:

The purpose of the study will be to assess the effect of microbial compositions of the disclosure in treating Parkinson's disease.

Methods:

Twenty subjects with Parkinson's disease will enter a double-blind, placebo controlled and randomized study.

1) Experimental group: Ten subjects will be given oral compositions containing the active composition comprising isolated, purified, and cultured: *Clostridium butyricum, Clostridium beijerinckii, Bifidobacterium infantis, Akkermansia muciniphila, Eubacterium hallii*, or any combination thereof. The composition will be taken once a day for 3 weeks before meals. Parameters observed will be neurologic functioning as indicated by score on the MDS-Unified Parkinson's Disease Rating Scale (MDS-UPDRS) before and after administration of the composition daily for 3 weeks.

2) Control group: Ten subjects will be given a placebo pill. The placebo will be taken once a day for 3 weeks. Parameters that will be observed are neurologic functioning as indicated by score on the MDS-Unified Parkinson's Disease Rating Scale (MDS-UPDRS) before and after administration of the composition daily for 3 weeks.

Predicted Results:

Following treatment, subjects in the experimental group will have a restored gut microbiome and show an improvement in neurological functioning.

SEQUENCE LISTING (14 sequences)

SEQ ID NO: 1 - DNA, 2043181 bp, Bifidobacterium adolescentis WBS-01
cagacgctggttctgaacggcctgcgttccccgcatcaccgtgcagtgcgacggcgagctcaagaccggtcgcgacgtggtgtatcgccgcgctgcttggcgccgaggaattcggcttcgccaccgccgcgctgatcgtcgaaggctgcgtcatgatgcgcgcctgccagaagaacacctgcccgcagggtatcgccacccaggatccggagctccgagcacgcttcaagggcaagccggaacatgtcgtcaacttcttcatgttcatcgccgaggaagtccgcgaactgctcgcgcagctcggcttccgcacgctggaagaggccgtcggccatgtcgaatgcctcgaccaggacgaagccatcaagcgttggaagtccgacggcatcgacctgagcaacgtgctcatgcagccgggtccggttccgggaaccatcctgcacaagacgatcgatcagaaccatgagctcgacaaggcgctcgacaacaagctcatcgagcttgcccagccagcccttgacaagaaggagcccgtgcgtatcgaaatgccgatccgcaacgtgtaccgtacgctcggcaccatgctcggctatgagatcaccaagcgttacggcgaggaaggtctgccggacgacaccatcggcatgacgttccatggtgccggcggccagtccattggcgcgttcattccgcgtggcgaaaccatccgcgtctacggcgaagtcaacgactacgcgggtaagggcctgtccggcggccgcatggtggtccgtccagaggacggcatcaccttcgatccgcacgagaacgtgatcgcaggcaatgtcaccggcttcggcgcgacttccggccaaatgttcgtggccggccgcgcgcgaacgtttcgccgtacgtaacggcggcgccaccttcgtggtggaaggcgtgggcgaccacggctgcgaatacatgaccggcggtacggtcgtgattctcggctccaccggccgtaacctcggcgcgggcttctccggcggcaacgtgtacgtgctcgacctcgacatgaagcaggtcaacccggcggccgccaccaacggcgcgctgctgttcgagccgcttgacgccgatgccgacaagctggtgcacggtctcgtcaagcagcatgccgaagagaccggctccgccttcgcgaaggccctgcttgacgactgggaaaacagcgccaagcgattcacccacatcgttccgaagcacttcctcgccatgcagaaggcgatgaaggaagccgaggagaagaacatcgatttcaatacgcccggcgtctgggaacaggtgtacgagcaggttatggaaggagcgcgctgacatgggagatcctcgtggattcctgaaggtccgtacccgtcgcgaactggccgaacgccccgttgaagagcgaatcaaggactggttcgacgttcacaccgaatccggcctgcagtcctggaccaccgagcaggcggcccgctgcatggattgcggcactccgttctgcatgagcggatgcccgctcggcaacatcattccggaattcaacgatctggtccgtcaggagaagtgggaggacgcgtacaaccgtctgtccgaaaccaacaacttccccgaagtgaccggtcgcatctgcccggcattgtgcgaagccgcctgcgtgcttggcatccatcagccggccacgatgattcagaacgacgaacgcaccatcatcgatcaggcatggagccttgactacgtcaagcctctgccgccgcagcgtctgaccgaccagaccgttgccgtggtcggttccggcccatccggtctcgcctgcgcccagcagctcacccgtgccggccacaccgtggtcgtatacgagcgtgatgacgccatcggtggtctgatgcgttacggcattccgaacttcaaactcgacaagcgcctcatcgaccgccgagtcgagcagatgggagccgaaggcaccgtgttccgcaccggcgtggaaatcggcaaggacatctcctgggatgacctgcgttcccgctacgacgcagtggtggttgccatcggctccaccgtgccgcgtgacatgaagattccaggccgcgagctcaagggtatccatttcgccatggagttcctgccggacgccacacgtcgcgtgtacggtgtcaagccggtcaacgacatcaccgccgaaggcaagcatgtggtgatcatcggcggcggcgacaccggttccgactgcctcggcacatccctgcgccaaggcgctaaggacgtcaccgtgctgcagatcatgccgcaggaaccgaaggagcgtccggccaaccagccatggccgaccttcgcccgcctgtacaaggaaacctcctccatgaaggaaggtttcgaaacgcagcgcgccgaatacgtgtacaacaccgactcggtcaacttcgagggctccgacgaggacaaggccaaggtgaaggtggagaactccaccgccaccgaaggcttcgtcgccgacgagaacggacatgtcaccggtctgaaggtcgtcaacgtcgctccaggagagaacgggccgttcacccgccagccaggcaccgaacgagtgattcccgccgatctggtgctcatctccgtgggcttcctgcaccctgacaccaccacgctggtggatcagctgccggtcgaccttgacggtcgaggcaatgtggcgcgtaacgacaagttcgccacctcccaggacggcgtcttcgcctgcggcgatgccggacgtggccagagcctcgtcgtgtgggccatctccgaaggtcgctcctgcgcggccgcggtcgacgagtaccttaccggctccaccgaactgccggcaccgatcgtcgcttccaagcgtccaatgatgctgccgcgatagacaacactgttgtaagggtatgaacgaggtggcccggctcgcgaatagtgagccgggccacctgtttttcacccgaaatgcggtaaagtaatcccagcaccatgcaacaaaggagtgactaatgccaaatcgcgcagaacgacgtgcccaagccaagcgcaatcgcaggggagtgccacagcaatacgaccaaacccaaggccgcgcacgttccggcatgttggacgagtatcagctgcaggaaaagtcacgtcgtctgcaggacggcaccgatgggccatggaagccgagtgccagtacggtcacggaaacggaaaacgcgctgaacaccaatcctgattacaagaatccgaagatgttcaaggcaccccattccgtccgtcaatggttccgtgtggccagctgggtgctgattgcgctgtcggccatcgccttcctcgtggtcatgtggctgccgtcgcatccgatgtggctcatctccacagtcgccatcgtcttcgcagtcggtgtgctgagcctgttcttcacggccggcaacccgaagcacaatccgaatctcgaccaaaacggaacagccgtctgatcacaaaaacgatggaaagcggtgagacaaccagaagcatttgtctcaccgctttttctatcggattttaggtatgcgctacttgacttcgactaaccgtaaagggtatgcgagaatgctgtttcatcgtttttcagaaaaagaatggaactttctgaaaaacgatgaaaacaatgagtgtttttcgtgtctgatgttttacagtagaacaggaaacgctggaagactcgaggaggagattacagacatgaaggttgacattctatcgcgtgaatacccgcccaaggtgtatggcggcgcgggggtgcatgccgaagagctttccaaggtgctggcggaacgtgtcgatgtgacggtccgcgcattcgacgggccgcgcacggccgccgacattcccgcgattcccggaacagacccgaaagggtcgctcactgtcgtcggctacgacgtgccgaaggagcttgaggatgcgaacggtgcgctgaaaacgtttggcgtcgatttgcaaatcgccaacgacgttgatgccgacatcatccatgcgcatacatggtacgcatgccttgctggctatctcgccaaaatgctgcatgacaccccattggtcatcaccgcgcactcgcttgaaccgttccgtccatggaaacgtgaacagttgggcggcggctacaatctgagctcctgggctgagaaagacgcctacgagcatgccgaccgcgtgatcgccgtatccgcgggcatgcgtgaggacatcctcaccgcctatccgaaccttgacccggacaaggtggtcgtagtgcacaacggcatcaccatgagccagtttgaaaccccggcggatgacgatccgggctggaaggtgttcgaacgttacaacatcgaccgcagcaaaccgaccttgctgttcgtcggacgcatcactcgtcaaaagggtctgccgtacctgcttcaggcactgcacttcgtggacccgaacatccaggtcgttctgtgcgccggcgctcccgacacgccggaaatcatggaagaggtcaagaccgccttcgccaagctcgacgaggaacgcggcaacatcatctggattgaggagatgctgccgaagccggagctcaacgcactcgaacatggctgcgacgcattcatctgcccatccatctacgagccgctcggcatcgtgaatctggaagccatggcatgcggtctgccggtggtcgcctctgcgaccggtggcattccggaagtcgtcgtcgacggcgagaccggatatctggtgccggtcgaccaactgcatgacggcactggcacccccaccaaccctgacaaattcgtgcacgatatggccgacgccatcaaccgcatcatggctgaccctgaaaaggcgaagcggatgggacaggccggttacgagcgcgcccgcgaccacttcagctgggagtccatcgcagacaagaccgtcaaagtctacgaggacgtgcttgccgaacggaagtagaaccgaacctgtctgatcgcggataaccgatccggctgatcgacagccagaataatcctgaaatgcctcctgccgacgcactatgctggcaggaggcatcatcgtatccaagtggtttgtgaaaatggaggggaccatgaacgaacagaacatcgcgttgaaactggacgatgtggaattccgtcgccgcaggcgcgtaattctcaccaaagtcaatctggaagtcaaaaaaggcgagaaatgggtgctgttcggtcccaacggcatcggcaaatccacgttggtgcagatgatgagcacccgtggattcccatccgaaggcacagtcgacattctgggaaaacgtctgggcaaagtgaacgtgttctcctaccgcaaccgcatcggtttgagctcggccgaactcggacgcgcgttcccgccgcaggaagatcctcttgacgccatcgtgacggcgctgaccgcaaccaccggccgttggcgcgacacctatactgacgaggattacgccaaagcccgctcattgatgcgtgaattcggcatcgaatacctggaaggcaagatgatgttcaagctttccgaaggcgaacgcactcgcgtgcttatctgccgtgcgttgatggcggatcccgatttgctgattcttgacgagccgaccacgggtcttgatttgggtgggcgtgagattgctttgcgtgcgttgagtcgtgttggtgcggagcagtctgaccgcgccgtgattctggtgacgcaccgtcttgaggagattccgcaaggcttcgaccacgtggcgatcatgggacgtatcaccggcaacgaggcggatgcgtatgccgataacgtcgccggcaacgatccggcgccgggcactatcgtatatacgggtgatttggagcatggttttacttctgaacggttgagccaggtgtttggattggatttgaaggtcacgcatgcgaatggtcgttggaacgcgtacgcggtgtgatgtcgacgtcgccgtcacattgccgtcgcttcgtgccgtctgccggtatgacggcggatacggtagcataggttcgttgctgtccgtggaatgcggtctgcaatcgtaagccatagtcgtgaaatcgcatactgaacgaacgtacgaaggagcgtaaaccatgcgtcgagggccgcttgccgccggtgaaaaagtgcagttcacggaccgcaggtcgaataaaatcaccgatcagctggtgccgggtggtgtgacgcagacctcgcatggcatcatcctgcatgatgatgtgattggccagacggaaggatccgttgtcgtgacggtgagtgcgaaacgtgaggctcaggtcaaccagacgcatccggaacgcgacgcgaacaagccgtggaagggaacgcgtgccatcggtggttgggagttcgccgtcatgcgtccgcgcttggctgactatgtgctgtccatgccgcgtggcgcgcagatcatgtatccgaaggacatcgcgcaggtcatccagctcggtgatattcgttccggtatgaacgtgctggaatccggagccggttcgggcgcgatgagcatcaatctgctggatgccgtggggagggcggaagcctcaccaccatcgagatgcgttcggaattcgcgcgcgtcgccgaagccaacgcgacggtttactttggcaaacgtcccgcatggtgggatttgaggaccggcgatttcgattcggtcgcggctggtttgccggaacactccttcgaccgcatcatgcttgacatgcttgacccgtggaaccgtcttgaacaggcgtatcgcgtgatcgcgcctggcggcgtgctcgtcgcgtacgtcaccaccaccacgcagttgagccgtcttgccgaagcgttgcgcgaggtcggctgctggaccgagccggacatgcaggagactttggaacgtaattggaaggcgcaaggactggccatccgtcccgatcaccagatgattggacacaccggtttcctcatggtttctcgcgcgatggctccgggcttccaggcgttgcgtaaacgcgaccgtgccacgaaggacacgacgaccgacatcgattcgttgacgcccgaggagcgtgccgaacagcttgaggatctggaattgcgtgacatttccgatcgcaagctgcgcaaggtgctgcgtgacctcgacgcgcaggtcgaagccataaaggagtagatttagagcgtttcatgccatgtcccagcggaaaatctgagacaatggacattagacatttgaaatgcggcgctggaaccggatcggagcgtgcgattatgggaacgagcctgaagaaggtcgctaaaaaggccaaggaatacaagtatgtgctgctggcgatgcgccacgccaaaaccgagccgttcggcggcaacggcagcgacgtgggacgtgagctcaccgacaaaggacgtaagcaggccaaagccgtggccaaaggattggcggcgttcaaaatggtgcccactcgcatcgcatgctccagcgccacccgcgcccgtcagacctgcgatcgcatgctcaaggtgttcggcgacgatccgaaagtcgactaccggcaaagcctgtacgaaggcggcgtgcaatccgtgttcgacgagctcgcgcaaaccaaggaaaagcatcgcacgctgctcgtgcttggccacgaaccgaccatttcgatcgcctgccaatggctggccagcaccgaatccgatccgacgttgcttgacctgctgaatctcggcatgtccccggcctcgatcgccgtattcggctcgaacgagccattcaaccagtggcagctgcacagcggcgaactcatcgcgctgcttaccgccaaagacttcgagtagggcttgcgtgttccgggctgattcggaacgatgagcattccgcagagtgctgtgatttgacttcaagcggcttcaaggttgtatggtgctttctgaaccgatgttcagaatgatggataggagagcccatatgaacaatcccagtgcgttccctcttggggaaccaaatgacggtttcgcccagtatttcgacggacagagctggcttgcgccggtacttgacgcgcctgaagtgtcaatccacaatgtgacgttcgaacctggatgccggaaccactggcatatccaccatcacgcggcccagattctcattgcggttggagggcgtggctactaccagcttgagggcgaagagccgaaggagcttgaaccgggacaggccgtccgtattccgccggacgttaagcattggcacggtgccgcccctcgcgaagctttcagccatttggcgttcatgattgcggatggcacgggcgacgtgacgaatgaatggctggaacccgtagaccccgacgcatacgagacattgcgttaaatccgcttgccgggctgttctgcattattgatccataaacataaatgtgtgaatatagacggcatacggactgcgttataaggacagtttataacgacattcaaattttcttgatgtcttatagctggcggttttgtgatagcttgagcgggttgcattgttcatatcagatggaggattcatgtccgctcttacttccgtctccggtttcccgcgcatcggccagaaccgtgagctgaagaaaatcatcgaagcgtattggaagggcaacaccaccctcgatgaggtgcgtgccacagccaaggaactgcgcgccaagcattggaagctgcagcaggccgccggcatcgacctgattccgagcaacgacttcagctattacgaccagatgctcgacactgccatcctgctcaacgtcattccgcagcgctaccagcgtctcgccttcgagaacccggaagagaccctcttcgcaatgggtcgcggctatcagggcgagaagggcgacgtgaccgccctgccgatgaagaagtggttcaccaccaactaccactacctcgtgccggaaatcgactccgccaccgacatcaagctcaacagcaccaagccgttcgacgaattcaacgaggcgaaggcgctcggcatcaccaccaagccggtgctcatcggcccgtacaccttcctcaagctcgcccgcaatccgcaggccgaggagctcgactacgacaagggcctcgtcaacgcggtcgccgcggtgtacgccgaagtcgtcgccaagttcgccgaactgggcgtgcagtggatccagatcgacgaaccgtacctcgtgctcgacaaggagccgggcgacgtcgaactgttcaagagcctgtacgccaagatcctgcccgcccgcgaaggcaaggtcaaggtgctgctcaacacctacttcggacacatcgccgacgtgtacgaaaccgtcaacctgctcggcttcgacggcatcggcctggacctgaacgaaggcaaggacgaaaacctcgccgccgtcgaaaagtacggcgtggcagaaaaaaccaccatcttcgccggcgtgatcaacggccgcaacatctggcgcaacaactacgccgtgagcctcggcctggtcgacgcgctgaagcaggtcaccgccaacgtggccgtctccaccgccagctccctgctgcacgtgccgttcagcaccgaaggcgaggacggtctcgccgacgacgtgcgcaagcacttcgccttcgccgtccagaagctcgacgaactgcacgaagtcgccgtgctcgccgacgcttccgacgacgagaagaaggcatccgccgaactcgcagccaaccaggcgctgttcgacggcacccgcgtcgccgccgatcctgcggtcgccaagcgaatcgcaagccttaccgacgccgacttcgtacgtcagccggcacgcgccgaacgccagaaggagcagcgtgaggcgctgaacctgccgctgctgcccaccaccaccatcggctccttcccgcaaaccaaggaagtgcgcgccgaacgcgccaagctgcgcaagggcgagatcaccaaggccgaatacgacgaattcatgaagaaccagatcgacgcctgcatcaagcatcaggaggaaatcggcctcgacgtgctcgtccacggcgaattcgaacgcaacgacatggtcgaatacttcggccagaacctcaacggcttcctgttcaccaagaacgcgtgggtgcagtcctacggcacacgttgcgtcaagcctccgatcgtgtggggcgacgtatcccgcgccaacccgatcaccgtggaatggagcgcctacgcgcagtcccgcaccgatcatgtgatgaagggcatgctcaccggtccggtcaccatcctcaattggtcctggccgcgcgaggacatcacccacgagcagcagacccagcagctcgcgctcgccatccgcgacgaagtgctcgatttggagaaggccggcatcaaggtcatccagatcgacgaggccgcactgcgcgagaagctgccgctgaggaagaccgactggcacaagaagtacctcgactgggccattccggcgttccgtctggtgcattccgccgtcaagccgaccacgcagatccacacgcacatgtgctattcggagttcaacgacatcatcaaggacatcgacgcgatggacgccgacgtgatctccttcgaagcctcccgtggcgaccttgtggtgctcgacgccatccacgacgccaacttcgaaaccgaagccggcccgggcgtgtacgacatccactctccgcgcattccgtccgaacaggagatcgaggaccgcatctacgagatcctgaagaagatggacgtcgaaaaggtgtggatcaacccggactgcggcctgaagacccgtggcaacgccgaaacctggccgagcctggagaacctcgtcgcagcggccaaggccgtgcgcgccaaactcgccaagtaaggccggcataggcataaacaggcaagatttccaaggaatcacatgcattcgccaatcttctcgctggaggtgttccctcccaagcgcaccagccctgtgggtaccatctacgatacgttggatggcctgcaggggctggaccccgacttcatctccgtcacctacggcaccggcaaatcgtccgaccgcacgttgaccgcacgcatcgcgcatacggtgaacgaatacggcattccggccgtggcgcacctgaccgcgcaataccttgacaaagacgacgtggatgaggcgctcgacctgttcgaccaggccaaagtctccggcgtgctcgctttgcgaggcgaccgtgtggaaggagccgaaccggcgggagtgttcgaccatgcgagcgatctggcggcctacatccgcgagaagcgtccggatctcaagatctacggcgcctgctatccggaaaagcacccgcaggcggccacgcttgaggaggatatcgacaatctcaagaagaaggtcgacgcgggcgtaagccacctcatctcccagctgttctacgacaacgaggatttccttcgattcgtggacaaggctcgtgccgccggcatcgacgttccgatcgaagccggcatcatgccggtgatgaacgcgaagtcggtgctgcgcatgtcgaagatgtgcgaatcgcgtgttcctgaaaaacttgccgtcctgcttgacaagtgggggagcgacaccgcgctgcttaaagaggcgggtatcgcttacgcgtccgaacagatctgcgacttggcggcacgcggcgtcgacggcgtgcacctgtacacgatgaaccatccatgcgtcagccggcgcatctggtccaacgtcaaaccattcttcgtctgattcagacgatgcaacaaacacgaaagggatgatttccggcaactgtcggaaaccgtccctttcgccatacttacggatatgaacgattactatgggaaccatggcttcttctacgcatcagtttgaggtgctcgatctgattcgggcgggattgcaggatctggacacggcacgcacgttgcttgacgagttgcgcgccgacggcatcgacgacgaccggctatgcctgctgatgaaaacattggaacagacctgcgagcccgacatcgcgctacgcaacctcgtcgacatcatcaaagcgttgcaaagccaaggccgcgacttccaccaggtcatcaccgacgacgccggactcgtacgactcgtcaccgtgctcggcgtgtccgacggaatgggcaagctcatgcgcttccgccccgaactcgtcatggccgcagccagcgactcatgcgaaagccatctgtacaaccacgcgcaacgccgcgcgcatgtcctcgaagcggtcggtgccgacccggccgacaatcgcatgccaaaagccacgaaaccactcgccgaagcggcgaccgcgctacggcagacctacagaaaacagctcgccgccatcatggcgcaggacgccaccgcggacgacccaatcgaaatacaaccgagaatcagccaggaactgtccgatcttgccgacgcggccctggaaggcgcgctcgccatcgcccgcaacgaagtggacagcagcgaacacgtgcgcttcgccatcatcggcatgggcaagctcggcgcacgcgaactcaactacgtatccgacgtggacctcatctacgtggtggaaccggcggacgcggacaccaacggcatgaccctcaaccgtgtcggcaccaaaatggccaccaccctgcagcgcgtatgccaatccgtcatcatgggcgtcgccgaacctacattgtggcagatcgatggcggactgcgccccgaaggcaaggacggcccgctcgtacgcaaactcgaatcgcacgaagcctactacgaacagtgggcggaaaactgggaattccaagccctgctcaaggcccgccccgtggccggtgaccccgacctcggccaagcgtacatggacatgacccgaccgttcgtatggaccgcctccaaacgcgacaacttcgtctacgactgccagcagatgcgcaaacgagtcgaagacctcatccccgcgcccctgaaggaccgtgaaatcaaactcggccgcggaggcctacgagacgtggaattcaccgtgcagatgctccaactcgtccacggccgcgccgacgagaccctgcgcaccagctccaccctcgaatcgctgcaacgcctcgccgaaggcgggtacgtctcacgcagacaagccaagaagctctcctgggactaccgcttcgaacgcgtcatggaacaccgccagcaaatgtgggcgctcaaacgcacccacctgttcccggacctcggcaaagccagtctcggcggcatcgaacgcaaacgcgacgccaacgacgacgaactcaaccacaacctcgaactgcgcagactcgcccgggccttccacatgcaccctgaggaactcgtcgacaaatacgacgaaacccgacgtgaagtgcgccacctgcacatggacatctactaccggcccatgctgcccatcaacgccggcctcgacgacgaacaagtggaactgtccgccaacgccatgcaggaacgcttcgcctccatcggattcgccgaccccgacgccgccatgcgccacgtcaccgcactgaccgccggcatctcccgtgccgcgaaaatcaaccgcatcctcctgcccgccgtcctccaatggctcggcgaagggcagaaccccgacatggggctgctcaactggcgcaaactcgaagaacactttggcacggacagcgaatacctcggcttcctgcgcgactcgccgtccgccgcgcaacgcctgtgccacgtcctgtccaattcacggttcctgggcgacgcgctcaacaaatccgtcgaatccgtcacctggctcggcagcgacaacgacctgcagccacgttcgcgcgaaagcctcgacgtgcagacacacgcctccctcgaacgcaacgtaggcagcatcaacgacttcgccaactccatccgcgccatgcgacgccacgaaatcgaacgcatcggactagggtggatgagcggcgtcatcgacgacaaggcgtcgctcgcaggtatgaccgacgtatacgacacggccatcgacgcatcgctcacctgggccatccgccaccaaacgcaggaaatgggattcgacgaagcgccggcggcaatcgccgtcatcggcatgggacgctacggcggcagggaagtgaacttcagctccgacgccgacgtcatcatcatctaccggccgtccgataacgccgacgacaaccaagccaacctcttcgcacgcaaagtgcaggaagacctccgcgccatcctgcaaggaccgaccacgctcgaacccaaaatcgaactcgacatggacctgcggcccgaaggcaaaaacggacccctcgtgcgctcctacgcgtcctgcgaggaatactaccgttcctgggcgagcacatgggagcaccaggcgctcctgcgtgcgcgttacgcggcaggcgacgcggcgctcgccgaggatttcctgatgaacgtcgccgacccgctgcgctatccgaagatcgatttgacggaggcgcaggtcgccgaaatacgcaagctcaaggcgcgtatggaagccgagcgattgccgcgcggcgtgcgtagggaccgtcacctgaagctgggcaaaggtggtctgtccgacgtggaatggacgattcagctgctgcagttgcagcatgccggcgacaacgcgaacctgcgagtcaacggcacgatgcaggcgttggacgagttggagcggcgcaagctggtttccgccggcgacgccgtcgtattgcgacgcgcatggtggatgtgcacggccgcgcgcaacggcagctacctgtggagcgggcgcgtcaaccaggcggatatcctgccggatgacacgtattcgctgggaggactcgccgtctatctcggatacgacgcgaatcgcggacagcatttcgaaaacgatctgcttgccgtaatgcgcaaggcgcgcgacgtgacggaacgtctgttctacggcctttcatgaaacgattcgagcgggcgctcggtgaacacgcggtgaacgctccgggtcagtgtttcgggctatagttggctaggtcactttcagtggccaccttcaaccacaagttgcatgaaaggtgagccgttgtcctcagtactcgaaccggcggtcgaaacgccgatggtcggaaaaagcgtcatcactctcgatgatctttccattcgtcagattcaggaaatgctgcacaaagcgcagtacatcgattcccatcgtaaagaagtggcacacacctgcgaaggcagggtgcttgccactttgttttatgagccgagcacgcgcacgcgtctgagtttcgaaaccgccatgctgcgcctcggcggcaaggtgatcggtttcgccggcgcccagctcgcctccgtcaccaagggcgagacgatcgccgacacgttgaagacggtgtccaactacgtcgacgtggtggccatccgccatccgaaggaaggcgccgcgctggtcgcatcccgcgccgcctccgtgccggtcatcaacgcgggcgacggcggacacatgcatccgacgcagacgctcgccgacctggccacgcttcaatcgcgcttcggccgtgtcaccaacctgaccgtcggcctgtgcggcgatctgaccttcggccgcaccgtgcactccctgatcgaaacactgtgccgcttcggcaacgtcaacttcgtgctcatcagccccgacgagctcaagaccccgcagtacgtgcttgaccgcatcaacgccaccgaatcctgctcctacaccgaagtcaaggatctggtctccgtcatcggcgatcttgacgtgctgtacatgacccgcgtgcagaaagaacgtttcttcaacgaggacgattatctgcgtctgcgcgacacctacatcctcgacgaagccaagatggcgtacgccaagaaggacatggccgtgctgcacccgctgccgcgcgtcaacgaaatcgccgtggaagttgacgacgatccgcgtgcagcctacttcgaacaggtcaagaacggtatgctcatgcgcatggcattggaaagctcggtggtcggtgacgaactgccgggatacgaaccgctcgcagccaaggaggttgaagcctgatggaagtcaccagcattcagaacggcatcatcatcgatcacgtgcccgccggaaccgcgctcaaggtacttgagtatctgaagatcgacccgtccaaaaccaaactcgcgttgatcatgaacgccgacagccacatgtacggcacgaaggacatcatcaaaatcgaggatgagaccgaatccatcgacctcgacgtgctcggcctcgtggcgcgcaccgcgaccgtcggcatcgtccgcggcggcaaaatcgtcgaaaagaagaagccgaccctgccggaacatgtcgtcaacatcatcaaatgcgtgaacccgcgctgcgtcaccaccaccgagcctgcggtgcagatgttccatctggtgcattccgaccgtcaggaataccgttgcgactactgcgacgaggaagcgaagttctgaaatcatgaccctcacccttcacgacatcaaggtctggaacaccggcgaagtcattgacctcgtcgtcccctccgacacggacgcgtccgtggacgcctcggcgatgaccatcgcccccggattcgaagacccgcacgtgcatttccgcgatcccggacagacctacaaggagtccatgatctccggctgcgcggcggcggcatccggcggatacacgaacgtgctcatcatgccaaacaccgtgccggccatggatggcgtgaaggtggaggccggccagccgggcgcctccgaagtgctcgacgccgaatacgacacggtcatcgattacctgcagcattacgaggccgctcatggcgtgaaactgccggtgcgctacgacctatgcgtatgcgcctcaaaggggcgtgccggccatgaggccaccgaagtggccgactggatcggctacctgcccgaacatggcgacgagcataaggacgcctaccagctggcgcatccggtgaccgccatcagcgatgacggttccgcggtgacccccagcattctcgaacaggtgttcgaaaacgtcaaggagtcgggactgtacctcatcgagcattgcgaacaccacgacaccggcgcggtcaatgacggtccggtgtcccgcaagcttggcgttccaggcattccggaggacacggaactcaaaatcgtcgaacgcgacattgacatgtcccgcaaaaccggcgtgcacgtgcacttccagcacgtcagcaccgcgatctccttcgacgccatccgcaaagccaaggccgaaggacttccgatcacctgcgagaccgcgccgcattacatcgcattgaacgacgaggcgctgcttaagtacggcactttggccaaaatgaacccgccgctgcgctccgaagcggaccgccaggccaccatcgcagccgtcgccgacggcacggtcgatttgttggccaccgaccatgcgccccacaccatggaagagaaggaactcggcttcctcgacgcgcccaacggcatcatcgggctggaatgcgcatacggcgtctgccacaagatacttgtcgacggcggattcatttccgacgaacgtctcatcgaactcatgtccaccggtccggccgaactcatgggccacgacaaaacggacatcacggcggtactcgacgactacgccgacgccgtgccgggagacgacgacaccaagcgcgtgcttgatctgggccgcgtgcccgaaagcgaccaggtggatctcgtggtgctgaacaccggagaggaatggaccgtcgacccggagaagttccactcctcggcacgtaacaccccattcggcggatggcaggtcaccggccggccgctcgccaccatcatcggctcgaagctggccttcagccgcatcgacaaggaggactgatggaccgtctgatcgaagccatcgaagacaagcagaatccaagcgtcgtgggactcgaccccaccgaagcgctggtgccgaatcaggtcgtggccagcttcgccgaggaaatcgccgaacaggtggaggatccgacggaagcgccggcagcccaactgtccgtcgccttcttcgaattcaaccgcgccatcatcgacgcagtagccgacatcgtcccggccgtcaaaccgcagatcgccatgtatgaggcgctcggaccagccggcatcgacgcctacagcatgacctgcgaatacgccaaacagcagggactgtacgtcctcggcgacgtcaagcgcggcgacatcggctccaccgcagccgcctacgcccaccatctgagcggtgtgaacgcgggggagcacgctttcgacccgtggcatgaggacgcggtcaccgtgaacccctacctcggcaccgacggcatcaccccgttcgtcgaagccgccactggtgccgacaaggacatcttcgtactggtacgcacctccaatccatccagcagcgaactgcaggaactcgaactcgcctcaggcgagcgcgtgtacgagcatgtcgccgacctcgtggaaggctggggagccgaaaccatcggcgcgaacgggtattcccgtgtcggcgcggtggtcggagccacccatcccgaggaaggcaaggcgttgcgggcgcgcatgccgcacacgttcttcctggtccccggttacggcgcgcagggcggtaccgcccaaggcgtggccggcatgttcgacaaagacggcatgggcgcgctcgtcaattcgtcgcgtggcatcatcggagcctggaagaagtccagcaaatacagcgaatccatgagcgcagacgatgcgcttgacttggtcgccgaatcggcgcgcgaggccgcgaaggacatgcgcgacaatctgcgcgcggtactgccgtaagctaccagaacaatcgaacgaaacacaggaaagggagtcatgaccgccgcagcaacgttcatgccgaccgtcggccaggcgagggaagcgggattcttccccagcaggcacacggtcgaaatcgtcgacaaccgcatgctggccgatggcgtgtaccgattgacattccgcgacgaattcatcgcgggacatgccaagccggcgcagttcgtcgacgtgtattccaacaatccgagcagactgatgccccgcccgttcggcgtggcagaagtggatggcgatgaggtgagccttatcttcgccgtcgtcggcaaaggcaccgccgaattctccgaattgcgtgcgggcgacaccattcgggtgatgggtcctctcggcaactccttcaacaccaaggagaacgcgaactacgtgctggtggccggcggtctcggcgtgccgccgctggtgcgcgccgcgcaggccatcgccgaatcggaggggtcgacgagcaccgcggtgttcggataccgcaacgtgcgtttcggagacggatacgtcggccggtacgcggacaagacatacagcatcgacgaatccgaaggcaatgtcgtaacgctccttgaccgtattgaaaatgaactggtgaacggcgagctgaagccggtcatcctctcatgcgggccgttgccgatgatgaaggccgtcgccgcatgggcggcgaaacgcggcatcgaggcacagctgagcttggaacagcgcatgggctgcggatacggcacatgcgtgctgtgcaccgtcgacaccgccgaaggacgattgaaggtctgctcggacggacctgtgttcacccgcgaacaattgggatggggggagtgagcatgaccgcagaacaacatgcgaacctgtacgaacagcacgaatggaagcatcccacccaggtggctggtatcccgtggaagaatccggtggcgaccgcttccggcacgttccaatatgctgccgtgcgctggttctatgacgtgagccagctgggcgccgtcaccactaaaggcgtgtctccggtgccatgggaaggcaatcctggcatccgtactgcggaaggcccctccagcaacatcaacgccgtcggcctgcagaatcccggcgtggaccattaccttgaggacgatctgccgaaactcaaggccatcaacgccaccgtcatcgccaacgtcgccggacactgcgacgacgactacgcggaagtcgtgtccaagctcgacgattccccggccgacatgctggaaatcaacgtgagctgtccgaacgtgtccgcaggcggcatgagcgtcggcaccgacccggtggctttgagccgcctcatcaccagactgcgcaagctcaccgacaagaagatgatcgtcaaactcaccccgaacgtcaccgacatcaccgtgccggcacgagccgcggtggaaagcggagccgacgcattgagcctgatcaacacgctgctcggcatgcgcatcaacatccgcaccggcgagccggtcatcacgcacgtcaccggcggcgtgtccggcccggccgtcctgccggtcggactggccgcggtatggcgcgtgcgcgccgcattgccagaaataccgatcatcggcatcggaggcatcgactccggcgagaccgcgctcgaatacctgtatgccggcgccaacgccgtcgaagtcggcgcggccgcattgttcgagccgaccgcgccgctgcgcgtggcccgcgaactcgacgatctgctcgacgaacgtcccgaactcgccgacaagctcgccaaaggcgagacctggcgctgaaatttcgtaatcgatcaatgtaaggagaacaagcaaatgaccgcatcgctcgaccatcgtttcaccgagttcctgctggaatcgcaggcgttgaaattcggcgagttcacattgaagtccggccgcaagtcgccgtacttcatcaacgccggcgcattcaacgacggacgcaagatcgcccgtctcggcgcgttctacgccgagaagattgtcgaggagatcgaggcgggcaacctgcccaaggatgtcgacaccgtgttcggccctgcctacaagggcatcccgctgggcgtgtccaccgccatcgcgctgacgtccgcccatggcatggaggtcggctacaccttcgaccgcaaggagaagaaggaccatggcgacggcggcatgatggtcggcacgcagcttgcggacggcatgaaggtcctgctcgtcgacgacgtgatgaccgccggcaccgctgtgcgcgaggtcatcccgaagctcaaggccgaggcgaacgtcgaggtcatcggcctggtactgagcgtggaccgcatggagaagaccaaggattccgacacgtccgcggtgaaggccgtcgaagccgaattcggcttcccggtgttcgccatcgccaacgtgaaggagatcttcgaagccggccagcgcatccagaacgccgacggcaccccgtacgtcacaccggagatcaaggccgccgccgacgcgtacctggaacagtacggcgcctgactgcggcgttcgcgctgaaccgcgctcatcggctgttataatctcggatatgacagaaaggcactgtgctgctttcgggcagtacagtgccttttcgttgtggttcctctgttccggggtcagtcgatgagcgtgtagccgtggctggcgaccaccgacttgagcttctccaagtacgtttcggcggccttggacagcttcgcgcgctcattggtgatccatccgacaagcatcgtctcatcggtgtcgagcggcacggtgacgatcttctcgttgttgagatcgccgttgtcgatgccggtgcataccgtgtagccgttcaggccgatgatgaagttcagaatcgtggcgcggtcggtcacgttgatctgcttggggagtactccggccagacggcctcctccgcgaagaagaagctgccttcctcgccctgctcgtattggatgaacgggaacggcttcagatcgtccatggtgaccttcttcttgccggccagcggattgtcgcgcgagatgaacacgtgcaacggcgcgcggaacagcggatggaactcgagatgcttctcgcgcagcagcttgccgatcacgtccttgttgaagtcggacaggtagatgatgccgatctccgaaagcatgttcgccacctggttgatgatgtccttcgtgcgggtctcgcggatggtggactcgtattcgtcggacttggtggactcgatcatctccacgaacgcctccacggcgaacatgtaatgctgcgtggacacggagcacagctgtttgcggggtttcgcgttcttgtaccgttcctccagcagcgacgcctgatcgaggacctgacgcgcgtaggtgaggaattccgcgccgtccacggtcaacgcgatgccttgggaggaacgggtgaagatctcgatgccgagctcgttctcaagctccttcaccgaggagctcaacgcgggctgggatacgtacagctcgtgcgaggcctcgttcatggagccgcattccactattttgacgatgtatttcagctgaaggagggtcataacgcccatttataccagcgtcgctttacgaaacgacgatttatagcgcttcgttttgcatagtggacacgcggtcggtggatgtgcggcctacagcggacgatgatatgggcgcatggccgaggcccgttccgcgggacgcaggcgcacgtccgccgcgctcacacgcgcacgcccaaggattccaggtccctgcgcgcctggtcggcgtcgacgaaacggaaggcgtgcatgccggccgaccgcgccccggcgacgttcttcgcggtgtcgtcgaggaacacgctgctctcggggcttaggccgaaacggctcatcgccagttcgtagatgtcggcgttcggcttgtgcatcttctccacgccggagacgacggtgccctgcagcagttcggcaagctgcgggaacttctcgaatgcgaaatggaacgtctcatgggaccaattcgtcaatccccacacgccatagccggccgccttcagatcgcgcagcagccgctccatgccgggcagcatgcgtggcagcgcgtcgtcgtaatgcgcgatgtaataacggaagatcccggcgacgcgttctccctgctcggccaccacatcgggccatatcgaatcgaagtcctccccggcgtccatacggtcctcgtatccgaagaagccgcaggggtcgtcgtcggcgcagatgcggtcgacggtcgcgtcgtcgaatctgccttcaagacatgcccgtgtccgccaatccagcaacactccgcagaaatcgaaaacgacgtcggtgatggtcggaactgcaacggtcatcgggaaacccttcttgtagcgtgcgtctgtcttccgccagtgtaccgtacccatgttcgtgaaggacgttttcgtcttcgcatgcggcgtttcctgaaagtcattggggcggaaaggctcgcttgggttttgaaaaaggctaatctagacgttttcggcgattgtgatgattgtcatgccgaccatttcgaacatacaatcaatccgaaattaaatcaacatgttgtctgaatagacgggtgtcctagtggaaagcattaggaaggggccgacgatggcatatatcgaaatggtgcacagcttcaagcgctaccatatgggcgacatcacaatcaccgccaacaacgatgtgagtttcggcatcgaacgcggcgagcttgcgatcattctgggatcatccggagccggcaaatcgacggtgctcaacatcctgggcggcatggacacgaattccgaaggcaaggtcatcatcgacggcgtcgacatctcggacttcgacgcgaagcaactgaccgattaccggcgcaacaacatcggattcgtattccagttctacaatctggtggccaacctcaccgccaaggagaacgtggaactcgcctccgaactcgtcaagaacgtggccgatccagtgcagacgctggtcgatgtgggacttggcgaccgcatcgacaatttccccgcgcagctttccggcggcgagcagcagcgcgtggccatcgcgagagccgtggcgaagaacccgaagatcctgctatgcgacgaaccgaccggcgcgctcgactaccataccggcaagcaggtgctccgcatcctgcaggacatgagccgcaaacgcggggcgacggtggtgatcgtgacgcacaactccgcgatcgcccccatcgcggacagggtgatccgcatgcacgacgcccgcgtcaaatcaatcgaaaccaacgagcatccgatggacatcgaggagctggaatggtgaaacgcatgctgtggaaggacatccggcaaacactgtccaagtcgaaaggccgggtcgtgtccatcgtatgcctcatggcgcttggctcattcgcgctggtgggactgaaggtcaccgggccggacatgcaggcgaccgccgccgacttctacgggcgtaacaacctcgccgacatcaccgtggtctccaactacggcatctccaaagacgacgagaggatcatcggcaaggccgacggcatcaaggaagtcgaatacgggtacttcaaggacgtggtcatctccggcaccgacaggagcatgcgcatctattccaaacccgatgccgtctccacctatgacgtgacggaaggacgactgccgaagcggaccggcgaaatcgcgttggacatgaaagaacgcgacagattcgccgtcggcagcaccttgaacgttaccgagaaaacggacatcgcaggcggcaccgtgctacgccaccacaaattcaccgtcgtcggtttcgtccgggccagcgagactctgtcctgcctcaacatgggacaatccacggccggcggcggcgagctcaaaggctatgccgtggccgttccgggagagttcgattccgacgtgaagatgatcgcccgggcgacctacgaagacaccgagggattggactactggagcgccgaataccgcgatgccgtgcagaagcataaggatcagctcgtgacgttgctcgcgaaccagccaaaagcccgcgaagcgacgatacgcagccaacagcgcaagaaaatcgacgaggccaaggacaaagtcaaaacatccaaacagcagcttgccgacgcgcaacggcagctggacgatgccaaacagcagatcgacaacgccaaggaccagttgagcgaaggcagcgccgaggcagtggaggaagggtcggcggccgcggcccagctggccacggcgcaagcgcaactggcctcggccaacgcgtcggtcgcctccggacagacgcaactgcaggcggcacagacgcaactggctcaaggacagaaccagctctccgattcatggaaccagctggcgaacggcaaaacgcagctggacgcggcgcgagaacaactcgaaacaagcaaaaccgtgctcgacaaagtcggcgcgacgctcggcaaatgggaacagaccggcatcaccggcaaactctacgaacaaatacgcggcaaatacgacatggcgatcaaccagtacaacgaagcctgcgccgaatacaacagacagctgaacgcctacaatgcgggactgcaacaataccagaacgccgtagcgcggctcgaccaaggctcgcaggcgtatcggagcaatgcggacaatctcgcacaggcatccaaacagatggccgaaaaacaaaacgagctcggcaaagcggtgtcgcaggccggcaagcaagtcgcagacggcgtcacgcagcttatccaaggccagagggacatcgacaaggccgaaacggaataccagagcaaactcgccgaattcaacgcgcagaagcccgaagccgaacgcaagatatccgaagccgaacggcagataaccctcgccgaggagaagatcgacaatctcacagtcccggcctattccgtcagcggccgccgcgaaggcccgacctcgcaaggctaccgcgtgtacatggtcatcgaaggcatcgtggcgaaactggcggacatcttcccgatcttcctctacttcgtcgcggcgctcgtcaccttcagcaccatgggacgcatggtggacgaggaacgcaccaattccggaacgttgaaggcgctcggctacggcaacgcggatgtgatgctcaaattcaccgtatacggattcgccgcatccaccctgggcacatgcatcggcgtgctcgccggccacacgctgctgccgcttatcgtcgcccacgcatacagcgcgggattcaccatgccggacatcatgctcaaattccacccctggatcaccatggccgcattcgcacttgcatggataagcgccgtcgtgccgtcatggctggccgcgtccaaggaactgcgcgaaaaaccggcgagcctactgctgcccaagccgccggccaaaggctcgaaaattcttttggaacatttcccaccactatggaaccgtctgaatttcacacacaaagtgaccgcccgtaacatcttccgatacaaaacacgcatgttcatgacgatcttcggcgtatgcggagcggtattcctgctgacggccggcctcgccgtccaatcctcgatcggacagataggaaaccgacagttcgaggaactcatccactacgacctgatcgtcgccgaggaatccgacaccaacagcgcgcaacgcgaggaaatcgccacgacgctgaagggcaaaaccgtccaatcctcgacagcggtgcgctacgaggaactgtcgaaaaccgcaggcaaggagaacgataagcagtcgatcaccctgctggccatcgacgacgcatacaacttcaacgaatacctgacattacgcgaccgcaaaacacaccaaccacagatactggtcaacaatggcgcggtaatctccgaacggctcgccgaaatgctcaacgtctcggtcggcgacaccttcacggtaaacgacgaaaacggcgcgcaacgcaccatcaaagtcgccggcatcagcgaaatgtacatcggccatttcatattcatgaacgcgcaatgctacgaacacgtgttcggcgaccagtacagcacaaacgcatacatggtcggactgaaagaccacagcaacgccaacacggaacgccaaggcgccaaattcatgaaactggccgccgtgcgcggcgtcgtgcagaacacgacgcagaagaacatggtgtccacaatcgtgggatcgctcaaccagatcatggaagtgctgattctcgtggccgtgctgctggccgtggtgatcctctacgacctgaccaacctcaacgtgtcggaacgcatacgcgagctatccacgatcaaagtgctcggcttccacaccagcgagaccacgatgtacatctaccgcgaaacgatcctgctgtcactgctgggcatactcgccggatacggcttcggagaatggctgcaccgatacatcatcaccgaagtgccacccgacgaagtcatgttcgacctcgccatcagctggatcgcattggcggccccggccatcgtcgtggccgtggtactagccgtgctcggctggatcgtataccgccagctcgaaacggtggacatgctcgaagcactgaaatcagtggaatgaccctccacgaaacggtcagcggagcagctcgccaaaagcccggggaacagccgcgacgacatcaccggcaacaatcggatgcccgatcgcgctcgccggagtcttgcccgcatgcccatacagatgcggacgatgccatccgcgctgctccgacccgctggccatcgcgccggcaagcccatgcatatacgcggcggccgcggcgacctccggaaccaaagccggatcgtcggacagcatgtcgtcctgctgcgccagcaacgcgcccaacacgccggccagcacatcgcccgaaccggcggtggccatccaggcaggcgcgcgcccggacaggatgatccgcgtgttcccatctccatcagctccaaccacaatggtgaccgcgcccttaagcagcaccgtggcccccgtaagctcatgcgcgcgcaacgccgcccgcaatggccgggcctccacccactgcctggaaacaacatcagccatatcggcatccaaccgattcagcaatgcggccaattcgccggcatgcggagtgataacgacctgcggcacaacatggcacggcagcaaatccaacgcgccggcatcaaccacaatgggaggcatgccctccgcccgctcgttccgcgagccatcgccatcctccaacgcgtaatgatccagcagcgcggcaatggtcgcacgctgcatgtcatcaccggaagcaacgtcaccctcggcgggcacgccggatccaaccacccacgactgcacccggcccttgcccaacacagcctccggcaacacggccaatatcatatcctgcgcacgctgcggccccagataacgcaccatgcccacattcgcgcacgccgcggccctcgccgacaacacggcagcacccggataccgcgccgaaccagtcaccaaaccaaccaccccacgcgaatacttgccatccgcaagagacggaagacgaaccgaatccgccacaaaatcgccatccgtcatctcggcaaacggaacagcatcatcgacatcgaaaccgaaatcgaccaacgtgatccgtccgcaagcatacgaagccggcggcaccatcgcacacggcttcatcgcaccgaacgtcaccgtcacatccgcaggaatatacggccccggcaacgaaccatcatcaacacccacacccgacggcgcatcgacggccaccaccaacggcaaatcagcggaagggtcattgttcggcaacgcaggcttgtccggcaacacgccatccatacccaaagacgaagccaacgtgccagcgacaccacgcaacgcgccggccacgccaatccccgtcatagcatcaagcaccacatgcgcaccccgcgcacactcgaccgcagcctgcagccgctcaccagcctcacccgcggaaaaaccagacgtgcacccaggaatatcagccgccggatccaacaccaacacacgcccacccgcacgaacaaactccctaaacgcatcctcatgcaacgaacggccaacagcaaccgcggtaacctgcgcaccctcacgcgccaactcagcccccgcatacaagccatcgccaccattgtccccagcgccagccaacaccgtgacccgcgcatcctcaacatccaaatcctcatcatcaagcaacgacaacgtcacacgagccaccgcagaagcagccatacgcatcaacggcacaccatcatccaacaaaggacgctccaactgccggacaacatcggcggaataggaactatacaacaacgtctgcaaacggtcggcatcatcggagacatccatggaaaatccttcccctcggcgtggaaccacaaacaccactttagtcgtatattaaaaacaacaaacaaaaacggcatggacgccaaacaagaaaacggagcggaacatggcatacatcgaaatgaaaaacagcaccaagctctaccacatgggatccaccaccatcaccgccaacgacaacgtctccttcaccatcgaacaagacgaactcgccatcatcctcggcgcatccggcgcaggcaaatcaacagtgctcaacatcctaggaggcatggacaccaacacctcaggacaagtaatcatcgacggcaaagacatctccaactacacacccaaacaactcaccgcataccgccgcaccgacatcggcttcgtattccagttctacaacctcgtcgccaacctcaccgcacgcgaaaacgtggaactcgcctcacaaatcgttcccgacgcacaagacgcccgacaggcgctcgccgacgtagggcttgcggaccgcgtcgacaattttcccgcgcagttgtcgggcggcgagcagcagcgtgtggcgatcgctcgagcggtggcgaagaatccgaagattctgctgtgtgacgaaccgaccggcgcgcttgactacaacaccggcaagcaagtgctccgcattctgcaggacatgagccgcaagaagggcgcgacagtggtgatcgtgacgcataattctgcgattgcgccgattgcggaccgtgtaattcgcatgcatgatggacgtgtgtcatcgattgaggtcaacgagcatccgatggatatcgaagagcttgaatggtgacgttgcgacacgctgtgatacgtatgatttgcgtaaatggctgattcgtgtaatatatgtgacttgtgcacggaagctaagtcttccggtgggaacattcctgcgtagctcagttggcagagcatccgactgttaatcggacggtcactggttcaagcccagtcgcaggagcgcagtttcgggtactccggaacatattcctgcgtagctcagttggcagagcattcgactgttaatcgaacggtcactggttcaagcccagtcgcaggagctttttagcccttggttttccaagggcttttttgtttccgtaagaacttttcgctgctattccaacgaatcgagcacgtcgtcaatgagtgtgcggtcgtgtgccgcatcagccttgagtcgagggaagcgacgtatgacgttgtcgggacttgcgttggccgcacgtgccacattcgattttgactcgccatgcgccacggcgatttccgcgagccgatccactagcgaatccgaaacctgccgtatttgctcgccaacccataactgggacaattcgggtgaaagcgtgtaatcgtcctgcagctcgcttgaagcctcctgaatggcggcccatagcaccatgaatggcttgcggtagtaggcgatgcgttcctcggacggctcgctctccaactgctgcaatgccttgcgttgcgtagtgttgtcactcatgcgtcccatcgtatgccacgttcggtggcgttttggcatgtcatggcgcgacacgcccggcatctgtggataagtgttgttctccgaccacaaggtcgttccaagtcgacgggcggtcttcgaacgtgccatgatatcgattcccgatagagacgcggaccacaggaggcctcatgaacaaatgggaataccgtcgtcgtgttcgacacaataagatgtccgatgacattgacaagcgcaaccggcaccggtgcgccgcggcgatggccgtatgcgtattggcgaatatcgcgttcacgatatgctgcgcgcaacctacggcgtcggcatacgcgcaatcggctgatgacgtggcgcatgaagtcgcacaagcggcatgccgcacatcaatgcagtggcctttggagcacgcgcaagtaatcggcgaatatgatgcgccggctaaacaatggttgcctgggcatcgcggtttggatttgcgtgcacggccgcaagacgccatcatcgcgcccgcggatggtgtggtcgccttcagtggcaaagtggcgggcaaatccgtggtaacgcttcgccacggtgcggaaacaggaagcctgacgtcgacgtttgaacccgcggtcactacgcgaccggtcggggccgtcatcgccaagggggagcgtttcgctcgtgttgaaggtggctcggaacattgcgccgatggatgcctgcattggggcctcaagagcggaggacgtgattatgcggatccgtcgggcagagtgaggtcgatgcgggttgaactgaaaccgttgtaacggccatatccacgggtgttgtcgttgttcctggggtcgtggccttaaagaaaaagtgcggtattccggctatgatgctgtctgtacattagatttcgaggagcgagaagcttatgatcaaggaatacacgcgccctttggaacagggaattgactcggacaaaaacatcttctcagtacttgaggagcgtgtggaacgcactcctgacgacaatcttgtcgaatacaagaacgctcagggcgaatgggcggcgttcaccgctgcggagttcaaaaacaaggtcgtcgccctcgccaaaggacttatcgctcgtggcgtaatgcctggagattcggtatccattatcgcgcatacctgctggcagtggaccgcgcttgatgtggccatcatgtccatcggcgcccttaccgttccggtctatgaaacgaattcgccggcgcaggtgaagatgattttcaatgatgccaatgtcaagatggcgttcgctgaggatgatttccagcgcgacaaaatcgaatccgtccgtgatcagtgcccggatcttggcgacgtgtacgtcatcggacttggtgcaattgacacgatcatcgaatacggccgcgcggtctccgacgccgaattccttgaacgtgaacaagcggtcaaaggctccgatctagccaccatcgtatatacgtcgggatccactggcaccccgaagggcgttgaactgacgcatgccaatttcgtgttcatcacctattccggcgtcaactccatgccggacatcgccatgaaaccgaatcgtcgactgctgctgttcctgccgctcgcccatgtattcgcccgatacatgcagttcttctgctttgccggaaacgtttcactcggtctgtccagcaatctgaagaccattctcgccgatttcaaggcgttcaaaccgacgttcatcctcgccgtgccgcggattttcgaaaagatctacaatgcggcctcgcagaaggccggagccggtttcaagggacgtgttttcgctgacgccacccagacggcatgcgattggtcgcatgctcagcagtccggtgggagcattccactcgcgctgaacgcaaaacatgccctgtacaacaagctggtgtattcgtcaatcatggaagtgttcggcggccacgtcgagtatgcggtctccggcggagcgccgcttgattcctctatcgcgcatttcttcaacggtgtcggtctgtcgctattggaaggctacggcatgaccgaaacgtgcgccccctcgagtgtcaatccgaccgaaggctacaagatcggcaccatcggcttgcctctgcaaggcgtgaccatgggggtcgacgaagaaggggagctgtgcataaagagccctgccgtatgcgccggataccacaacaatcctgacgttaccaagcagcaaattgtcgatggatggctgcataccggtgatctcggctccattgatgatgacggcttcgtttccatcgtcgggcgtaagaaggatctcatcatcaccgcaggcggcaagaacgtctccccatgcgagatggaagcatccatcatgacttcgccggtggtgagccaatgcgtcatgatcggcgatcgcaagccattcatcgccgcaatcatctcccttgatttggcggagacgaacctatggctggaatccaagggagcggaacaggtcgctgatttggatgaagcctcgaagaatcccattgtgcgtgcggaagtggagcgtgccgtcaacaaagccaatgagctcgcctcacgtgccgaatcaatccgcaagttcgaaatcgttcccgacgagttcactgaggagaacggtttggtcacgccgagcatgaaggcccgcaggcaggcagtggttgaacattaccggacgttgatcgacaaggtcatctacgtgccgaggaagccggcggctcacgccgaatgatgttcgaaatatggtgggggccggtgacatccgagtgatgccatcggcccccaccatatccggaagaatcccggaagaatcccggaagaatcataggcccgcatccgccagcgaaatgtagccgggttcaatcagcgttttcttgagattgtcggcgctgatcgccaatgtctcctcatggatggtcgtaattttcttcccctcgaccgttgcggaacggatgaaaccgagtttggaaagtttgcccgaagtgttcagtcgcacgcatgtctgcgcgatgtcatcggccaacgccttgcggttctccatggcggtcatccattgcttgccgttgacgatgttcggcatggaactgatataggccccatagccggtgatgatcggccattttgcgttttccttgttatcggaatcgctgtcgtcatccgatgacgacgtcttcgcagggtcaggcactgcctgccgtttcaggtcttttttgcccgtgatgctgtccacgatgccggagattgagatggaagggttgatatcggctgaggaacctgtgtagccgagtttgtccaactcgtcggcgatgttcttcgccacatagtcgttgcaggagatgacgccatcaaggtggacagggtgcgaatcgtccttgtccgcgtcgagacgttcggcaagcaccgatttgatttgttcggcttttgacgaatcgaatgccacggaccgccagtcatccttggtggtcgaagcggtgagcgtctcggaaggagatgccgctttgccgtccttgaaatacggttcgagcactttccagatgcctttgaacatgttctgggcgaaggacgtgtccgttttggcatcatgtccgtcggccgcgtcgtaggggagtagtacctcgatttgcttgggggcatcggacgatgccttgtcgagctcgagcttgttgacgagctctttggcttgcagttctccaatctgctcggccgtggtcatcggcacgtacacgtccggcgcatacccttgaagcgtattggagatcagaacgaccttcattccttcattctgcgcaagctgcaacgccgaaaccagccgttgcgctgattgcgcataatcctgttcgtcctcatccgacgcgtcggagttccacgtgatatcatgccgtgcatagtcgccgtattgcctgtcggattccggcatctcggcgacaggcgccaccaccaaggtggttttggctttcgtggacgaatgctcggtcccgttgatgtgattcaccacatagtcttggacgctttgactttgtttgtcgaggttcgaagcggttttcacggtgatgtcgccgcttttgacaccggtccgtttcaacgaggacacgatttcgggaacgagtttttcccatttgctcaatggcgtctgttgagagatggtgatgctgtctgtcggagcgaaaatcgccacattgccggcatcggctgttgcgctggattgtgatgacggctgttgctgcgattgcgaatcaccgttgggcgagcaggcccccatggctgttgccatgcagaccgatgccagcagagcgagcagacgtttcgccgggattgtgcgatgcagaatcatgccatgtcctttgcggaagaatagacgttccttatactgaccatcgattgtaatatccggacgtcaaaaagcccgtacgcgtgtgtgattgcgcatacgggctttcgacagctcagatagattactctgccagagcctttgccagattctcgtcgagggcgttcatgaaaccctcggtatcgagccaaggctggtccggtccgatgagcatggccagatccttggtcatctgtccgccttcgacggtggagatgatgactttctccaaagtttcggcgaaatgcttgacttccggagtgttgtcaaggtcggcgcgatgcttcagaccgccggtccatgcgaagatggaggcgatcggattggtcgaggtcttttcacccttctgccaacggcgataatggcgggtcacggtgccgtgcgcggcttcggcttcgacggtctgcccgtcgggagtcatcagcacggaggtcattaggccaagggagccgaatccctgtgcgacggaatccgactgcacgtcgccatcgtagttcttgcaagcccagatatagccgccatgccacttgagggagcttgccaccatgtcatcaatgagtcggtgctcgtaggtcaggccagccgcctcgtacttgtccttgtattcgttttcgaacacctcggcgaacgtatccttgaactggccgtcgtacgccttgagaatcgtgttcttggtggacaggtacaccggatagccgcgcatcagaccatagttgaagcaggcgcgtgcgaaacctcggatggaatcgttcacgttgtattgcacctgggcaactccgccgtcagggccataattgtaaacgacgtgctcaatcggctcggagccgtcttccggagtgaaggttacggtgagggtgccggctcccggaaccttgaaatcagtggctttgtactggtctccgaaggcgtgacgtgccacgacgatcggcttggtccatcccgggaccaggcgaggcacattgctcatgacgattggctcgcggaagatggtgccgccgagaatgttgcggatggtaccattgggggacttccacatcttcttgaggccgaactccttgacgcgcgcctcgtccggggtgatggtggcgcatttgacgccgacatgttcgcgctggatggccttcgccgcgtcgacggtcacctgatcgtcggtggcgtcgcggttttcgatgcccagatcgtaataatccaaatccacgtcgaggtacggcaggatcagacggttcttgatgtctttccagatgacacgggtcatctcgtcgccgtcgagttcgacgactttgccttcgaccttgattttggccatggtttgtcctccctgtcggaattgaaggtgatgggttccgtcttattacatgtgtgttaattccgtatggaaatgtccaaaaccgtggggacacgcgcgaaggcactgtcatagctgagcattagccttgaaaccatgtctcaggaaattgaaatcggtttgggcaagaagggccgtctggcctattcgctggacgatgtctccatcgttccctcccgtcgtacccgtgatcctcaggatgtgtccacctcttggcaggtcgacgcctatgaattcgacgtgccggtcatcggcgccccgatggattccgtgaccagcccggccacggccatcgccatgggcaagatgggcgcgcttggcgtgcttgacctagaaggattgtggacccgctatgacgatccccagccgctgctggacgaaatcgcgcagctgtctgcggacaaggccaccgaacgcatccagcagatttacgctgagccgatcaagccggaactcatcgtcgaacgtctgcatgagattcgtgatgccggcgtcaccgtagccggcgcgctgtctccgcagcgtacgcaggattattattccaccgtgcttgaggccggtgtcgatctgtttgtcattcgtggcaccgtggtgtcggcggagcatgtctccaaggaccatgagcccctgaaccttaagaaattcatctatgacctggatgtccccgtcattgttggcggcgcggccaactacacggctgcgttgcatttgatgcgcacgggagccgctggcgtgcttgtcggcttcggtggcggtgcggtatccgccaaccgcaacacgattggagtgcacgcgccgatggccacagccatcgccgatgtcgccgaggcccgccgcgattacatggacgaatcgggcggacgctatgtgcaggtgattgccgacggcggtatgggtgattccggcagcttcgtcaaggcattcgcgctgggcgccgatgcggtgatgctgggctcgcctctggcacgcgcctccgaggctcctggcaaaggcatgcattggggcgccgaggcccgccaccagacgttgccgcgcggattccgcactaacgtgggcaccgtaggttccttgcaggaggtcatgttcggcccgagccataacgccgacggaaccaccaattttgttggggcgcttcgcagagccatggccacgaccggttatgtcgatttgaagagcttccaacgttgtccggttacggtcgcttcgagccactgatcagatagcttcgtcctgtggataaaaaagttatccacaatccctccgtcgacttgacgggggattgtctttatgtattaatgtttttggtccttctcagtgaagagagttggatgacattaaataggtaaagaaatgagggatccatggcaatggacgacttatctgacgatggcgtttcacctccggaatggcagtccggctctgagcgggagccggaagacgacaaggagatagaaggcaatgagcctgacgaaatcccaccgtcagaccctgattcgtatgtcggtcttaaagaagcggaaaacaatggccaatggctgcagtgcataggaaaatccgtcgagaagcttccttcatatgatgggtttttggaaacacaattatccggtatgcgggtgcccttccatgttatccggtccgattccacaccgtgggacgcgaagcaagcctattccttggcgttattgggcgcgcgcatgtcgtgcgatgccatcgacatcttccgtggtcggcaaaagccggcgcatgtagagcgtattctaacggaggactgtatgcgtaggcttaaaatcgcagcttccataataggccattatatgaaggaagacgcaaatctatatgccaagattggtctgcttcccatcaacgtgtccgccattaacggctggttgacttcgaccacgaaattcgaatgtgcggctttgctcaacatcggcgaaacgcggttgagatgcaacaccgcattcaggctcaaaggctccacgtggaagtgcgtcttggctgatttcgggtgatcgcattgatgcgatgatacggtaggaatctgcaaaaagcccttggcgtcgatgttcgcagtcgatgccaagggctttcagcgtgccttaagcatacgggaactactatagagaaccatgttgagagaatttgtaccagagccggcctacagcaccacggatgatgacacggtatatgcgttgctgtcgcgtcgtgcgcagaagaatccggatgatcttatcgcacaatggcaggatgatgagactcggcaatggcatgatgtgacggcaggccagatgctcgctcgtgtgcgcgccgtggcgaagggccttatcggtcttggagtcaaagccggaagcatggtggtcatttactctcccacctgttacgagtggggtgtggtcgatttcgcatgcgcggccatcggcgcggtaagcgttccgatttatgaaaccgattcggccaagcaggccgcttccatcgtggaagaggtggagccggttattgccttcgctggagattccgcccacacgcagacgctcgaacagattcgtgacatgcatgaagggctgcgttacgtgttcaatttcaaagcggacggtcttgacgcggttgccgatttcggagagggcgtcgatgacgatacccttgatcaggtcattgcccggatcaaggcggacgacatgctcaccatcgtttacacatcgggctccacgggacgtccgaagggtgcgatgctgtcccatcgcaacttcacgcatatcgtgctcaatggctacatcattcttgacgagatgctgtaccagcccaacaggttgatgctgttcctgccgttggcgcactgcttcgcccgctatatccaatacgtggcgattggcggacaaggcgtggtcggctatctgcctggagccaagcatctgctcgccgatctgcgcagtttcaaaccgacgtatttgcttggcgtgccacgtgtgttcgaaaaagtgtacaacgctgcctcgcagaaggccggtgcgggtattcgcggcagggtcttcgccaaggcgttcgatcatttcgtgcaatggtccaaggacgagcaggacgggggacatcattcgatggtggcccgagccgagcattccttcttcatgtccgtcgtcggcaagtccattcgttccgcgcttggtccgaacctgaaatatctggcatgcggcggcgccccgctgaacgtcgaccttgcccacttcttcaatggcatggatggcatcacgttcattcaggggtacggtatgacggaaaccgcggctccgatgatcgtcaactggcaaaatgcgaatcgcgtcggttccgttggtaagcccgggccgggtatgggtgtgcgcaccgatgatgatggcgagctgcaggtcatgggccccaatgtttttcttggctactacaagaatcctgagaagaccgctgaagtcaaaatgcctgatggttggctgaggaccggcgatctgggggccatcgacgatgatggattcgtgtatatcaccggccgcaagaaggacatcatcatcacagccggaggcaagaacgtcagccccgccccgatggaggacatcatcgacacctgtcctatcgtgtcccatgctgtggtcattggcgatggcaagccgttcatcagcgctttgattgaactggatcctgatatgactcgttcttggctttcccagcagggtcttgatgccgatatgtccatgaagcaggtagcggaaaacgatgccgtgcgcgctttcgtgcagcagtatgtcgaaaaggccaacgcgaacgtttcccgtgcggaatccgtacgaaaattcgagattctcgatgaggaattcaaccaacaggacggcaccttgacggcaagcctgaaagttgttcgtcccaaggtgctgcagcgctacgcagacgtcatcgaaaacgtgatttacgcgccaaaaccctccaacaggccgttgccgaagaccgtccagattctcgaccgcaccaccgaaaccgtcaagcaggcgtcggaaagcatgcggcaggcttctgaatccgtcagcccgaaggttcggcaggcatttgataccatgcaggagagaatcaagaagcagtccgatgaaccggatgacgagacggcaccgtccgtcgagccttccgcaaccaagaacaacgaggagcgttaattttggcaatccgtgagattcgagtcgtacctgatccagtgctgcgcaccccatgcgatcccatcaaggagatcacgcccgcggtgcgccatctggtgcaggatttgttggataccgttgatgacccgggacgcgccggattgtccgccaaccaaatcggcgtgagtctgcgtgcgttttcctacaatatcgacggcaaaatcggctatgtgcttaacccggtgttggaggaggccagcggagagcaatatggcgatgaaggctgcctttccgttccaggattgtggtacaagactcgtcgcgccgattatgctcgcgtgcggggcattgatctggacggcaagccggtagtgttggaaggccatggcatcatgggccgcatgctgcagcacgagactgatcatttggacggtcacgtctatcttgatcgtctggaaaaggaagaacgccgcgaggcgatgcgttacatgcgcacccatcgcaagtgatcgaaacagcgaacgacgattcaaccatggggccacgtcagaaagacgtggccccatggtatttttagtatttgtgcgccaatttggtgagaagcgctgccgcgagtgcttcaaaccgcccaattattgtcaaccggtgcgcaaccaattcgcgtcatgctcgcgacgacctgtgtcggtcggctgatgcctgcaaggcattggctgcacgcaggaacgcatgaccaggcaagaaccgacaaagaaagaggtagcaataccatggctcagatcactatgagcgacatgctgaaggcaggcctgcacttcggccaccagacccgtcgttggaacccgaagatgaagcagttcatcctcacccagcgcaacggcatccacatcatcaacctgttcaagtcgctcgacatgatcgacaaggcctacgacttcatcaaggccactgttgcccacaacggcaccgtgctgttcgtcggcaccaagaagcaggctcaggaagctgtttccgctcaggccacccgcgtgaacatgccgtatgtctccgagcgttggctcggcggcatgctgaccaacttccagaccgtgtccaagcgcgtctcccgcctcaaggaacttgaggaaatggacttcaccgacgtgcacggctccggtctgaccaagaaggagctgctgctcctcgagcgtgagaaggacaagctggctaagcagctgggcggtatccgcaacatgaaccgcaccccgtccgccatgttcgtggtcgatgtgaacaaggaagctctggccgtcgaggaagcccacaagctgggcattccggttgtcgccatcgtcgacaccaacgccgatccggaatccgttgagtatccgatcgccgccaacgatgacgccatccgcggcatcgaactgctgaccagcctcatggctgacgcagtggccgaaggtctgctggagcgttccggcaaggccgccaaggccgaaggcgaagccgagcagccgatggctgcttgggaaaaggagctcctcaccgagggcgctccggcagctgaagccccggctgaggctgaaggcgaaaccaaggccgagtgagaccatgctctatgatgggaggtgctatgcctcccatcatcggggcatcaccaaattttcagaggagacaaatcaatggcagcaatcactgcagctctgatcaagcaggtgcgcgaggaaaccggcgccggcatgatggacgtcaagaaggccctgaccgaagccgaaggcgatgtggctcgcgccaaggaaatcatccgcgccaagggcatccaggccgctggcaagcgtgaaggccgcaaggctcaggaaggcaccatcgcctccaccgttgtcgaatccgccaacggccagaccggctatgcggtcgagctgaactccgagaccgacttcgtggccaagaccccgaagttcgtggaattcgccggcagcgtgctcgatgacgccgtcaaggccgaagcatcctccgtggatgaggttctggcagcagcctccggtgacaccaccgtgaaggaagccgtcgaggaagccgctgctctgttcggtgagcacgtcaaggtaggccagttcgccaaggtcgagggtccgcatgtcgaggtctacgcccacaagaagtccgctgagatgccgccgagcatcgtggccatgattgccaccgatgaagccggcgctgctgtggctcatgaggccgctctgcagatttccgcgatgggcgcccagtggctgacccgcgaggatgttccggctgatgtgctggaatccgagcgtcgcgtggccaccgagaagaccacggaggagctcaagagcaagggcaagccggaggccgtgatcgagaagatcgctccgaagatcgtggaaggccgtctcggcgcattctacaaggagaccgtgctgcttgagcaggcgtacgtcaaggatccgtccaagaccgtcggcgacctgttcaaggaagtcgggggaaccgcgctttccttcgctcgtgtggaggtcggcaagggcgacgccgagtgaatctgatgtgaattgagctcacgctttcgaacgtgggcttggcatatctccaatgtccgcaatccaacaggattgcggacatttttttgcactaaaccccatcgtgttttggtgtctgtgtttgccgatagtcttgaaaacggtaaatttcatgggttttcgggtaagaaaggcatttcatgactggcgaaaacactggcgacaatccccgcagggtactgctcaagctgtccggagaggcattcggcggaggcaaagtcggcatcgacaccaccgtcgttcgtcgtattgcggaggaaatcgttcccgcggtcaagcaaggtgtgcaggtcgccatcgttgttggtggcggcaacttcttccgtggcgccgaactgcagcaggccggcatcgatcgttcccgcggcgactatatgggcatgctgggaacggtgatgaactgcctcgctctgcaggatttcctcgagcaggagggacaggccacgcgcgtgcaaaccgccatcaccatgggacaggtcgccgagccgtacattccgcttaaggccattcgtcatctggaaaagggacgcgtggtgattttcggcgccggagcaggcatgccgtatttctccactgacaccgtgtccatccagcgttctctggaaatccactgcgatgaggtgctgatgggcaagaacggcgtggacggcgtatacactgccgatccgcgcaaagacgagaacgccaagcgcttcgccacgttgagctataaccgtgcattggtcgacaatcttgcggtcatggatgctgcggcgctttccatggcgcgggacaacaagcagcgtatccgtgtcttcggactcgagggcgccggcaatgtgacccaggctttgctgggcgaggagatcggcaccatggtttccaccgcggaatccaccctcgccgagtgacgacattcaaagccgaatatcgattaaaccaacaatattaaaggagcaaacaatggcaactatcgtcgatcaggccaaggcgcagatggccaagtccgtggaatccaccaaggagaacttctccggtattcgcaccggtcgtgcgaatccggcgctgcttaacggcatcaccgttgactattacggcgcaccgaccccgctgaaggccgttgccaccatcggtgttccggagccgcgcaccttggcggtcactcctttcgatgcgtcccaggccaacgccgtggagaaggcgcttcgtgattccgatctcggagccagcccccgtcgcgacggcaacgtcattcgcctgaccatgccggagctgaccgaagagcgtcgcaaggaatatgtcaagattgccaagggcaaggctgaagacggcaaggtcgcggtgcgcaacattcgtcgcaaggccaaggaatcccttgacaaggccatcaaagacggcgacatgggcgaggacgaaggcgatcgtctgctcaaggaactcgacaaggtcaccaagcagaccaccgacgagcttgacgctctgctggaaaccaagcagaaggagatcatggaggtctgattccttcgaatctccataatcatcaatcgacgcacggtaccacaggagagaccacgatggaaaaacaggagcaacgcgaaaaagaagccgaagaggccattaacgccatcaacaagaaaaccggacgcaacatgccgcaggccatcgccacggcggtcgtcctgatcgccatcatcttggcatgcctgttgatcagcgttgatttgttcgtctatcttgtcgtgctgttcatggtgctcgcattgtgggagctgcgcgtcgatttcgccaccgcgggattgcatattcccgtggtggcgctgtgggcatgttccgcggtgactttgctggccacctactacagtaagcatcatattgtggctatgacggtctgtgtactggcctccttgctgcttgtagcgatcgccgcaagtgccaaggtgacgttcggcagtcggctttccctggccgtggcggacaaactgtcgcacaccgatgcaggtgctcgtctcgaatcgtcgttcaatcatgaacagggtgaagtgcgccacagccgactgagccatgtggcagtctccatgttcaccgttctgtacattccgctgcttgcctcctgcctgatcatgccgttgacgttcaacggtcatccggtggcacatgccatcatgcttgtcttcatgcccgcgctgagtgacaccggtggtctgtttgcaggtgcatggcttggcaaacataaactcagtccccgtatctcaccgaagaaatcatgggagggcctggcaggatccatcttgtttgccatggccggttcttttgtggtgatgttttgcacttacgagccatccgtttggacggttcgatggtgggtgcctattgtcgctggtttcatgatcggtatagccggaaccttcggcgacctatgcgcttccatgctgaagcgtgacattggtattaaggatatgggccatctgcttaaaggtcatggcggagtgatggatcgtgtcgactccatcctcctgtgcgctcctttcgtgtgcgtgctcctgtgggccaccggaatgtgagaaagggccaataaccgtgaattccatgaatgatcagccggaaacaggcatcactcctggaggcacttcgggcgccttccgggatgtgctgtcgaaagaccatgcccgccgtggcaagccgccactgcatttcgccgatatgtccgaagaggaacgtatcggtaaggccaaggaacttggattgccgaaattcagggtcaaacagctggctaatcattactatggccatttcgatgtcaatgcggaagaattttccgattttccggcggcaagacgctccgacgcggctgaagctttcttcccggaactcatccatgaggtgacacgccaagtcgccgatggaggcaccaccatcaaaacgttgtggcgcctgtttgatgggtcgctgatcgaatccgtattgatgcgttatcccaccagaaccacgctttgcatttccagccaggtcggctgcggcatgggttgcccattctgcgccactggacaactgggactgaccaggaacatgtccgcaggtgaaatcgttgagcaggttcgtgtggccgcgaaggccatgcgtgacggtgaagtggccggaggctccggacgactgagcaacatcgtgttcatgggcatgggcgaaccaatgggcaactataaatccgtcttgagcgcagtccgccaaattagttccatgcctcccgaaggcttcggcatctccgcacgtaacatcacggtttccaccgttggcgtggtgcctggcatcaggaaactggccgaagaaggcatcccagtacgtctcgcagtatccctgcacgcgccgagcgatgaattgcgcgatgaacttgtgcccatgaacaagcgtttcaacaccaaacaggtgctcgacgctgcgcatgattattatctggcttccaaacggcgagtcagcatcgaatacgccttgatgcgcggcatcaacgaccaggcggaacatgccaaattgctggcgaagcgtctgaaccactatggagatgattgggcgcatgtcaatccgattccgctcaatccgatcgagggatcgaagtggaccgcgtccaaaccagaagacgagcgtagattccttgagattctccataacgctggcatcacagccacactgcgtgataccagaggacaggacattgatggcgcatgcggacagcttgcagccaaagaacgtgactgattcctccgaaaggcccggttctgtccgctactcggaatccgcatgaaccgacgtaacgtattgcggttactcttgcaatcattgcaaccgttatgcgtgaaggagtagagcagcatgtcactggcggtccgagtcattccatgtcttgatgtcgatgcgggacgagtggtcaaaggcgtgcatttcgagaatcttcgcgatgcaggagacccggtcgaactcgccgcggaatactaccgccagggcgcggacgaactgacgttccttgatgtgacggcgtcaagctcccataggcagaccatggtcgatgtggtgagccgcaccgccgaacagatttttattccactgactgtcggcggcggcgtacgtacccctgaagacgtcgattccctgcttcgttgcggtgcggataaggtcggcgtcaacaccgcggccatcaatgaccctaccctcatcagtcgtgtcgccgaacgattcggcaatcaggtgcttgtgctgtccgtcgatgcacgtcgcgaacagggagaacgacatacgcagtcaggtttcgaagtcaccaccatgggcgggcgcaaatccactggcattgacgccatttggtgggtcaagcgcgcccaagaacttggtgcgggggagattctccttaattcaatggatgccgatggcacccaacaaggcttcgatctggagatgatcaaagctgtccgcaaggaagtcaaaatcccgattatcgcttctggcggcgccggcaaagcctcggattttccgccggcaatcgaggcgggcgccgatgccgtgctcgctgcctcgattttccattacggcaaagtcaccattggtgaagtcaaagacgccatcaaggcagccggatacaccgtacgctgaatagaaccacggaaactacgcaaaccaaccctgtagtactgaacaacgaatcgcaataccatcatgaccaacgaagcatacgacaacaccaccactctcgacccgcgcatcgcacagcgtctcaagcacgatgacaaaggcttggtcgcggccgtcatccagcagttcgataccaaagaggtactgatggtcggctatatgaacgacgaagccatcagacgtaccctcaccaccggacgcgtcacattctggtcgaggtccaggcaggagtattggcgtaagggcgatacgtcgggacatgcccagtatgtgaagtccttcgcgctggattgcgatggagatgccattctggtagaagttgaccaagtgggagcggcttgccataccggcaaacgttcctgttttgaagaaggcggacagctgcctgtggtcgtgggccatcgaaccaaagaacaggagggtcagcggtgagcgaatgcagcgtacagaccctcaagtggggtgctacatggccaagccgtgagcagttccatgaattggccgaccaaggctaccgtgtcatccccatcgtacgtcgtttgctggctgattcattgaccccagtcggcttctacgagcgtctcgcaggaggccgttccggtacgttcatcctcgaatcggctgaatttggcggagcgtggagtcgatacagcttcatcggcgtgcattccatagcgcagctgcgttcgaacaacggcaaagccgattggctgggacaggtgcctgtcggagtgcccaccgacggtgatgttgtcgaagtggcacatgccgcgctgaagacattgaaggctccgcacgtcgagggattgccgaatctgaccagtggcctcgttggtactgtcggatgggattccatccgacattgggaaccgacgctccgtgccgaagccccgaatgagaccggacagccggaaaccgttctggctctcgccacggacatcgcagtagtcgaccacgtgtctggctcggtatggctgattgccaatgctgtgaatgtcgatgaccgtccgactcgtgccgatgccgcctacgatgaagcgctggcacgtctggatgatatgcagcgcaaggctgccgcacccgtcgaaaacgaagcccgggtcaatgtgctcgacgagtcggtcggccagccccaactgcgattccgcacggagaaaagcgattacgaacgttccgttgaagaggccaaacgccatatcatcgatggcgatgtgttccaagtggtcatttcgcagcgactggatattgattctcccgccgatccgtttgatgtgtatcgtgtgctgcgtaccctcaatccgagcccgtacatgtatttcatggcactcaccgatgctcaaggacgtgatttcaacgtcatcggttccagcccggaaacactgatcaaggtggacaacggccatgccatgtctttcccaatcgccggttccagaccacgaggcgccactcctgaggaagatgaacgtctcgccaaggaactattggcagacccgaaggaacgcagcgagcatatcatgctggtcgatctggcccgcaacgatctgagccgcgtgtgccgtccggaaagcgtcgaagtcgtttccttgatggacatcaaacggttcagccatatcatgcacatctgctcaactgttaccgggcaggtcgatccgcatatgacggcgttcgacgtgttcacttccgccttccccgcggggacgctgtccggagcgccgaagccgcgcgccatcgagattatcgatgaacttgagccggccgaccgtggtatttacggcggcaccgtcggttattttgatttttcaggcaacctcgatatggccatcgccattcgaactgcattcattcgcgaccatgaagcgagcgtgcaggccggagctggaatcgtcctcgattccgtgccggccagtgagtggcaggagactcgcaacaaggccgaagccagcgttgaagcggtacagatcgccgcgcagcttcgccagttgtgagtcacattctgaccgttcaattgtgttgtgaaaggaagcagtaatgtctgtgctcgatgaattggtggcgggagccgtcgaggatcagcgatcaagagaaaacaacgtgccgctcgctgaggtcaagcggatggcgttcgaggcttcagcgccaatcgatgcgcgccagtggctgaaaaaggcggatggcattccggtcatcgccgagatcaagcgtgcctccccatccaaaggccatttgagcgatattccggatccggccgctttggcccgcgaatacgagcagggaggtgcaagcgcgatttccgtgctgactgaaggccgtcggttccttggctctcttgaagatttcgacaaggtgcgcgccgcagtgaggattcccgtgctgcgcaaggatttcatcgttaccgaatatcagatttgggaagcacgtgcgcatggtgccgatctggtgctgctcatcgtcgccgcattggacgacgtcaagctcaagtcgctgctcgatctcgcgcatagcctcaatatgacggtgctggtggaaacacacacccgtgaggagattcaacgggccatcaatgccggggccaaggtcattggcatcaacgcccgcaatcttaaagacctcaaggtggatgtgaacaagtacaacgaactggccgcggatttgccggacgatgtgattcgcgtggcggaatccggtgtgttcggttcggttgagcttgaggattacgcccgtgccggcgcggatgcggtgctggtgggagaaggcgtggccaccgcggccaaccatgagcaggcagtggaacgattagtaaaggcaggagcaagagtgaaggcatccgaacagaccccgttggcaagccatgaaggaccatatttcggacagtttggcggacgctatgttccggaagcgctgatcacggcgctcgacgagcttgaacgcgtgtatacggaagccaaggccgatccggaattccataaggaattggcgcggttgaaccagcagtatgttggacgtccgtccccattgactgaagcgcctcgtttcgcgcagaggctcaaggagaaaaccggtcttgatgcccgtgtgttcctcaagcgtgaagacctgaaccacaccggcgcccacaagatcaacaacgcgcttggacaggccctactggtcaagcgcatgggcaaaacccgtgtgatcgccgaaaccggtgcaggccagcatggtgtggccactgccacggtctgtgccatgctgggactcaagtgccgcatctacatgggacagatcgatgcccgccgtcaggcgctgaacgttgcccgcatgcgcatgcttggcgcggaggtcgtcgaagtcaccttgggtgatcgcatcctcaaggacgccatcaacgaggcgctgcgcgactgggtcaccaacgtcaaagacacccattatctgctcggcacggtcgcaggacctcatccgttcccatccatggtgcgcgacttccaaaagatcatcggagaggaagcgaaacagcagctgcaggattggtatggcatcgaccatcccgatgctatctgcgcatgcgtcggcggcggctccaatgccatcggcatcatgaacgccttcctcgatgacgaacgagtgaacctgtacggttacgaggccggcggtaacgggcccgaatccggtcgccatgccattcgattcgcgccaggtaccggtgaactgggcatgttccaaggagccaagagctatctgttggaaaaccccgaaggccagacccttgacacgtactccatctccgcaggcttggattacgcctccgtcggccccgaacatgcatggctcaaggatatcggccgcgtcaactattcctgggccactgatcaggaagccatgagcgcgttcaaggatctgtgcgaaaccgaaggcatcatccctgccatcgaaagctcccacgcagtggccggcgcgtacaaggcagctgcagacctcaaggccaaagggtatgagcatccggtcatgatcatcaacatctctggccgtggagacaaggacatgaacaccgccggcaaatggttcggatacctgaccgacgagcaggccaaagccttggaatccaacggcgcgcaaggcaacaacgcggacggcgagtgagaaaaggagcaaccatcatgacgaacgcaacatcatccacgccgtccggccagccactcggcatcagccacaagccaagcccgacggaaaccatgttcgatgaattcaaagccgccgacaagccggcattcatcggatatctgccatacggattccctgatccggattattcgctcaaagctttccgcaccatggtcgaacacggcgtgaacgcggtcgaaatcgggctgccgtattccgaccccgtcatggacggtcccgtcatccaggcggcatcgcaaatcgccatcgacaatggtgaaaaaatcgccaacgtattcaaagcggtggaaacagtggcgaacgccgggggagtgccattggtcatgagctattggaacctcatcttccattacggcgtcgaacgattcgcacgtgatttcgaaaacgccggtggagccggtctcatcaccccggatctcattccggacgaggccggcgagtggatcgaagcctccgaccgtcacggactcgaccgcatcttcctggtatctccggattccaccgaagaccgtctgaaagtcgttgcggacaatgcgcggggtttcgtctatgctgccgcccgcatgggcgtcaccggagaacgctccaccatcgatgcatccccgaaggaactggtcgcccgtacccgcaaggccggtgcgaaaaacgtgtgcgtaggcatcggcgtgtccaccgcggaacagggggctcgtgtcggatcgtatgcggacggtgtcatcgtaggctcggctctggtgcataccatgattgacgaatccggcaagcatgcagtcgacgaagccaccggtctcaaggccttggcggcgaagactgaggagcttgccgaaggcatccacaacgcccgcaactgaaccagtccaaagacaacatactggtagtccacgtaccatatcgtatacgtggactaccatcaggaaaccatgacacttgcttacattccgtcacccaccatttcgcagttttccatcgggccggtgaccatccatttctacgcgctgtgcattctgctcggcatcgtgctggcggtatggatgacaaccgttcattggaaacgatatggcggtaatttcgatcagattctcgacatcacgcttgtcgcggtgccgagcggcatcatcggtgcgcgtatataccacatcatcaccactccggaacgtttcttcggaccgaccggcgattgggtggagatgttccgcatctggaatggcggactgggcatctggggcggcgtcctgcttggagcgcttgccgcttgggcatggtgtcgtcacaagcattatccaatggctctgctcggtgacgccgtcgcgccaggattgctcgtggcgcaggccgtgggacgtctgggcaactggttcaaccaagagctctacggcgcgccgacgaccttgccttggggtttgaagttgaatatggagggaagcgccatcggtcacagcgaacaatgctatgacggagcgacctgcccgacaggcacgctgttccaccccaccttcctgtatgagatgatttggaatctcatcggtgctgcgctcatcgttttccttggttccaaaatcatgaaaaaactcaaggccgggtccttgttcgccatatacatcatgtggtacacggtgggacgcacttggatcgaggctctgcgcattgatttcgcgcacgagttccttggcgtgcgcatcaacgtatgggtgtccatggcggtgttcgtgcttggcgtggtggctttcatcgttattcagcagatgggaaagtccaccgagctgcttgccgagaagttgcgcaccgtcaccgagattgagctaagcctcgtcgaggatggagaaaccggtctcccgaccgcgaaggccaaccttacgaaaaccaaggatgaaatcacggcaaacgatggctcatccgtctcatatgccgatgaccagtccgacaacaagtaacatcaagtcgattaccttccatagaatgagaaccatgactattcaaatcgcacctagcatcctgtccgctgacttctgcaatctggaacgtgaccttaaggccatttccaacgccgatctcgttcacgtggacgtgatggaccatcatttcgttccgaatctgacgttgggtgagccgattgtagctcgcatctgccaagtcactgaccttccggtcgacgtgcatctgatgatcgaggatccggaccgttgggctccggaatacgccaagcttggtgcggcttccgtcagcttccatatgggagcgacgcatgctccggttcgtcttgcgcgtcagctgcgcgacatgggctgcaaggcttgcttcgcggtccgtccggccgaaccggtcgagccgatcttcgacatccttgacgaattcgacatggtgcttatcatgacggtcgaaccgggcttcggcggtcagaagttccttgacaaccagatgaccaaggttcgtcgtctgcgtgacgaaatcacccgccgtggcctgaagacgaagatccaggtcgatggtggcgtgagccccaagaccgcccatatcgttgccgaagccggtgccgatgtgctggtcgccggttccgccgtgtacggtgccgagaatccggccgaggctatcgactccatccgcgagaaggccgaagcagccttcaaggcgtgaacgcccaccatacaaggaagcatacgaatatgaagacttttgaatcgctgttcgcggaattgagcgagaaagccgccaccaagcaggccggttccctgaccgtcgacgagcttgccaaaggcacgcacttcatcggcaagaagatcgtcgaagaggctggagagacttggatcgccgccgaatatgagggtgctgatcgcacggccgaagaaatgagccagctcatctaccatctgcaggtcatgatgatcgatcgtggcatcacactcgaggacatctacaagaacctgtgagaaacccggggccatgccagttgaaggtgtggccttttttagaggagaaacatgctaagaatcgctgtgcctaataagggcatgctgtccgaacccgcctggaacatgctggcggaagccggctaccgtttgaggagcaaccctcgccagttggtcgtggaggatcccgacaatgatgttgagttgttctacctgcgtcccctcgacattgcggtctatgtcggtcgcggcaccatcgacgttggaatcaccgggcatgatttgctcgtgaactccggcaccgatgcggaggagcatatgcagcttggcttcggagcctccacgttccgtttcgcagccccgaacgattcgccgattaccaagcttgaggatattgaaggcaagcgagtcgccaccacattcgacaagctcgtacacgactatctggtcgagcatggcatcaacgcggaaaccgtgcaccttgacggcgccgtcgaatcgtccgtccagcttggcgtcgccgatctgatcgccgatgtggtttccacagggaccactctgcgtaatgcgggactgcgcattttcgctgaaccgctgatgcactctgaagccgtattgattcgttcccctcgtcttgaggcggatgacgagcgtctgacgattctgagcaggcgtctgcaaggcgtgctcactgcccagcgtaatgtgcttatggactacgacattccggtcgagaaggtgtccgccgcagtggatatcactccgggtttcgaaagcccgacgatttcgcctctgcatgataagcagtgggcggccgtgcgtgtggtggttccgaaggcgaaggtgaaccagcttatggaccagttgtatgaagttggtgcccgtggcataatagtcaccgcgttgcaggcttcgagaatgtagtgttgctcgtaatatgagcaaactgattattaagaagcaatacagtccggaaccgcgagacatctatttcacggttccgaacttcatcagcctgttgagaatcatttcgattccttttatcgcgatgctggtctctcatcacaggatggtgaccgccttggtcgtgcttgcgctatcggcgatatccgatggtttggacggactgatcgccagatcattcaatcaggtgagcaaaatcgggcaaattctcgatccgattgccgatcgtctgctgatcttctgcagcattcttgctttgggtgtggcgaacatcattccatggtggatgctgatcgtcgtcggcctgcgagatttgatcatggctgttctgatactggttttggcgcagcacgattatggcccattgcctgttcatttcgtaggcaaggccggtaccgcgatgctgcttatcgccatcgtcgcgttgatcttcgccgacatctggtccaactccgctgcggatacactgcatctatgcggtcttgccaccggaatctggggcgttggactgtattggcttgcagggtacatctacatgcgccaaggcatccaactgttgaagaacgatacaaacagcaaggattgacgcatatatgaagtccgatgctccacgtttcgcgtcgttccccgtttccccggagaacgtacccacaaagcatcgtgccattttttcgtcatccttcgccggcctgtcatcccatcatgtgcaaccggcctccatgcccgccatgccgcaacgccatagacatgtcgatgacgattcgcttcggcttattgacgatttgaccaatcgtccgatggacgtcctgtattcggactcccgcctggccactaaaaaacgttcggcggtttcgatttgggccaccaggattctggtgttcctcatctgcatcgctgtgggtgccgcgggaagcgttttcgtgcgccagctgagcactgacccacgcaaagaagtacgcaagcagttggcaagccagctgaccgaacaaacgaagcgggtcggcgacctcaccaaggacgtcaacgacttgcggtcgcaaatcgaatctgaatcggaatccttggcaagctggtccctaaaccagacgatgcaggatgatgaaatggtcaatggaacgcttccggtgcaaggggaaggcattgtcctgaccgtagccaacccgctttccgtcagcggcgacaatgccgactcctcactgccaagagaaaatggcagccaggttcgagtcgtcaccgattccgatttgcagctgcttgtctccttgctatggcaatccggagcggaggcgatcgcgatcaacggcaaccgccttggcgtgcaaacctcgattcgaactgccggatcgacgattctcatcggagtcaattcggtgcaaagcccatatcgaatcgaggcgataggcaatcaggcgaccttggcgaaatcggtaagcaagacaacgcagaaacaactgtatgacgatttcaaaaaggccggcatctatccgcagataagcaaaagcaaatcgattacacttgatgctgcagtggctggcgacacgacgcatgtgaggaaggacaagtaatggcagctgtcttgggacttatcatcggcgtggtaatcggtgtattcgttcgtccggacatccccatcgagctccaaccgtatctgccgattatggtattggccgcgttggatgcgttgctaggcgccgcacgcgcgtatttccaacgcagcttttccgataaagtgttcgtgatctccttcttctcgaatgtcatcaccgcgacgctgctggtgttcctcggcaaccagttgggagtcggctcccagctgcagaccgcagtgatcgtagtgctcggcatacgaatctttaccaatgtgtcctccattcgacgcttcatctttaaaggttgatgcggtatgagcggacaagacgcgaacagcaaggacatgctgtccagaatccatgagcagagggtcaaggaccagaacaatgacagcacccaaaccggtgcgttccccatggtcaaggccaagaagcgaatctcacttgatgcgaaggtcacacgaacccgactgtattccagcattctggtcacgatattgtgcgccttgcttggcttcggctatgtgatccagataaacaacacgacatccacctatgagacgatgagcgaagatgaattaaccaagctcatcagcgagaccaatgctcaggtccaaaagctcgaacagcgtaagaacgaactctccagccagctgaacgctttgaaagacaccgcggacaaaaatgagaaagccgcggaaatcgccaagcagaacgcgcagaccaacggcatcctatccggccgtctcgcggctacgggagaaggcgtggtcatccgcatatcgcagggttccaaacagaagattgactccgcgatattgttcacgttgcttgaggaattgcgcaacagtggtgccgaggtcattgagatcaacaatgtccgcgtggtaaccagcacttacatcagtggcacggccggcagtctcgtctgcgatggcaccaaactgaaatccccattcaccattcgcgcgatcggcgacagcgacaatctgcagaacgcggtcaatctggccggtggcgtcgggtcgcggctcaaagtgaagtatggcgctacggtatcggtcagcccctctgacaaagtgatgatcaagtccacacgtcaggctccgcagtatacatatgcgcacgtcatcggacagtaaacagtaaaggacctttcctttcgcgacattcaatcagcgttgttcttccgttcaccgaaatggcgtgccgttgtctgcgcttgaccctatcttgttcatcgttgatatatagtccaggcctgcacattggtaacgcggaccccgatagcaaaggacaactcatggctgaacagaccatctccatcacactcaacggcgaaaagaaggaggtggcggcagaccagaccggcgtccagctcttctccgacgacaagaacatcatcgcggtgcgtttgaacggcgaaccccgcgatctctataccgagctgcacgacggcgacgttgtggaacccatcgcgctcgatagcgaggacggtgtggccatcatgcgccattccgcaacccatgtcatggcccaggccgtgcaggagattcgccctgacgccaagcttggtgttggaccggtcatcaaagacggcttctactacgatttcgatgtcgagactcctttcactccggaggacctcaaggaaatcgaaaagcgcatgcagcgcattatcaagttctcccagtccttccgccgccgcgtggtgaccgaggaagaggctcttgccgaggaagccgaccagccctacaagcttgaacttatcaaggataaggaagcgcatcttgacccggaagccgccaccgaaatcagcggcaaggaactgagcttctacgataacgtcgaccgtgaaggcaatgtggtttggaaggacctgtgccgtggtccgcacctgccgaacacccgttacatcaaggcgttcaagatcgagcgttccgccgccgcatactggcgcggcagcgaggccaatccgatgctgcagcgcatttacggcgccgccttcgccaccaaggaggacctgaaggcataccagacccgtctggaggaggccgccaagcgcgaccaccgcaagctcggcgcggaaatggacctgttctccttcccggatgagatcggtccgggccttgccgtcttccatccgaagggcgcggccgtcatcaacgccatggaggactattcccgtgagatgcaccgcaagcaccactacagcttcgtgcagaccccgcacatcaccaagggcggcctgtatgagacctccggccacctgcagtggtacaaggacagcatgtatccgccgatgcgtctggacgaggagaaggacgagaacggcaacgtcatcaagcaaggcttcgattactacctgaaaccgatgaactgcccgatgcacaacctgatcttcaagtcccgccagcgttcctaccgtgagctgccgctgcgcctgttcgaattcggcaccgtgtaccgttatgagaagtccggtgaagtgcatggcctgacccgcgtgcgcggcttgactcaggatgattcccacatctactgcacccgcgagcagatgaaggacgagcttaagagcctgcttaccttcgtgctcggcctgttgaaggacttcggtctggatgacttctatctggagctgtccaccaaggatccgcacaagtacgtcggttccgacgagatttgggaggaagccaccaacacgctggccgaggtcgccaaggaatccggtttggacttggtcgacgatccgtgcggcgcagccttctacggtccgaagatctccgtgcaggcccgtgacgccatcggacgtacctggcaggtgtccaccatccagctcgacttcaaccttccggaacgtttcaagctcgaatacatcgccgccgatggcacgcaccagcgtccggtgatgatccaccgcgcgctgttcggctccatcgaacgcttcttcgcggtgctgcttgagcattacgcgggcgccttcccggcgtggctcgccccggtccaggtgcttggcgtgccggtcgcggacgagttcgccccgcacctgcagaagttcatcgccagcttggaagaggagaccgtccgttgcgagatcgacctgtccgacgatcgcttcggcaagaagatccgcaacgcatccaagtccaaggcgccgttcatcctcatcgtcggcgaagaggatatgaacaacaacgcggtcagcttccgcttccgcgacggcagccagttgaacggcgtgccggtcgatgaggcgaaggcgaacattctgaccgtaatcaagaagcgcgtccaggtcaacaccgcagacgacttcaaggccgccctcgccgactgagcgagaccggtggcaacaagtcgcacgcgaccatgaaccgtgaaacggcgcacgaatctcgacaagaggtttgtgcgccgtttctcattttctcatcgagaaggaagtaacacatgcttgagcatcttcgtgcgccgttcaaaaaactcatcgagccaatagccaaagcgttgatcgccataggactgaccgccaatgcggtgacggtgattggtgctgtcggcaccatcgtcgtggccatcgccaccggtgtgaccggatggctatttgggggagcggttgttctgactctgcttgtgcttgccgattcgttggatggctcgatcgccgcgcttaccacgggtgggaccgaattcggggcttttctcgactccacgctcgatcgcatcgctgattgggcgatgctcgtaggcgtgatcatcttctttcttatgcatcgtgactggtggcatacggccatcgacaacacgcctgactatacgagcatgatcggtatcgccgccgccgcggtggccgtgatgacatcgttcgtcacttcatatgcccgtgctcgtgccgaatcagtcggctatgaggtgaaaaacggcatcgccactcgtgccgatcgcttgaccatcattctggtgggcatggccatcaccggattgacgcgtcagggattgtggctcgccatcgccatgatactgttggccggattgggattagtcaccgtattccaacgcatcttcgaagccaagcgccaaatggtcataggggagaaaacatatcggcggtagtcacagccgggggcagaccccatccaaaagttcgaaaagcgaaatgccacaggttcgtattcggcattttgtcggcgaaccgctttagaatcatttcgtttgaaacatccgcaacctgcctaggagcattatgtcaggtcattccaagtgggcgaccaccaagcacaagaaggccgccatcgacgcgaagcgcggcaagctgttcgccaagctgatcaagaacatcgagatcgcagcacgtatgggtggcggcgatcccgacggcaacccgtccctgtatgacgccatctacaaggccaagaaggcctccatgccggccgacaacatcaagcgcgccgtcaagcgtggttccggtgaggaagccggcggcgccaactatgaagacatcgtgtacgagggttacgccccggcaggtgttggcctgatcatcgaatgcctcaccgacaaccgcaaccgtgcggccgccgacgtgcgttccaccctgaccaagggcaatggctccctggccaccactggttccgtgagcttcaacttcgaacgcaagggacagatcgttgttccggccgaaggcgttgacttcgacaacctgttcgagaaggccgccgaagccggtgccgaagacgtgaccgacgatggtgaggtattcaccgtcatcaccgatccgtccgacatgatcgacgtgcgcaaggctctccaggacgccggtttcgattacgattccgctgatctggtcatgatgccgaagaacgaggtcgagctgagccttgaggatgcccagaaggtctccaagctcatcgacaacctcgatgatctggacgatgtccagaacatctactccaactggaccgcctccgacgaggtcatggcccagcttgacgaggagtaatccagcgtgattattcttggcgtcgaccccgggctgactcgctgcggggtcggcgtgattgaagccggcgcataccgccggctttcttttatccacgtggatgtggtgcgttccgatccaaaaacctcccaggatctgcgtctgctggccatctacaacggcttggtggaaaaaatcgaacgatttgctcccgatgcggtgtccatcgaacgagtgttcgcgcaagaaaaccgtaacacggtgctgggaaccgcacaggcggcagggttggcgatgctcgctgcggcgcaacgcggcattcctgtggcgttgcatacgccgacggaatcaaagcttgcaatcaccggcaacggcaaagcagagaaaatccagatggaacgtatggtggcgcggatattgggattgaacacgctgccaaagccggctgatgcggctgacgcgctggctattgcgatctgtcacgcgttgcgtccggctggtgcgctgcaaggcggcgaacgcgaacagcatctcacggcggcgcaacgacagtgggcgcaggcttcgcaaaaagcagcgcgcagacaaggcgtccgcagaggcatgtaagctgtatcgaacagatgttctagacctgtgcgaaggagacgtccataatgattggcatgctacgtggccatgtggagtcggtagacgccgtatcggccattatcgaggtcgggggagtcggctatgaggtcaggatgccatccgccgacttggcttccatgcacgccggccaggaaatcaaggtctacacttcgttgaatgtgtcccaggacgccatcactttattcggcttcggcacgctggcctcgaaacgcatgttcctgcaattgcagaaggtcagtggcatcggaccgaaagtcgcgctatcgttgctgtccactttgcctcccgatcgacttgcgagggctgtggcggatggtgatgccactgcgttggccaaggctccgggattaggcaagaaaggcgcgcagaaaatcatcctcgaactgaaaggttccattgatctgagccagattgagggttcttccgcaaccgcttcgactcctgaagacactggggccgaacaggtcgtcgaaggtctgatgtctttgggatggcaccagcaggacgctgcccatgcggtgcagacggtctgcgccgataatcaaatcgagacgccgttgaacgccaaggatgttccacgcgtgctgaagctcgcgctgacatcgttggatagaggtagatgaaacggaccattatgacgaacactgatacattcgaacagccgaacaccggggcgaacgaggaatccctccgtatggtttccgccgcacccgtcggcaacgaaccggtcagcgacgaggagcttcgtcctcatatcctcgagggattcatcggacagccaaggctcaaagcgcagttgcagcttttcctcgatgctgctcgaaaacgtgacgttcctccggaccatatcctgcttgcggggcctccgggacttggcaaaaccactttggccatgattgtggccaatgaattggaagttccaatccgcgtcacttccggtcccgccatccaacatgctggtgatttggcttcgattctgagttcgctggacgccggcgaggtgctctttatcgatgagatccaccgtctgccccgtgccgccgaggaactgctgtacatcgccatggaggatttccgtgttgatgtgatggtcggcaaaggccctggagcttcatccattccgctgacattgcctcggtttacggttatcggtgctaccacgcgagagggcatgcttccctcgccgctgcgtgcgcggttcggtttcacggcgcatctggatttctacccgcatgaggagcttgaaaagctgattgagcgttcctccgcagtgttgggaatccagttggaggacggggccgctcgccaactggccatgcgttcccgcggcacgccgagaattgccaaccgcctgcttcgtcgtgttagggattgggccatcgtgcacgatctcgaatcggtgcgtcccgatgatgtcaaggaggcgttggcgctttatcagatcgataccgaaggtcttgaccgtctggatatagcagtgcttaaggccatcgtcaccaatttcaacggaggccccgtcggcttgaacaatctggcggccatggtgggcgaggagtcggaaacggtggaaacggtatgcgaaccgtatctggtacgtgagggcttcctcatccgcacgccgaaaggccgcgtggccacgcgcaaggcatgggagcatcttggtatcactcccgacgaatccgcatatgatgtcaatgagatgtcatagacttcacatcctgagtaatgtgttccggttgagaccctgactccgaggagtttattttggatatcctttttctcgttgttcttatcgttgtaatgttcggcatgatgttctggcagtccaagaaagccaagcagcagcaagctgaacgtcagaatttccgttctagtctgcagcccggcactgaagtgatcaccatcggtggcatcatcggcaaggtcgtttccgtcgatacggaatacgaggagatcgtcgttgattccgaaggatcgcaactgcgtttcggcttcaacgccatcagccgtgaatatgtccgtccggcatacgtgcatgatgatgaggtcgatgagaacggcaatccgctatccaaggaagacgagcccgaccagaagcctgtcgtcgacgcgactgaagagcccgcacaggatgccgatgttattcagcagcccattgacgagcagaagaacgattgatttctttgatttttagacggcgaaaatctcatttttgaggttttcgccgttctttttcgcacgggaaacctataattcaaagtgccgtaaaccaaggtagaaggaaaccactgtcatggcagcatcggatatcaccgtttcgggcttgaacaaagttggagccgaagacgcagcatatcttgtatcgaaaatacgtactattccgggctttccgaaggagggcatcctattccgcgatttcatgccggtgttggctgatgcgcgcgcgttcggtattttgatgggggcccttgaagcggcattgccagtagacgtcgatgatttcgacatggtcgtcggccttgaagcccgtggattcctgttcggtccagcgttggccgcccgtctcggaaaggggtttatcgcggtccgtaaagccggcaaattgcctccagaaaccatgtcgcaaagctatgacctcgaatatggtcaggcgtcaatggaaatcgaaaccaacgttgtccatgagggagtgcgcgtattgatcgtcgacgatctgatcgccaccggtggaaccgccaatgcggcgcgtagcctcatcgagaagtgcggaggcgtcgttgctggattcagcttcgtcatggaacttaccggtattgacggcatgaaatcgctaggcgattatccgacaagctcgctggtgtgcatgcctgcctgataactccgttttcgtcaaccattcagaacaaacaaccaaagggaatgatccatggatctctatgagtatcaagccagggaattgctcgaagaacagggtatcccgactcctaaggcaatattcgcccagaactcccatgaagtcgccgaagcggccgaccagattggatatcccaatgtgattaaggcgcaggtgaagattggacaccgtggccaggccggcggagtcaagctcgccaagacccgtgacgagtccattctcgcgtcggaagacattctgccgatgaccattcacaagcacaaggttagcggcgtgctggtggccgaggcgaagaacatccttcacgagtattacgtctccatctcagtggaccgatcctctcgtgatttcgacgtgctcgccactgcgaatggcggtactgaggttgaggaaatcgccaaagagcatccggaatccgtgaagcgtctgcatatcgatgctcttgacgatttcgatttggaagcggccaccaagatggctgaaagcatcggcttctatcatgccgatgttgatcaggccgcgcagattctgctgaaaatgtggcgttgcttcaaggagaacgacgccacgcttgtggaaatcaacccgcttgcaaaaatcggcgatccggatgacgaatcttccaagtcgttgtgcgcgctggacgccaagatctcccttgatgacaatgcatcgttccgccatgatggttggaaacgtttcaccgatccgatttatgtcgatccatatgagcaaaaagcccgcgaacatggactgcattatgtgcatctcaagggttccgtcggtgtgatcggcaatggtgcgggactcgtcatgagctctcttgacgcggtgtcaggcgcaggcgaggatcagggcacgaatgtcaagcccgcaaacttcctcgacatcggcggaggcgcttccgccgaagtgatgtcgaatagtcttggaatcgtgctgtccgacccgcaggtcgaatccgtgctcatcaatgtgtacggtggcatcacctcgtgtgaacaggtcgcgaagggcattctcgaggcgcttgacgaacttggcagcagcaagcctatcgtcgtgcgattcgatggcaatgcggcggcggaaggtctgaacattttggcccaagccggccgcgccaacctgcacgtcgctcagaccatggaggaagccgcacagcaggccgcacgtttcgcggccaaggaggttcgctgaaatgacgcttttcattgaagatggcgctccggtcatcgtccagggcatgaccgggcatcagggcatgacccacacggcccgcatgctcaaggccggcaccaacatcgtcggtggcgtgaacgcccgcaaggctgggctggacgtcaccttccctgaagccaaaaatggcgaggacgccaccattcacgtgttcgccaactgctctgaagccatcgaagccactggagccaaagcaagcgtcgtgttcgtgccgccgcgcttcgccaaggacgccgtcgttgaggccattgaagccggcatcgaactgattgtcgtcatcaccgaaggcattccggtggcggacagcgcgtatttcgtcgagttggccttgcgtaagggcgtgcgcatcgttgggccgaattgtcctggtctgttgacgctgccatcttctaaggacgccaagggctgcaacctcggcattattccagatggcatcgtgtcccgcggcccgttgggtttggtgtccaagtccggaacgttgacctatcagctgatgggggagctgtctgacatcggtttcaccgcatgccttggcgcgggcggcgatccgatcgtcggcacgaccttgcaggaggctttggaagcctttgagaacgatgaagccaccaaagccgttgtcatgatcggcgaaatcggtggcagcgccgaacaggacgctgccaagtgggcttccgaacatatgaccaagcccgtcgtggcctacatcgcgggattcaccgcgccggaaggcaagcagatgggccatgccggcgccatcgtttccggcggcaagggcaccgcgcaggataagaaagaagcccttgaggccgttggcatccgtgtcggtcgtactcccggacagaccgctgaaatcatgcgagaggtgctcgcttcccaatcgctatgatgacgaacctgaagtattggctgaaagggcttgccgtcgcggcagtgtccatgattatttacgccgttgccttgggctgctatatggccctaatgcttctggtcatatccatggaagaaggcggggacaatctctccgccttctcggtgcctcttaccgaggcgttggtgctgctcagccaaggtatcgggttcaagactgatgccatcacgttgacgattgtgccgttgctcttgacggtactgcttatcgcccttatcgcgcagctcgccagaagattcggcacgagtctgcgtggattcgcggccggtctggtcttttgggaagccgtaaacatcttcttcgccagaagcataaatatcgaaatcgttgattcgatgacgatgatcgccatcaaaacggcgcttgttttcatcctcggatatgcggtcgcggcgattccgaatgcgtcatggccccaagcctgtaccgaatggattcgatctcatgtgtcatcgccggtgcgaaagaccatggtcatcggttccgtcctagggctgctgctggaggcggcgtatctgctggtcggtctgatcgtcgttgttttttgggcaataagcaatcaatcatcgatagcgaagctatatgaactttcgggcatgcagaacgggtctcgtattcttaccacgatcagtatgctcgcatggcttccgaatctgatgatttgggctgtctcatggactttcggcgccggcttctcaatcggcgatttagccgaattcacattatggaccggacagggtgacgggctccccgccttgcctcttttcggtatgatgccacaggcggttgagacggattgggtgagaatcgcgctgatgtgcataccattggcatccgcttttgctaccggcatggtcgtcatgttgtttaataagggattccatatcagagtaggtgaatcaggacggaacatcgacgtcaaacgcgttgtgctgagttttgcctatccgattgctgctttttcgattaccagcgccgtcgtgtccgtggcttccagcttgctgttcgccttgggaaacggaggcttgggatcgaaacatcttgcgcacgtcggcgtagacgtgatcgcatcaacccgtaaggtgggacaacccaccgccatgggtttgttctccgcatggctgctgactttggtggccgtgagcatatttttcgccatacgctggatgatgaagcgtatacgcgaacgtggaaagagggagaccgcccccgaatccacggaaaacagccgtgaggaaacacgtgcgcttcgcacggtcgcctcgaacaacaataacaaggaggatcagggtgacaacaacgaatcgaccgatacgacgggctctggtatcagtcttccataaggaaggcatcgaggtacttgccgaagcgttcatcaaggcgggcaccgaggtggtttccaccggttccaccgcgaagcgtctggctgagctgggtgtcaaagtgaccgaggtctccgaagtcactggtttcccggaatgccttgatggccgcgtcaagacccttgacccgcatatccatgccggtatcctcgccgacatgaccaaccccgaccatgcctcccagctcgagaagtttggcatcaagccgttcgatctggtggtcgtcaatctgtatccgttcgccgacacggtccgctccggagctgacgaagccgccaccatcgaaaagatcgatatcggcggtccgtccatggtgcgtggcgcagccaagaacagcgccaccgtcgccatcatcaccgatccgaacgattatgcactcgtcgcctcccgcatcgagaacggcgagggcttctcccttgatgagcgtcgctggctcgcaggaaaggcgttcgcccatacggccgcctacgacgccaccatcaacgagtggaccgcgaagcattggccgaagccggcgtccatcgaacagccggtttccgaaggcgagaccgaagtgaatgaggccaagttcccggccacgttcacccgtacgtgggaccgcgcgcacgtgctgcgttacggcgagaaccctcaccagcaggcttcgctgtatctggatccgctcaaccagaacggcttcgcacacgctgaacagcttggcggcaagccgatgagctacaacaattacgtcgatgccgacgccgcatggcgtgccgtgtgggatttcgcgcctcagatcgccgtcgcagtggtcaagcacaacaatccatgcggtctggccatcggcgctaccgtggcagaggcgcacaagaaggcgcacgcatgcgatccgatgagcgcctatggcggtgtgattgctgcgaacagcaaggtcaccatggaaatggccgaaagtgttcgtccaatcttcaccgaagtcatcgtcgcgcccgattacgacgccgatgcgcttgaactgctccagaccaagaagaagaacctgcgtatcctgaaggtgtctgagcctccgaagaccaagacccagttccgtcagattgacggcggtctgctcgtgcagtccaccgatctgattgacgctccaggcgacgatccgaacgcgtggaagctggtttccggcgagccggccgacgctgaaaccgtcagggatctggtgttcgcatggcgtgccatccggtgcgtcaaatccaacgccatacttatcgctcacgatcaggcaaccgtaggcatcggcatgggccaggtcaatcgtgtggattccgccaatctgtccgtcgagcgtgccaacacgctggctgacggagccaaccgcaccaagggagcggtggccgcgtccgacgcgttcttcccgttcgccgacggtgccgagattctgatcaacgccggtgtcaaggccatcgtccagcctggtgggtccattcgtgatgaggaagtgttcgaggcggcccgcaaggccggcgtcaccatgtatgtgaccggtacccgacacttcttccactgagttcagtggaagcgtcgaccggcaagctgggagcgtcgcggcgcgataaatgacgtggcgtccgaaaccattcgctggtttcggacgccacgttttattattatgattgcgttccgtgcgcggacgcgcgttgacatataacgaaaggcctgcgatatgagtcatccctacgtttccgaagaccatgaaggcaagccgtggtttgaatggatcgttgcggcaatggtggttatagccacagtgcttgcggtcttaggccatgtaaaagccgccaccacggtaatcgcggtgacggccatcataacaggactaatcagactcgtaatgcgcgagcgtagtccttggaaagtccgttcagttggcttcgacgctttcatcggcatcggtctgggcgtcggactgttcatcctgctcgccctcgtgcccgtcggcatcgtctgacgcgtcgtcggctatggtctccagcgtttcggaatcctgctcggcttccgaaacgtttttcttggtgccgatcatggacgcgactatggccacaagcgagacgatggcggctgcgagaatcgggcagatccagaacacccacagctgctgcagaggctcttgggaaaggccctgattctgggcgaagatggcgatgccagtggcacgagccggattcagagcggcgcctgttaccggataggagattgcggcgccgacaccgtaggcgagacccatggcgatggcatggctggtattggtctttccggattcactggtggtgttgagcgcggtggcgacgatgatgatgcccgcgacgagttcaacggcgatggccagagtgatgctgaaggacacgccgtaattgccgagcgtggcataggagacggaattcttgtcaaaaccgttaatgaccggcgtcagccagattttcagcgttacctgctcggatgtcggcagcaggaagcggatggcggcgcctgcgccgataccacccagcacctgagcgataatatagagcactccgtcaagcacatgggttttgccggacagcatcgccgcaacggagaccgccggattgaactgggcgccggaaatcgtgccgaatatcagggtggcggcggcgtacaccaaacctgtcagcaaggcgatgaacgccatattcacgccgtagatcgcggaaccaagcgtgcaaatcgagtagatggcgaagcagatgatgaagcttcccaccagctccgcgcctgcgcgaagggccagtggcttgctctgttcttcctctgttacggacgttgcttcaacagcagtcatagtctttcctctgtcatatagtggacaagttgcggtttttatgaaagccgccaaacgactgccatactaccagcagtccctgtaagtattatccggccacgttgggagaacgatgccaaacgcatattctcgcgccgccaaggcgcacaatcatgacaatgaaggcattcgcctgcagaaacttctcgctcaggcgggcttcggctcgcgccgtaaatgcgaggaaatcatcaccgatggtcgcgttgagatcgatggcgagctgattaccgaacttggcacccgagtcgatccgaaacgtcaggaggtccgtgtcgacggttctcgcgtgcgtgtgaaccctaaccatgtcacgcttgcgttgaacaagccgaaacgcgtgctgagcgccatggaggatcccaagggacgctacactttgcgcgacatcgtcggagacaagtacgagcgtattttccacatgggccgtctggattatgattcggaaggcctaatcctcatgacgaacgacggcgaactgagccagcacgtcatgcaccccaaatatgaggtcgaaaagacctacatcgccacgctggaaggacgcatcagcggtcaggtgtgccgcaggctcgtcaccacgggcgtgaagctcgacgatgggtggatcaaactcgaccgctgcgctattctcgactccagccgcgaaagcacgttggtcaaggtcgtgctgcattcgggcaagaaccgcatcgtgcgccgtattttcggctcgatcggttttcccgtcaagcgtctggtacgcacgcagatcggtccgatcaaactcggcgacctgaaaagcggcacgtatcgcgtgttgtcgcaggctgaggtccgttctctatccaaggcggtgggactgtgatccgtgtagctattgatgggcctgcgggcgtcggcaaatcatccacgtccaaggcactggccaaatattatggtttcgcatacctcgacacaggcgcgatgtaccgtgcctgcgcctggtggtgcatgcacaaaggcatcgatttggatgccgaaaccatcgatgagcagctcgtcaccgaaaccgtcggcgaattcttcaccgacggccatttcgacatcagcgtcgatccggacgatccgaaggtgtacgccgatgacgaggacatcagcgaggccatccgttcttccgaggtctcttcgcacgtgtccaaggtgtccaacatcatccctgtgcgtcacgtgttgatcgccgcgcaacgtgcctacatcgcacgagaggcttcggtcgattccttctccgaaggcgccggtattgttgctgagggccgtgatatcaccaccgtcgtcgctcccgacgccgaagtgcgcatcctgcttaccgcgcgtgaagaggtccgtcaggcccgacgtagcggacaggccgtctcgggtgtgggtgcggaaaatgtcgcggcacgcgacaaggccgattcgaaagtcaccaacttcacatccgccgcggaaggcgtgttgaccgtcgacaactccgatctcaacttcggcgagacccttgacgtgctcgtccgtatcgttgacgacgccatcgaggaacaggaataccgccagtacgtttccaacctcgaaggctatgagctggatgaaggcgatgaggagctgatcgatggaacggcgttctctggtggcgaaagcaagaatggtccgaaaccggtcggcgtacttgccgtggtcggacgtccgaacgtcggcaaatccactctggtgaaccgtattctcggccgtcgcgcagccgtggtggaggacacccccggcgtgactcgcgaccgtgtgagctacgacgccgaatggtgcggcaccgatttcaaactggtcgacacgggcggctgggaaaccgacgtggaaggcatcgaatccgccatcgcatcccaagcgcaaatcgccgtgcagcttgccgatgccgtgattctcgtggtggacggtctggtcggtctcaccgacacggacgaacgcatcgtcaaaatgctccgtgccgccggcaagccggtgacgcttgcggtgaacaaggtcgatgatcgcgaaagcgaatacctgaccgccgaattctggaagatgggtctgggggagccgtatggcatttccgccatgcacggtcgtggcatcggcgaactgcttgacgccgcactcgactcgttgaagaaagcggaaaggacatccggcttccttacgccgtcgcatctgcgccgcgtggctctggtcggacgcccgaacgtcggcaaatcctccctgctcaatcagctggcccacgaggaacgcaccgtcgtcaacgatcttgcgggcaccacgcgagatccggtcgatgaggtcgtcaccgtcgatggcgaggattggctgttcatcgataccgcaggtatcaaacgtcgtctgcacaagctgtccggcgcggaatacttctcctcgttgcgtacgcaggccgcgatcgaacgttccgagcttgccttggtgctgttcgatgcctcccagccgatttccgaccaagacctgaaggtcatgagccaggccgtggacgcgggccgttgcatcgtgcttgtgttcaacaagtgggacctgatggacgagttcgaccgtcagcgtatggaacgcctgtggaagaccgagttcaatcgcgtcacttgggctcagcgcgtcaatctgtcggcaaagaccggatggcacaccaatcgtttggccaatgccatgcgtggcgccttggcatcatgggacaagcgcatccccaccggcaaactcaacgcgttccttggcaagatccaagctgcccacccgcatccgctgcgtggcggcaagcagccgcgaatcctgttcgcgacgcaggcgtccaccagaccgccgcgcttcgtgatcttcgccaccggcttcttggagcatggctatcgccgctacatcgaacggtgtctgcgcgaggaattcggcttcgaaggatcgccgattcagatttcggtgaatgtccgtgagaagaagaaacgcaagtaaccaccggaactgttagaagaggggcgtgcgcctggttcagaccatggcgcacgcccctctgccttattgaatctgggtcgttgccggcttttgctttcctttacgcacagcttaggccgacagcgtcagaacagaggatgttcatcctggttgcgtgttctgagataccccgttatggctctgcgcgcgagcgagcttaatgaaatgccgtcctgcttggccttggcccgcgccttatggcctacggcgtaggggagtttgatcttccattcgtcgccaagctgtttgcgcccgtcgctgttctttggcatgcgcccgatgccgaccgcgtctgaacagccatcggaatcgtcggacaagagtgccctgcgggtcaattcggtaagcgtgatgccatcatgccgagcgcgttcgcgggcttccaagccaagctcgcggggcaatcgaatcttccattcatcttcgggaagcgttgaatcgaacacatgggcgaattcgtcgacgtcgtcgaactgtggctgcgtgtcgttctgctgcaaaccgaatcacctctctgaacccatgcgttaatcgcattaaacggcaagaaacatgaaaaatatcgcaggctacatatttgcatgcgctcaagaccgtcctgacgtccagcttccggctccgatagatgccattctgaggggctgtatgccgcagttcactgcccaaacataacgaaaaacccgccgtttcaatactgtggaaacggcggggcgacgggctttcttggtcggaccagcgggatttgaacccgcgaccccttgacccccagtcaagtgcgctaccaaactgcgctatggtccgaacggtgcgaaaagcaccgaatatgaagtatagcataatctctacggtttttcaaacacatcgtgtcggaaagcgagtcgcatccattccggagagtttggcttcggatatttgagggttttccggcaattgctccaccggaagttcatgttggttctgtgtctaaatgcccccgattttggcggaatgtcgtattatggcataagcgcatcgaataacaacgcccgttcgaaagggagagacattgactgaggacgtattcgaatactctgccgcgaagatgcggaagcacggaatgaccgacatggccatcgcccagttccgtcgtctgtacgaggtctggcgcaatgaggaggccagcagttggattcgtgaggacgaggtcgaaccgctcgtcagcgttcccagcttccatgacgtgtatgagaccatcaatcacgacaaggccgttgacgcgttcgccaaaacggcgttcctgaagcttaacggcggtcttggcacttcgatgggactcgattgcgccaagtcgctgctgccggtacgtcgccacaaggcacggcagatgcgtttcatcgacatcatcatcggacaggtgttgaccgcgcggaccagacttggcgtcgatctgccattgactctgatgaactccttccgtacctccaaagacaccatgaaggtgctgcagaccaataagaaattccatcaggaagacatcccgatggaaatcatccagcatcaggagccgaagatcagcgcggaaacgggaatgcccgtcagcttcccggccaatccggaactcgaatggtgcccgccgggccacggcgacctgttctccaccatttgggaatccggtctgcttgacgcgcttgaggcgcaggggttcaaataccttttcatctccaattccgacaacctgggcgcgcgtccctcccgtacgcttgcgcagcatttcgagaatacgggcgcaccgttcatgatcgaggtcgccaaacgcaccccagccgatcgtaagggcggccacatcgtgcgagacaaggccacgggccgtctgatgctgcgtgagatgagccaggtccatccagacgacaaggacgacgcgcagaacatcgacaagcatccgtacttcaacacgaacagcatttgggtgcgtatcgatgcgctgaaagcgaaactcgcatcctatgacggcgtgcttccccttccggtaatccgcaataagaagacggtcgacccgaccgatccgaccagcgagccggtcattcagctggagaccgccatgggagccgcggtgtcgcttttcgatggcgcgacctgcgtatgcgtcgaccgtatgcgtttcctgccggtgaagaccactgacgatttgttcatcatgcggtccgaccgattccatctgacggaccagtacgagatggaagacggcaactacatcttccccgacgtccatttggacgcgcgctattacaagaacatccacgatttcgatgcccgtttcccatacggtgtgccttcgctcgccgcggcgaaatccgttgatatcgatggcgattggaccttcggcagggatgtgatgctgtttagcgacgcgcgactggaggatcaaggcgaaccaagctatgtgccgaatggcgaatatgtcggcccgcagggcgtggaaccggacgattgggtctgactttggacggccatgcaacacgaaaacgatgttttttcgtgaaataggcacaaatcgcttaaaaaacctctatcatagaatgttgtgtgcggcttacgaggccaagcacttaaaaagaaacgttaacgagacgtgaggactaatggctgagggaagtaacggtaggcgacgtttttccgacaaatggggcaagcatgagcttgatgtgttggctgtgctctcctcagcctttccgcaatggcttacctcacgtcagatcgcgcaacgtgtgaaggcgtatgccgattcgtacggagagctcgccgatcaagcggcgaaggccgccttcgccaagcaatttcagcgtgaccgcgccaagctcgccgccatgggcatcgccatcgaatcaaggcagccggaatattcctccaagtcagaagggcaggatttcgcttcctaccgtctgcagcttggcgatgagccgcgcgtgcgtctgctgttcggcgacgaggatctgccgattcttgccgctgcgaattaccttgcgcgctccatgtcgatttcctcggctcctgcgcacgaaccccagcacgcttcccgtaccgcgccgcgcgtgccgcagacgccgattccaggacttggcttggattccatcgcgccgggtcttggcacgcaatccattcccgacgagctggtcaaagtggtcgatcagcgacgtttcgccgccactgtggatgttgatggcgagcatctcaatgtcgcctacgccgactccgatgatctggccatgttcgtgctgtctcatccgggtgcgtccatagtgagccctcaggaggctgtcgacgcgttcaaccgccggctgcatgcggccacgcagttcgtgccggccgatgaatccaccggcaccgacagctccaccgtggtgtctccggaaatcaaccgcaacagcactgatgaggatgataccgaggaaggcaagggccgtccgaagaagaactccgcgttccagaccggtagtgaggtcgatcggcgtcttcgcctgatgctgttcctgtccgcccacatgggtgaggaatactctcttgaagaacttgcggaacgattcatcggcaggccgaagtccgatgacgaattgaagaagttcgtcaacatcattcataaggacatcaacacgttgaccacggtgtccgatgatggcgagatggccggaagccagttcttcgatatcgattggtccttgcttgacgcggaaggcatcgtctccgccacgaattcgctggggcttgaacgccttgccggcatttcccagcagtacctgagcatgctgacagcatcggtgagctatctcgcccactcctctttgcttccggacaagctgcgtgagcaggcggaatcgctgtacagccgactgcgccagcacgtcaagcctggcgacatgccgtggctgagcctgaccggatacgagatggaaccaaggaacttctccatcgtcaagagcgccatctccaaaggcatgctgctcgacatggaatatacggacggtgcgggccgtatacagcgcaagctagtggcgccagacaagatttttgtcgacgaaggcgtttactacgtggcggtatggaccgacgtgtccaacgcggcgcccgcggacaagatgaagttcgtcaagacggatacgaccatcaacaaggctactggcaagcctcgtatctggcaggtgcttcgcatctcccgcatcgagcatgcggagctggtcgaacccactgaaaaagtggaccttccggacgtgcccgcatccgaactgcgcaagtggagtttcgacaatggcacacctgccgtgttcataaccaatcaggacgacctgtcgttcatcgacagcctgtcgggagccaccgtcgagaaatgcggcgaaggcgagaaggtgcatctgattgtgtcttccgattcctggtatgtcgcgttctgcatcgcgcacgcccgtcatattactgccgtcgcgccggagacgttgcgtacgatgatcatcgcccgagcacagcatgagctgagcgtcggcgaccgagagaacgaagactgacgggggaggcgctatgccttggtggatttggctggtactcgtcctgttcatgctgacgatgctggtcggcggcggcgcatacgcatgcatccgcggatatcatgcgttcaaagatgccatcaaagtaggcggacgcatgtccaaacgtttcgaggccatgtccgagccgttgccgcaaccaaaggagaacacgtccccgttcttcacacgtccacttgaggacgcggccaatcgttatatcgacgctcatgccgaagtcatcagccgccgtgaggaaaagcgcgtccgtcatgcccggcagtgggcgcagtggaaacattccaacgactgattcgaaaaggaaccatgactcatcatcgtcgacatggcaataacgacaccggcacatacgatgccgagatgaccacagccctatctcccgcgcaacgctatgcggcgttcaaacagacgcaggccaaacgccaatcggtctcgtctcgtttcgcacggtccatgccattcgaattggacgatttccaagtcaaagccaatgatgcgttggaagccggcgacaatgtgctcgtcgccgcgcccaccggagccggcaagacggtcgtggctgatttcgcgatctatctggcccaagagcgtaacgtcaaagcgttctacaccacgccaatcaaagcgttgagcaatcagaaataccatgatctggtcgaaacgtacgggccggacagagtcggcctgcttaccggcgacacgtccatcaactccgaagccgacatcgtggtcatgaccaccgaggtcctgcgcaacatgctctacgagcattccatgacgcttgacgccttgcgttacgtgattcttgacgaggtgcactatctcgccgaccgtttccgcgggccggtgtgggaggaagtgatcatccacctgccccaaagcgtgagaatcatcggcctgtccgcaaccgtgtcgaatgtcgaggacttctccaaatggattgaatcggtccgtggcgacaccacgctggtggtgtccgaaaaacggcccgtgccgttggaacagcatgtgcttgttcaggcggacgaccacaccgaaccggaactcatcgacctgtatcgacgtgataaagacggcaatcagacagacaagctcaacgcccagctggtgagcaggctcgatcagctcgaccgcaaggccgcgaaacgtaggggagagcagcgccccgacagacgaaagggcggcaagggcggcaaatggaacgaccattcccgcagacccgaacgccatacgccacgtcgttgggccgtgattgatgaattgaatttcctcggcatcctgccgggcatctatttcatcttctcccgcaacggatgcgatcaggccgtcgaacaatgcatcaacgccggactcgaactcaccaccgatgacgaggtgcgtcgcatccgccgtatcgtcgatgagatggtcgaaggccaactcagtcaagaggatttgaaggctttgcatttctcgcagttccgcttcgccttggaggaaggattcgcgccgcatcatgctggcatggtggcgctcttccgccaaattgtcgaacgactgttcgaagaggggctggtgaaggtcgtcttcgccacggaaacacttgccttgggcatcaacatgccggcacggtgcgtggtggtggaaaaacttgagaaattcgatgggaccgggcatgtcggattgacgccaggggagttcacccagcttaccggacgcgctggccgacgtggcatcgacaccatcggccatgcggtggttgtggaccatcatggcttcattcccgccactgccgccgcgctgtccagcaagcgcgtgtacccgctgcactccagtttcaaaccgacgttcaacatggccgtcaacctgcttaattccagcgattacgagaccgctcgcatcacgcttgaccattccttcgcgcaatgggaggccaacgaatccgcctggcagcttgaagcgcagatggatacgttgcgcaaagcgttggacggatacgaacgggcgttcgattgtgagttcggcgacttcaaggagttcatgcggctgcgcatgcgcttgagcgacttggaaaagaacgaacgacgcaaactcaagcacgaggtgttccgcacgcagaaggcgcgaagcgaagcgttcaaagaccttgacaggagtatcgcggagcttcgcgaaaaagacagggaccatccctgccgcaaatgccccgatattcagaagcatctcaaatgggggcatcggtgggcgcgtgaaatgcgtgaattggaacgtgtgcagcaccgctacgattcacgcaccggctccgtggcacgtcaattcgaccgcatctgcaatgtgctgaacgagctcggatacctcgatcggcttgatgaaggcgcaaaagaacatatcgattaccggcttaccgaacgtggacagctgttgcggcacttgtacagcgagcttgatttggtgcttgcccaggcgatcgatgatggcgcgttcgacggactcgatgcgacggagctggccagcgccgtcatgtcgttgatttacgagccacgcagaggcagcgggggagagccgcgccattatcccggaggaatgcaggggaacgtcgccgtctgtgcggcgcagctcaaaggcgtgcacgcgtcgattgccatgctgtgtgaggactatgccctcgacgagccgcgccaacttgatttcggcatcaccgatgtcgtctacgaatgggctcagggcgaaagcctgtcgcgtgtgctgtacggcaccgatttgaccggcggcgatttcgtacgcggatgcaaacgtctcgccgacgtgttgcagcagatcgccgtggccggaccatacctgggtaaacgcgccgaaacgctcgctccgattgcgaaacaggcgtacgagaacgtcaaccgtggcatcgtcgcctattcaggtgtcgactgagcatgtgcgcaatcgggagatcggttttcgcggacgccgggaataagtgacacgtccgaagtgttttgtagcttagagtaagcagataatcaaggaggcaaaagcaatatggcggaacgtagcctgcgaggcatgagcatcggtgcgaagtcgcttgaatccgatgacaatgtggattttgcggcgcgaaccgacgtcgcatacgtgtgtccgaaaggccatcgtacgattctgccgttcgctgagggcgcagaattcccagatgagtgggagtgccgctgcggcgccgtcgcgcaccgtgaaggagacaatgacgacgaggctgatgaaatcgccaagccgacacgcacgcactgggacatgctcatggaacgtcgtaccgaagacgaactgaaggctttgctggagaagcgtctgcaaatgcatcgtgacggatggttcccggactacgagtgacctgcagttgaacgacacttgaacgaatgcccggtcattgagaccgggcataattgtttctgtcatcaattcttatagcacacaaccaaggggagaatcagatccatgtccgaacatccgaagaaagtcgttctgcttgacctcgatggcacactgacgaaatccgatccaggaatcattggctgcgttgtcaaggcgttcgaagagatgggatatccggtgccggacgatgccgaattgcatcgtttcattggaccggccatcagcgaatcgatgcaacgcaacggcattccggatgacaagcttgacgaaggcgtgaggatttaccgcaagtattacgccgacgaggccgtgttcgacgacccgaacaatcccggacagaaagtccccggccgcctgaacaacacgatttaccaaggtattccggagcagctcgccaaactgcgtgccgacggatactatctggcgattgccagctgcaagccgcaataccaatgcattccgatttgcgagcatttccacttggacaccatggtcgacggcatctacggtgccagcgaggacaattcccgtcttgacaaggaccaagtgatccgttgggctttccagcacatcgatttcgacgagaacgcaggagacaaggcactgatggtcggtgaccgttggaccgatgccgacggcgccaaggcgtgcggtttggactgcctcggctgcggctggggctatgcggagcccggagagctcaaagcccatggcgcataccgtattctggattcggtagatgaactcgcgcaggccgtcgaggagtatttcgcctgagtccgtaaacggaaacgctgtaggccagttacgtggttgctgtcgcaatatcgtggcagcaaccacgtttttatttattgagtgacggaggccgttatgtcagaaccgcgtgtttgacgcttcctcaagcctggaaaacgtcattcctgaaaagccgataatgtacgttatgtcagatttctatttgacggcctgattgagcttccgctccatctcgctgtgcatgccgtttcgggcctgaagatacatgaaaacaagttccgctgcgatcagcatggccatcaccgcagccgacggccatccgacatgttcgtagaaacgccggaacttcgccgagaaatccgacctgaacatcgcatataccggatatggcaacgcgccaatgaccaatgaggtgaaatgcagcgcgatgatcgaccaacgcaccggatgcacatcgcggtgtttttgggaaaacagattgcctcgaatcgcagtaatcgaacaaatgttcactgcgatgacggcggctatgatccacaacagtgccggcagaatatcaagcatgcgctactcccctgcgggttatatcgttcgaatgttccgggctgaatcgtaccaattgtatgcgatcaggctgctgcgcgggatttgcgccgcgattccagcttctttctcatacgtatcgcggcaatgtcgtcgattggccttattggtgtctgtcgatgccggcgtcttcgtcaaatcgacatattcctcatgttctagagcctctttgatctgatgccatagcgatccgacggacaccccgaacacagctctgccgctttgtagcagagccaccatctgttcgctgtccgtgcactcatgcacattctgcccatcgcacatgatggtgatgccggccaactgttcgggcgtgcgctgcgcgaggaagccgatggcggtggtcacgttctgcagattgattccggcatccagcaatcttttggaaacggcaagaatcaccacatctttgaacgaatacaatctgcgtgagccggatccgtgcgacggggtgatggatggttccactatctgtttacgcgcccaatagtcaagctggcggtacgtgatacccgccacttttgacgcgaccgtaccacgatagccccgtgtgacggactgcgcgtccgcggaggggaacaactccccctgcaccgcgtgcgacacgtgcagatgcaaccgcattgttggttctgcctcgccgtccattgtcttctcctacacgccataaaacaatcgcctatgagcttccattcggagcccataggcgattgaaggaaaaccgttactcacagtttatcccgcatcgggcgtttcattaggcaatgacggccttgttggtgaaatatacgagacggaacttgcccagaatgatttcgtcgccgttcttcagttcctggctatccactcgttgacggttcacgtatgtgccgttcaggctgccggcgtcaatcaccgaataatttccgttaatcctgcggaacaccgcgtgcgtgcgggagacggtggaatcgtccagcaggatgtcggaactcgggtcgcgtcccacggtgatctcgtcctcgtcgaggagataacgcgagccggacaccgctcccctggtggaaatcaggagcgccgtgccgtcggccagacgcatgatcgtattgaggtcctccttcgtcagaggacggtctccggtggaagtaaccggtacagtgatagcaggaagaccaatgatggtcgtttcgcctgcgcttggaatcggatcagtcatagctgtcattctaccctctccccttgcaattggccggtattgtggccggcatggtcacgaatcatacactgtgaacggtatttaccgttcgttcttgtcgatgatggatacgaattcgtccttcggcagcatgtcatcgtagctgcgccagcgtcgttccagttcgcggttcgcctcatcgtgttgtttctgccccagctcggcgtacgctttcaattcgttggggcccatatccttaaccggttggttgaggttcaattgtctctcgttcacaataggcaattgtagccgcttgccggggaacaaaaagcctggaacgcttttaatcgcgttccaggctttttcaagaaggattcagtgtgtggtgtccaaatcagcggcgggtgtcgatgatctcctgcagagcgccgttgacggaagaggagccggcagccgaagacagagcgttgatgccgctgacttcgaagccacgcatgattgcggagaagatcttgttcttgttcatgatgtttccttttcttgctggcgtgctgtgacgcaccttgcgtcttgtttgttttcttttctgtttacgatactcattttagaaatgcgtttggcaaaagtcatgcttctctcgtttgattctttgtattttcatcggcaattcttgtgtaatgtggtgaatcgtttttcgtcgatcgctgtttttgccggcgcgtcgatgcttgcattcttatctgacgaagtagcgtgaaaaggaatggaaacaaaaaaccggcaaaaccgagctgtgataacggtgggtgatataggaatcgaacctatgaccccttccgtgtgaaggaagtgcgctagccgctgcgccaatcacccagtcttaatttgtacggagcaatgctccagtgggcgatacaagattcgaacttgtgaccccttccgtgtcagggaagtgcgctacctctgcgccaaccgcccgggtcatgccaacatgcgaaaactaatctcacatgatgcgaggtgggtacgagagtcgaactcgtctatacggctttgcaggccgctgcctaaccgcttggctaacccaccataaaggtcgataatcaatcggaaccttagagcggacaacgggactcgaacccgcggtctcaaccttggcaaggttgcgctttaccaactaagctatgtccgcatgtctccagcagattcactgcgtgagcacgagtatctactataaccacattcgtgtaatttgcaagtcagcgtgtcgcggtttggtttattcgtattcaccgatggctgaagcgcgtgtcacaccacccgttttcggtatacattaaaagcatgtgtgaggagagcgcaatgcccaagacgatacttatcgccgcattcgaaggatggaacgatgcaagccaagcggccacgaacgtcgtccgtcatttggtgtcccggtatgagtcgcaggaagtgcgccatattgacaacgaaggtttctacgactatcaggtggcccggcccatgatctgctccgtgcaggggcgtaagcgcatcatctggccgcaaacgactttctatgacattgccgtctcccccatgctgcacctgcttgcgcagatcgcacccgaacccaattaccggtgggaggaatactgcaggcagacgctacgtgtcgcagaagactatgacgtaagtgatgtcatcacgcttggctccatgttcgatgaatgcccgcacacacggccattgccgcttgacatctccaaaagcggctgcgaatgcgaatccgacagggaatacaacggtccggtgggcatccccaacatccttgacgccttcgccgccgaagcgggctttccgacaacatccatatgggtatccgtaccgcattactatgccaataccgaatgcatgcaaggcactttggagctgctgcgcgccttgtctttaataatcgagtatccgcttattgaaggagatttgaccagaaaggccatgcaatggcgttctgacgccgatggattggtgtcagacatgcatgccggcgactatttggctcgtctggaacatgattacgatttggacgcgagagcgaagcgaatcgcctcgaacggcatgcctgcctgcgaggaactgcttcgtgaggccgaatcacttctacgcaacggcgtctgagtcgttcccctccaggaggaggtctcagacgaaaaaaatcccggccgccttacggatggccgggattcgctttatttacgccgaatcacgcttacgcggcggcaacgacttccgtcgggtgcagcacgccgcagatcagcagcagagccacgacaacggccagcgcgatgcggtagatggcgaacgccttgtacgagaaagtggacacgaacttcaggaagccgatgatcaccacatagccgaccacgaacgccacgatggtggccgcgatggtcgcaccccagcccgggaacattcccgcattgcctgcggccacatccttgaccgcggaaacggcttcgaggatgcccgcgccgaacacggccggaatggccatcaggaagctcacgcgcactgcagcctcacgggtataacccatcgcacggccgaaggtgatggtgccgccggaacgggaaacgccaggaatcagagccagcatctgaccgatgccgaagatcagcgcatccttccaggtcatctcatccatggtcttgacctgcttggcgcgggcgtcgaccacccacagcagaataccgaagataatcagcacggtaacggtgatccacagattacgcagcgtgctttcgatggcgtccttgaacaacagaccggcaatcagaatcggcagcgtgccgatgatgatgaaccaacccatctgcgtgtcgcggttatgcgcgcccatacggctcttgaagtccttgccctccttgccgaacaaggagccgaaccacgcgccgagaatgcggatgatgtcatgacggaaatacaggatcacggcaagctcggtgccgatctggatgatggcggtgaacgcggcacccggatcggagcccagcatcaaatcgccgatgatacggatatgggcgctggaagagaccggcaagtattcggtcaacgcctgcaccaggccaaggaaaatcgcttggaagaaattcatgaaccctctttatgttcgtagaaatatggtttcgtctgcttttccgtgaccaagagtagcgagaggggtctagttttcaaggcatcccggcatagttgtctcaaaccatgcacacaatggagccaaaagtacgccggcatgtccggcatgggagaaaggctcatcggcatgggcaaataccgcaaaagcagggcattcagccccgaaggtttctttgaatgcgagggacgtggcctcaaatggctcggcgaggcgcaatcgcagggcggcccacgcgtggtcgacgtatacgactggggcaaggattatctcgacattgaacgcgtgaacgcctgcggtccgaccatccaagccgcgcgcgatttcggtgttgcgctagctcatatgcatgatgccggtgccgaacattttggctccgctccaactggatacgacggcacctgctatttcgggccgttgcaggatcccgtcccgatgaatgccggtgcctgggatgatgtggccacctatctggcggacggcagattgcgtccgatggtacgactcggcatgaaacgtcgcgaactgaccgactatgacatggaactgactgaagccgttatcgacgccttgcccgacatcctaggcaaggccgccaacgacaagcccgcacgcgtgcatggcgacctgtggagcggcaacgtcatgtggactgctgattccggtgacgtcgaagccgtgcttatcgatcctgcggctcacggtgggcaccgtgaggaagaccttgccatgctcgacctgttcggcatgtcatatcttacggacatcctcgaaggctatcagtcggcgcatccgcttaaggccggatggcaggaccgcatcacattgtggcagctctaccccattgcaggacattgcgtgttcttcggtggaggatatgtgagccggtatcgcgccatgtgcaggtcgctgctcaaataggcgggaatcacccgtcacgccagatgtgaaagaagtccgtatcccaaggttatgagttgggatacggacttcttttcatatgtcccgtattcgattggattgcgaaaactagcgcagcgcgtccttcagcttggagaagaaccccttcttcgcgccggacgacggacgggacttcacggcaacatgctgggcgtccgtgtcgtgcatctcgccgaaccgctcaatcagctcccgctcgtcatcggacagcttcttaggaatctccaccactacgtgcgccaccaaatcgccgcgctcgttcttgtcgtcgagatgcgtgacgccgaggttcttcaacgtcacggtatcgtccggctggctgccggctgggatatccagcgtctgcctgccgtcgaaggtgtcgatttcgacttcgtgccccaatacggcccaactcatcggcaccttgatccaacaatgcaaatcgtcgtcatcacgagtgaacatgtcatccggcttgatgcggatatccacatacaaatcgcccgcgacgccgccattttcgccgacctcaccctgattggcgagacgcagacgggtgttgttcgccacgccggccggcaccgcgacgccgacattgcgggtgacgcgcacgcggccatggccgaggcaggacgggcacggcttctcgatgaccgttccatggccttcgcagcgttcgcatggcgcggtggtcatcatctggccgagcatggtgcgtaccacgcgctgcgcatatccctgaccgtggcagtcgggacattgtgtgggctgtgtgccgttctggcagccggtgccgccgcattcctggcacaggccgaacgtgttgaccttgacgtgcgtggtgtcgccgaacaccgccgtcttcaaatcgatggtcgcggaaacaagcgcgtcacgccccggctgggtgcgcggagtcggtccaccgccggtgccaccgaatccgccaccggtgaacatgctgaagatgtcccccatatcgccgaatccgccaccgaatccgccgccgtgcatgccgcccgcattcggatcgttcggatcgacgccggcatcgtacatctgccgtttcttaggatccgacagcacatcgtacgcgttgttgacttccttgaacttgtcttcgaattccggacctgcgatgtcgggatggtatttgcggctcatctttcgatacgcctttttgatctcgtcgtcgcttgccgaacggtcgacgcccagcacttcgtaatagtccgtcacgattattctttctccctgttggttctgcgtgtcattgtgccataaggcggggtcagtcggccggctgaccttcatcgtgggcgaggaacgccgtcagatatctggcgaccgccctcacggcggccatggtcgccgcgtagtccatatgagtcggcccgatcgatccgacgaatgcgaccggttcgcccgcctgccgcgtatcatcaccgctttgattttccgtctgtgatgatgcggccgcatgcgtcgcgccgtccgtggcggccgcggaggtacgcccgtagccactggttaccactgaggcgtgcagcaaaccgggcgtgtgcgtttcggaaccgatcgccactccgacgccgtcggattgcgtggtttcgctcagcgagctcatcaacttcatgagcaccacctgctcctccaacgcgtcgaacagcggggccaggtcggccaccgtgcgttgatgcgcaagccgtgaagtgcccgccatgtacaattcgctcgcgcgttcgtcatccgccatgccatcaaaggcctgcgcaagcgtttccgcaagcgtgctgatcgcatggtattccttgcgcgctcccatctgtcgtacgcaatcggccgtgcgggtcagcgaaacgccggagcattgcgtattgatctcgttggtcagatgagtgagcgtcgtcacgtccggcaatttcgtgacgttgaggatatgctgcgcgacacggccggtatcggtgatcactacggcaagcagcgtattaatggacactggcacgatttcgatatgccgcaatgtcgacttcgacagtgacggcgcggccacgacggcgacctgtccggtgatctgcgccagcagccgggcggcccgctgcagcgtgtcctgcagattgaccgatccggacagaaagctgttgatgccgcggcgctgggcctccgatagcggaacgaccgtcgccaaacggtcgacgaagtaacggtaccctttttcggtcggcaccctgccggccgaagtgtgcggctgaataagatagccttcatcttccaaggccgccatgtcgttgcgcacggtggcggagctgacgccgaggtcatgatcccgggtcagtgtggtggaacccaccggttcctgagaacggatgtagtcctcgaccacggcacgcaacaccagcatgcgtcttgattgcgccatgcgcgcctccttatgcataggtgtgtgccggtacgccttatgtttgacggcgctgatgagacgtacccggaaaacttcttttaatgttttagcactccggcgcccggagtgctaatcggttcgcttccagagtagtttccttcatgcggcaaagccttgcggcgactggcattgggagatatatcgacaaacgaacatctgaagttcacgcgaatgttaattgtgagcgctaacagcacacaaactaccaaaacacgccaaaatttcaccacaacgtcacctcacatcgctactatgggaaacgcaatgtgagggcgtcgagcgctcggcacaagccggatacgcggcccgaccaattggaaggaaagtaatccatgaccgaattcaaggagaccgagctggacgaacgcgccatcaagatggccaaggtcctgtcggccgacgcggttgagcgtgcgggacacggccacccgggttcccccgtctccctggcgcctatcgcctacaccctgtaccagcacttcatcaagcatgatccgaacgaccccaactgggaaggccgcgatcgcttcattctttccggtggccacgcctccctcacccagtacgtccagctgtacttctccggctacggcctgaccctggacgatctgaagaacttccgtggcggcgctgacacccgtaccccgggtcatccggaatacggcctgaccccgggcatcgaaatgaccaccggtccgctgggccagggcttcgcctccgccatcggcttcgcctatggccagcgtttccagcgtggcctgctcgatccggaagctccggaaggcgagtccccgttcgaccacaacatctgggtcatctgcggtgaaggcgatatcgaagagggcatctccggcgaagccgcctccctcgccgccaaccagcagctcggcaacctgaccgtgatctttgatgccaaccgcatccagatcgaaggcgacaccaacctggtgctggccgaggacgtgctcaagcgcttccaggcatacggctggtacaccgacgagttcagcttcatccagcctgacggctcctacaaggaggacgtcgaaggcctagccgacaccatcgccaaggcccgcgccgccgccccgaaccagccgaagctcatcaaggtcgacaccctgatcgcatggccgaccccgggcaagaccaacgacccgtcctcccatggctccaagctgggcgccgaggccgtcgccggcctcaagaagctcctcggctacgacccggaggagtccttccacgttgacgaagaggccctcgcccacgcccgcaaggtcgccgagcgcggtctcgaagcccacaaggaatgggacgagaagtacaacgcatggcgcaaggccaacccggacaaggctgccctgtacgaccgcatcaaggccggcgagcttccggaaggcttcgacaaggccatcgacgacctcgaggccaccttcgaagtcggcaagaacgtcgccacccgtggcgcttccggctccactctgaacgccatcgcagccgtcatgccggaactctggggcggctccgccgacctcggcggctccaacaagaccgacctcaagggcgctgagaccttcgccccggctgagtgcgccaccaagcagtggccgaactgcagcaagtacggccgtcagctccacttcggcgtgcgcgagttcaccatgggcaccatcaccaacggcatcctgctgggctcccacacccgtccgtacggcggcaccttcttcatgttctccgattacgagcgttccgccgtgcgtctggccgccctcatgcagattccgaacctgtacgtgtggtcccacgactccgtcgcagtcggcgaagatggcccgacccaccagccggtggagcatctggcttccttccgcgccatcccgcagctcgaggtcgctcgtccggccgacgcttacgagaccgctgaagcctaccgttacttcttcgagaagaagaacaccctgccgaccgctatggttctgacccgtcagggcgtcccggttctcgccgagaccgctgagaaggccaaggacggcgtgaagaagggcgcttacgtgctcgtcgacaccgagggcaccccggacgtcatcatcatggccaccggttccgaggtccagtgggctgtgtccgctgccaagaccctggccggcgagggcatcaaggcccgcgtcgtgtccgtgccgtgcgtggaatggttcgaggagcaggacgccgaatacaaggaggccgtgcttccggccgccgtcaaggcccgcgtctccgtcgaggccggcgttgccatgccgtggtacaagtacctcggctcctacggcaagccggtgtccatcgagcagttcggcctgcagggtgatggcgctcagaacatgatcgatctgggcatcaccgccgagcacgttgtggaagccgccaaggcctccatcgcggaagtcgaagccgccaagtgatgatacggggagggacacgacagcatgtgcccctcccctttcaccgataaacaagatttgatccaaaaaggtatcaaggagaaaaaacaatgactgaagcaactcagcgcacctctgactccggtgtctcgatctggctggacgacctgtcccgctcccgcatcgagtccggctctctgcaggatctcatcgccaacaagaacgttgtcggcgtgaccaccaacccgtccatcttccagaaggctctgcacgaggtcggcccgtacgatccgcagctgaaggaactgggcaaggtcgacgttgagaccgccgtgcgcgagctcaccaccaccgacgtgcgcaacgccaccgacatcttccgtgaggttgccgagaagtccgatttcgttgacggccgcgtctccatcgaagtggatccgcgtctggctcacgagaccgaggccaccgagaagcaggccgaggaactctgggccaaggtgaaccgtccgaacgccatgatcaagattccggccaccctcgaaggcctgccggcaatcaccgccaccctggccaagggcatctccgtgaacgtcaccctgatcttctccctggagcgttacgagcaggtcatcgacgcctacatcgagggcatcgcccaggctgacgccaacggccacgacctgaagcacatcggctccgtcgcttccttcttcgtctcccgcgtggacaccgctgtggacaagctgctggaagccaacggctccgacgaagccaaggctctcgagggcaaggccgctgtggccaacgctcgcctggcttacgagctgttcgagaacaagttcgccaacgatccgcgttgggctgctctcgaagccaagggcgccaagaagcagcgtccgctgtgggcctccaccggcaccaagaacgccgcatactccgactgcaagtacgtcgacgagctcgttgctccgttcgtcgtcaacaccatgccggagaagaccctgaacgctctcgccgatcacggcaatggcgctccgtccatcaagggcacctacgaagagtcccacgccatcatgaacaagctcgccgatctgggcatcaacatcaaggatgtcaccgacaagctggaagctgacggcgtcgcagccttcatcaagtcctgggacaccgtcctcgccgacgtccaggctggcatcgaccgcgtcaacggctgaatcattcgctgatacagcaccgttaaacggataaaagccgagaggtctccatcttttgatggagacctcttttacgtatgccggaataatacgcgcagaagacatacggaaagacaaaaaggccgcgatatcaaatcgcggccataatcgaaagaaaagcgaaccggaaatcaagcctgccaatacgtgctgaagaagtcgccgatctcgccgatggtctccttcaacatgctgatacgaggcagatagaccacacggaagtggtccggctcctgccagttgaacgcaccgccgtggctgatgaggatatgcttgtcatgcagcaggtcaagcgcgaactgctcatcggaatggatgttgaacttcttcacatcgatcttcgggaagatgtagaacgccgctttcggtttgaccgcggtgatgcctggaatatcgttgagcatgttgtacaccaactcgcgctgatcgtagatgcggccgccgggcaccagataatccttgacgctttgatggccgcccaatgcggtctgcaccaccgactgcgcaggcacgttcgagcacatacgcatgttggccagcatgttcagaccctcgatgtaatccttggcgagacgcttgttgccgctcagcaccatccagccgacacgccagccggcgatcatatgggacttcgacaatccggagaacgtcacgcagaacaggtcaggcgcaagggacgcgatggagatgtgctccaacccatccatgaccagacggtcgtagatctcatccgagaagatcatgagctggtgctctcgcgcaagatcgacaatctgctgaagcacttccttcggatacagcgcgccggtcggattgttcggattgatgatgacgatcgccttggtcttgtcggtaatcttggaacgcatgtcgtcgatgtccggataccattcggaatcctcatcgcagacgtaatgcaccgcggttccgccggccagattcacgcaagctgtccacagcggataatccggcgacggcacgagtacctcgtcgccgttgtccagcaacgcggataaggacaggttgataagttcgctgacgccgttgccggtgtagatgtcgtcgatggacacgttggggatgttcttcagctgcgcatactgcatgatggctttgcgcgcggagaacaggcccttcgacggcgaatagccttccgtgtcgggcagctgctgcgacatgtcgtagaccacttcatccggcgtgcggaagccgaacggtgccggattgccgatattgagtttcaggatgtgcgtgccggcggcctccatgcgcgcggcctcgtcggcgaccggtccacggacgtcgtacagcacattgtcgagcttgtgggatttcgtaaaagtgcgcatggttcttccttctgtcggttgctcggatgcatcgtcaacatggtcgggctgttcaccggcaaaatccggcaaaatcgcggcatgctcttccatgggaacatccttgcccatcagccaatcctcgttgacccgcagatacgcggcaaggaaatgcgcgatatcggcacggggaacggttttgccactgacgtattggctcatatggcttttgccgagcttgatattgaacttttccgcagcatgaacgaaatcaatctgtttaagctcgcgtaatgccatggcatcattcaatctggtcgagaatgattccgtcatgcctatccttccagttcaatttaaacaaaagctagttcaaagaatagcacgacagggcaccaagaaagacaaagagttcaattttggtggatgtgtttcatgccgctgcatgaatgagttcaattccgtgaaaagactccatgtgggggggcggtcaaagcagattgttctcaacccattgggccacgccgtcatcgttgttcgaagggcagatctcatcggcgattttcaacacgtcaggattcgcgttggccacggccactcccctgccggattcacgaagcatggcgatgtccaccaaatcgtcgccgaatgagacggtccgtgacaacggcgtcgacatgcgatcggcgaggatgctcaatgcatgctccttattggcctgcggattcatcagcatccacagcgagccttcggagatatgcacgtcgaaatcgtcggggatgagccgtcccacacgcttccactgctcctcgttcgggaacaggatcagcttgtccgcggtgccgtccggaacgtcatcgaaatccgtgtatcgccaggtctgcgtcttccagtatttcgtgacgtcgaaattcgtgtacctgacatcatccatgacgatgcccacttccatgtcaggcagttcctccagcaggtacttgcagacctcgcaggcccttttcgaagagaatccgatcttctgcagatgtccgtccttcggcagtgtcggtgaggtgagcatatcgtaatcggacgagacggggttgaaatccaacagcgccccgttgagataggcgacggcgtcaaccggaagcttctgcacgaacgagtagccggtgctgaccggtcgcgcggtctccaccacgaatttgatgccggcgtcgtgcatgcggttgatgctgtcaatggatcgttgcgtcaggaaacggtcctcgaaagtctctccgtcgtgcagcagtgtgccgtccagatcggcgacgaccatggtcacgtcatcataggtgttgtttgtcgaagtcatttgaatcctttgcgggagcaatctagccggagacaagtttggcccatgaccgtgaagccggtcatgggccaaaccaaattacgtcaatcagatgaggttgaatttcgtcatcagaccgagggcgatgatgatggccacccacagcaatgcgatgatgacggtccaacggttcaggttcttttccgcgacaccggaggaacccgcattctgggtgagtccgccgccgaacatgtcggacaaaccgccgcccttacccttgtgcataaggataagcaaggtgagcaagaggctgaggatgacaagaagaatctgcagcacaagcttgacagtagccatagcggacacgggtgaacctccagttcgtaaacactgtttctgataatagcgcatggtgttgaaaaaatcgagcgtccaaccatgctttttaaaagttttcaggcggttgtttccaatgtcagcttgcagatgcgtgtgagttcatcgaccttcaacgcggagccgccgatcaggaagccgtccacatccggctcgttgatcagttccaccgcgtttttcgaggacaccgaaccgccgtacaggattcgcaccgtttcgccgacccgtgttccgaacgtatcggacaggtcgtttcggatcgccctggccgcgtcctgtgccgactgaggcgtagccaccatgccggtgccgatcgcccataccggctcgtacgccacaatcagcttcgcggcctcctcatcggacaggtcccgcgtcacgtcgtgcacctggccgaccgcgaaatcgagctctatgcctttgcgccgttcctcgtagctttctccgacgcaaagtatcggctgcatgccggcagcaagcacggccctcacctggtcgacgatgttcgcgtcgtcttcgggatggtatttgcgtcgttccgaatggccgacgatcacgtacgagcagccgagatgggcgatcatatcggcggagacgtcgccggtgaacgctccctgcgaggtgactgagacggcttgggccccgtagcggattttcagattgtccgattcgacggcgacctgcacgctgcggagtgaggtgaatgacggcatcaatgcgatttcgcaacgtttgtagtcgaaatggatggcccgaagattccatgcaagctgctgtacgaaatacgtcgcttcaagatgatcgaaattcatcttccagtttccggccaccaaaggaatccgtttcggccccataatattcgtcgtctcccgtccgtgctcgtcaaagcgaaaggtcgttcttgtgacattgtatgcgaaatacgcaaaaggtgctcccccacccactgatgaggaagcaccccttcatgattctgagatcagtcgagcaccttcaggcccggcagttccttgccctcgaggaactcgagggaggcgccgccaccggtggagatgtgcgagaagccatcctccgggaagccgaggttgcgcactgcggaagcggaatcgccaccaccgacgatggtgaatgcgccggcagcagtggcatcgacgagagcctgggccacggccttggtgccttcagcgaaggtcgggacctcgaacacgcccatcgggccgttccacacgacggtcttggaatcgacgatcttgtcgtggaagagcttctgggattccggaccgatgtccagacccatcttgtcggccggaatggcgtcggcggccacgacttccggagcgatgtcctcatcggatttcgggaagaccgggttgatgacgacatcggtcggcagcacgagttcgacgccgttcttctcggcgcgctccatgtagcccttgacggtttcgatctggtcctcttccagcagggaggtgccgacctcgtagcccttggccttgaggaaggtgtacgccatgccaccgccgatgaccagacggttggccttgtccagcaggttgtcgatcacgccgagcttgtcggagaccttggagccgccgagcacgacggtcagcggacgctccgggttcacggtggcgcgggacagtgccttgacttccttctcgaccagcaggccagcggcggccggcagatcggcggcgacgtcgtagttggagccctgtgcgcggtgcacgacaccgaagccgtcggacacgaagacttcgccgagggcggcgatcttcttggcgtatgcggcacgctcctccggatccttgctggtctcttccggattgaaacggacgttctgcagcagcacgacatcaccatcgctcatcgcggcgaccttggcctgcgcgtcctcaccgtaggtatctgcggccagcggaacggtgatgccgagcagctcgccgagacgggcggcgaccggagccagggacagttccggaacgaccttgcccttcggacggccgagatgagccatcagaatgaccttcgcaccctgttcgcgcagagccttgatggtaggcagggcggccttgatgcgaccatcatcggtgatcgtggtgccgtccagcggaacgttgaaatcggcgcgaaccagaacgcgcttgcccttgagatctccaagatccttgagtgtcttcatgtatatcctttcctagccgcttgtaagcgtggaatggccatattgccacttacgcataatacaagcccaaacgaacaaaaaacaccatacgacggaaaagtcgcatggtgttttgtttccggaaacgaaaatcaggccgcttgacggcgtgccttctccgttttctcagccaattgcagcagtcgacggatacgtccggcgatcgcgtccttggtgattggcgggtcggcgagacggcccagctgctcaagggacgcgtcggcatggtcgagtcggagctggccggcggatttaagattgtccggaacgtcatcgccgaggatttcaaaggcctggcggaccttatcgcaggcttccgcggcggccttggcgctacggcgcatgttggcgtcatcgaagttcgccagacggttcgccttgcctcgggcctctccgtcggaacgctttccggtccattcgcgggcggaatgaggggcgcccatgaggatgagcatgcgttcgatggcatcggggtcgcgcaacgtcacacgttcggagctgcgcagcttacgcggcttggcggtgatgccgagacgacgcgcggtggagaccagcgccagcgcggcctcatgattcggacatacgatttcgagatagctggccttgcccgggtcggacaggtgtccgcctgcgaggaacgcgccacgccaggcggccttgatctgggcgatcttgccgttgatgatgtcgcccggcagacccagcaccatgtttttggtgtaacggctgtacaggccggtctgcagcaccagagccgcgctgcccttggggacgcggactatgaagcgctgcaccacgccggtcggcgtctgcctggaaacgggggtaagcgtggcttcgtggccgtacagatttctgatggtgtcctgcagccatatggccgcgtcttgggaatcaagctgcgcctgcacgagaatgtggtgatccaccgagtgcaaaccattgccgaatcgaatcatcgcagtcgcctgtgcctttttggcgatgggcaactcgttgtcgattgcggccagctcgcttttgacgtcatccagaagagccaagagccaacctcctactttcctgttcttccctataatttcaggcgagtcgcggactcgacccgcactgctaccggcttactgtgataccgaataacttggacaaagccggcagcttttctttgtatttggatactgtcttctcacaatgcggtcatcaatcggccgaacgcttgtccagctcgcgggccgatacggagaccgtgagaccacgcgcacgcaggcgcttggccaaggcctcgctcatggccacggaacggtgctggccgccggtgcatccgaacgcgatggtcacatagtgcttgtcttcctgcgcataaccttcgatggcgatggcgatggctttctcgtaggcgtcaaggaactcctccgcgccctcgctggagagcacgtagtcgctgaccggtttgtccttgcccgtcagcgaacgaagctccggcacccagaacgggttgggaaggaaccggacgtccgccacgaaatcggcgtctatcggaatgccgtatttgaatccgaaactgaagatatgcacggaaaccgtggtcggtccggaaccaagcagaccctcgtacagtttcgtggacagctgatggatgctcaatgccgaggtgtcgatgacgatgtcggcgtgctctttgaggttcttcagcaggtcgcgttcctcaaggatgccgtcgatcagacgattgccctgctgcagcggatggggcctgcgcacggattcgtagcgcttgatgagcacctcgttgctggcgtcgaggaacaggatgcgggtcttcaccccaagatcgtccagatggctcagcacggcggacaggtcgtcgaaatagtcacgtgacctcacgtcgatgaccgcggcgagtttgtggatgttcgaaccggagctggtcatcatgtccaccagcgggacaagcagtttcggcggcatgttgtcgaccacataccagcccatgtcctcgatgctgttggccgcgtgggaccggcccgcgccgctcatgccggtgatgagcagcacttcgaagcctgcggccggagaaggcgcgctcgtatgcctgcctgcctggttgacggcgttgttcttttcgttcatcacagggcctccttaagcgcggagcgcatggcatgctccaatgcttcgactttctgatggctggtgggctcggtcggcggatcgttgtcccatatgccggtcatcagccagacttgaatcatggcttggtacagcagcatctcctcgccgccgatggcggtgccgccgcatgacctccaggcctgcatgagcttggtcgggcggggatcatagaccacgtcgagtagcgtgccgttcgtgactatgccggctgaggcaaacgcctcggcgatcggatcggcggcaaggccggggatggtgttgatgacgacgtccgcatgggacagcagattcaccgcatggtccatggcgacgatgcttatggagccgacgcccatatggctttccgccaatggttcaagcgcctcgttcttatcgggatggcgtgccacgacggtgacatgtccaatgtggggcatctcggtgcaggccgccaaagccgaggtggcggtgttgccattgccgatgatcaccgcctcgccgtcttgtccagaatccatccgcatgccacgtgcccgatacgagtgctcgaaggcgagctcaattcccttcacatccgtgttgtagagcctgatcgcagggatggcggcgttcttatcgttcgcgccagaccagtcgaagacggcggtgttggccaccttcagctctttcgcccacgcgttgcatggcacgccatatggctggatggtcttcttcaacggcatggtcaggctcagtcccgcccagatggaatcaagcgactccaaaaaatcctcaagctccgtctcgccgacctcgtgcctgccatacgaccagctgtcaagtcctagagctcgataggccgcattatgcaatacaggggaaagcgaatgcgcgatgggtttgccaaggaccgcgcaccgatggtccacctcggtcatgttccctcccttactctcaccattcatcatgctagcaacgcagaagcgattgctcgttacagattctatttcttttcatctttcggactgtttccatccgatttcactgttcggagggcatcctccgccttcgaagcaatgtcaacggacgaatgcaatgcctggtaaatgttctcggccttggcatggccgatgcctttgacctgttcgaaatcctccacgctcgcctcacgcatggcgcgtacggagccgaaatggttgagaagccgtttctgataggcttcgccgatgccgggaatgtcgtccaaagcggaacgcaaagctcctttgcgtctggtctgacgatggtaggtgatggcgaaacgatgcgattcgtcacgcacccgctgcagcagatacatgccttcggactgacgtttgaggatgatcggatagtcgtcatccggcacccaaacctcctcaagacgcttcgccaatccgcagacggccacatcgtccacgccgcagtcggcaagcgccttggccgccgccatcacctgcggtttgccgccatcgaccacgaccagattcggcttataggcgaaatggcgacggttggtgttctgctgcacggcatccgtttcaggaccattcgtgccatccgacctatcattttgcgtggccatccgacgctcgttgtccatgctttccccggaatcgccggcgatgttgccatggcggaaacgacgggtcaacgtctcatacaatgcgctcaaatcatccaacgcgccctgcccgtccgcacctcggatggcgaaacggcggtactccgactttttcgcgatcgcgtcttcgaacaccaccatggacgctacctggaatgcgccgccgactgtgttggaaatgtcgtagcattcaatgcgcaacggcgcctgttcaagcccaagagccttcgtcacatcgttcatcgcatcggaacgtgcgcccatatcgctgatacggctcatcttgctgcgtgccaacgcctgcttggcattgtcgttggcacggtccataagctgtttcttgtcgcctctgctggctacacggatggtgacggccgctccacgcaatccgcttagccattgctcaagccctgcgctgcgcgacggttcgattggaacgatcacctcacggggaacaggcgcgattggagccagcaggtcggcacgtcccgtctgctcctgacgttcgttgcgttccttcgtggcctgcgcacgggcgatagcatccgttgcggtcacggtctgtgtcgaaccgatcgcattgcgctgctcggtcacgacggtcgaatcggagacggccgcgctctcccccgtggtttccgaatatacctgagtgatcagatcggcgatcaactccgcgtcgctcacatcttcgactcgctccacactccagttacgttcgccgcgaattaatccggaccgcacgaagaacgcgtgcacgctggcttcaagctcgtcggacgcgatgccgaacacgtcggcgtcgacatccgaatcgaacacgacggcgttctgctggaccacggtcccgagcatttggatctgatcgcgcagccgggccgccttctcgaattccagttcggcgctcgcctgcttcatgtcgcgggtcagttgggcgatatacgatttgccgattcggccggtcatcacgccgacaagctgctcgcacatcctgcgatgctcgtcagcgccgatacggttcacgcatggagcggagcatttgccgatcgatgccaacaggcatggacggcccgtcaactgcgccttgtggaacacgttcttcgagcatgtgcgcacgggaaacgtcttcagcaacgcgtcgaggctgtgccgaagatcccataccttggcgtacgggccgaaatatctggtatcgcgacgtttgcggctgcgagtcacccatacgcgtgggatgcgttcgcctgatgagatggccagatacgggtaggtcttgtcatcgcggaacaccacgttgaatcgtgggtcgaactccttgatccacgtgtattcgagtgtgagcgactccagttccgtacccactaccgtccattcgaggctgcgagccgtcaacaccatggtctgggtgcgtggatgcagctggtagagcggctggaagtagttcgtcagccggttgcgcaggttcttggccttgccaacgtagatgacgcgcccctcgccgtcacgccacttgtatacgcccggctgcgcgggaatgtcggaggttttcggacggaacaggtcgcgagtatcccccaacaggggcgcgccgttcttgttcactcccctgccgtcggattgggtgccggcgtccgatactgcggtttcccgtaacgcatccgccgttttgcgccacacgtccggactgtgtcgttcgaaatcagtcacagcatatccctaaggaacttgcccgtccacgactgttcgcattgcgcgacctgctccggcgtgccttcggtgacgatggtgccgccgccgtcaccgccttccggccccagatcgatgatccaatccgcggatttgaccacgtcgagattgtgctcgatgacgatgacggtgttgcccttgtccaccaatccctgcaatacgagcagcagtttgcgtacgtcctcgaaatgcaggccggtggtcggctcgtcgaggatgtacacggttttgccggtggaacgccgttggagttccgtcgcgagtttcacgcgctgcgattcgccgccggacagcgtcggcgccggctggccgagccggatatagccgagaccgacctgcaccagggtgtccaggtaacgcgagatggacgggtacgccttgaagaactgcgcggcctcctcgatgggcatgttcagcacgtcggcgaccgatttgccgttgtacttcacttcgagagtctcgcggttgtagcgctggccgtggcattcctcgcagtccacgtacacgtccggcaggaagttcatttcgattttcaacgtgccgtcgccgtggcatgcctcgcagcggcctcccttgacgttgaacgagaaccgtccgggaccatagccgcgcacctgcgcttcgggcgtcttggcgaacagcgtgcggattttgtcccatactcccgtataggtggcgggattggaacgcggagtgcggccgatcggattctggtcgacgtggatcaccttgtcgcactggtccacgccttccacgcgcgtgtgcttgccgggcacgatgcgcgcgccgttcagcttgtccgcaagcaccggataaaggatctggttgaccagcgtggatttgccggaaccggacacgcccgtcacgcaggtgaacacgcccagcgggaaattgacgttcaggttcttgaggttgttctcgcgggctccgaccacgcgcagctgcttggtcttatgcgtcttgcggcgtgcggcgggcacttcgatcttccgtcggccggcgatgtagtcgccggtgatggagcgtggcgcttcggtgatttttctggcggggccggaatacacgacctcgccgccatgttcgccggcgcccggaccgatgtcgatgacccagtccgcgtttctgatggtgtcctcgtcatgttcgacgacgatcagcgtgttgccgaggtcgcgcaaatgatgcaatgtaccgatcagccgttcgttgtcacgctgatgcaggccgatggatggttcgtccagcacatacatgacgcccaccaggccggagccgatctgggtggccagtcggatgcgctgcgcctcgccgcccgacagggtcttcgccgcacgcgacaacgtcagatagttcaggccgacatcgttgaggaagccgaggcgtgcgcggatctccttgacgacttcgccggctatctgcgcggccgagccttcgagttctaggccgttgatccatgcgaggctccgttcggcggacatgtcgcacacgtccgcgatggactcgtcgtccacggtgacggcaagcacttccggacgcagacgccgcccatggcacgcctggcatggcacctcgcgcatgtacgactcgtaatactgcttcatctggtcggaatcggtttcgtcatgccggcgcatcaacgtgcgcaccacgccttcgaaaccggtggaatactcgcgcatgcgaccccaacggttgcggtacgagacctgcaccttgaaatcgcggccatacatgatggcgtcgcgcgcgtccttgggcagatccttccaaggcgtgtccaggtcgaagcccatctcatcgccgagtccctcaagcacatggcggtagtattcgccggtgcctttggtcatgccccacggttcgatggcgttctcgttcagcgtcttgtccggatcgggaatgaccagttcggggtcgatttccagcttgtatccgatacccgtgcattcagggcaggcgccatacggcgcgttgaaggagaaggtgcgcggttcgatctcgtcgagttccagctgatggccgttcgggcaggcgcgtttctcggagaacggcttgcgacggtccggatccttctcgtccaaatcgacgaaatcggcgacgaccacgcctttggaaagcttcaacgccgtttcgatggaatcggtcagacgctggcggataccgtccttgaccaccagacgatccaccaccacttcgatggtgtgcttcttctgcttggcgagcttgatgtcatcggacaattgccgcatctcaccgtcgatcagcgcacgcgcgtaaccatcgccacgcagcagttcgagcagatcctcgaattcgcccttgcggccgcgcacgaccggcgcgagaatctggaaacgcgtgcgttccggatacttcagcaacgtgtccaccatctgctgcggtgtttgcgcgcttaccagggcgccgcattccggacaatgcggaatgccggtgcgggcgaacagcagtcgcagataatcatagatctcggtgattgtgccgaccgtcgaacgcggattgcggttcgtggtcttctggtcgatcgaaaccgcggggctcagcccctcgatgaagtcgacgtccggcttgtccatctgccccagaaactggcgcgcgtacgccgacagcgattcgacatacctgcgctggccctcggcgaacagcgtatcgaacgccaacgaggatttgcccgaacccgacaggccggtgaacaccaccatgcggttgcgaggaaactccaagtccacgttcttgagattgtgctcgcgagcgccttggatggtgattttgaggtcgttgggtaggtgtgtgaggtctgctatgagtgagtcgcctgttgttttcatgggggcttttttgatttcgcgtgtgaggaatgcgtcgctggtgagtacgtgttcgaccacgacttcgttgtgtgtcgtgttgttgcgtttggttgtcatggtgttcttccgcttggtgttgcctgttctgttgtataggatagcgtatttttgttgtggtttcgaacaggtgttctatttggtgttgttgtttggtatgtcgttgccgggtatgtcgattggccagtggtgttggtcgtgcaggatggttgtggcgtcgcgtatggggatgcgttcctgttcgatgcgtaggtattggatgtctgttcctgtgcagagtgtttcgtagagtttgcgttcttcggtggtgagtccgggtgtgggttgtggggtttgtgtggtgaggggtttgtttttggcgtcgagttgggtgccgtattgttcgtatgtccggtatgcggtggtgtccatcagtatggatgtgcatgggatgccggtggcgcgtagtttggagaggatgtcgagtccgttggcgtccatgtcgccccagtagatgatgttggggatggtggtgagccatggcaggagtgttgtgatgtgtgatgttgcggcgtatccgttgccgaggatgcagatggcgtgttcgacggtgggcatggcctggtaggtgtctttgttttcgatgatgatggcgtgttcgatgtcggttggctggctgcggacccatggttgggtgacgatgaggtcgggttggtcgtggtgttcggcgtccatgaggcgtagtcggagttcgttcgggcgttcctggaaggtgaggttgtcttgtccggtgagctggcatatcgctttgcggcgttgggagttgggtgtgccgagccatttggcgctgaatcctgggatgggcgccatgcgtggggtcatggtgtggcagtcgtggtttgcgaagtagtgggcggcttggatgacgaggtggaagtcggtgtcgtcgtggtctttgagggttttggcgacgttcatggcgttctccggttcgaggccgaattctttggcgagcgcgctcatgcggtcgtgttcgcgtaggtagcgttcgcgggtttgtttggtggcgatgcggagggcggtgtcgaggtcgggtatggtcacggagtcgatgagcgggctttttgttggatgagtccgctggagacgattttggttttttcgctggtttcgcagtggtgttgccgcgcccagtcgcggatggtttcgttttgggcgcggatttggttgtagtgctgctctagttcggcttgtttgggcagtcggatggttttgcgcagcggccaagattcgtcggtgtcgtacatgtgcctggtgaggtgggcgtcgacgtattcgtcgagtttccggcggatgtccgtttcgcttgtggtgtttctggccgctgccatattatgcctccgtcgcgggttgcgtctgttcgacggtggcgtcttgtgtttcggcttgcgttgccggctcgcggtcgagctcctgcaggtacgagttgccggttgcgggatccttgtatgccacgtacgctttgtctgcgatgctgaggatttcggcggttttgctttccggcgcggatacgatgatctggaagccgaggcgcggcagcacggtcagcgcgcgtttcgtgtagcgtccgtcggctttgatgagggcttcgtccaggaacagtgtggtgtaggtgggcttgccggtcaggtcgccgccgagcaggtagatcagggccgcgccgtagacgaacgaggtgagttcctgcaacgcgccgccggacttgccgccggtggagctgatgcgttcgtcgggcagatcgttatggtgcacgatcgcgtagaacgagctgcgcacgcgtggatcgaggttgcgcgcaccgtattccttgatgccgttcgtgtcgcggatctggccgagttccgcctggagcctgccgatgaacgtttcgcagcctgcgaacgccttgcgcgtctccatgggattgctgcgcgcgttgcgtgtccaatcgtcgagcttcgacatgatgcggcccaacgaggatttgaactgccggtcgatcgggtggaagtccacgtggagcgagagcctgccgccgcgggggccgaactgttggcctttgagcatgccgttgatgcggtcgagctgctccctgacgttctcctcgtcggtgttgaacgcgcggttgagctgttggaagctcatatacagcttttcgacgctgttcgcatactcctcgtcggtcgcggcgcgggtgacgagcatgttgaggttcttgagctcgtcaaggaaatacggatagtcctccacgctcgccatgacggtgtcgccctccgtggaatggtgcttcagatagtcgcccatggcgcgttccgtgtcggcgcgcaattggacggcacgctcgtcgatctgctggagtctcgcacgcacggtgttgccgattctgcgcagcacgcgcacgtcgaacggcgccgtcccctcacggtcgaaaccgccggcgatgcgctgcggccgttcctgcggacgcgacgtgtcgaaacaggtctcatacgtgtcggccagcagattcgacaccatgtcggacaatgcggcatcgtcgaaatcggagtcgccatgcatgtcgagccatgcctgttcggcctggacggcatgctgcgcgttttccaattccgcttcggcacggtacctggtcttgccctcgtcgtccttctgccgtagcagctgtttcaactcgtcctgcaattgtgccagttccggatcgctttcgatccgttcgatctgcagacggatccgttccgccttcgtctcgagcccgtccacgtcgatcttgccccatggcagatccgcgacggtcaatgcgagctcatgctcgtcctgcagcagagtcatggcgttggccatctgcctgccgcggcggtcggcgtcctccaacgcccgttccgccccgtcaagctggcgttccaattcggccagataccgttcgttcacgaagccgatgacctgacgcaggcctttgacgccatggaatccatggtcgccggatttgatctgcccgtcgacctgcacctgccgttcggcccggtccatgtcgtcgatcgcctccacgcaacgcgcgtcgaaccgttgcgacgcggtctgctccttcaaccatccgacgaacggcgaatcctccttgtaccgcagcttcgacgacatccacccctcgttgcaggccgaatcgtattgcgcgtcggtatcgacgaaacgccaggcacgccgcgtcatacgcgtcggatcgatcgcgctgaccttcgcggcgaacccctgctcatgccgcttgtccacgagaatggtctgcgcgatgggcgcgtacgtgacgtccatcgccagacgccattgctcgtccccctcgtccacgtccatcagttcggccacgtacggcagttccgtctcgtccaagcccgtcgcccgtgcgatgagcgtgcgcgcatggtccatgtcgtcgctgatgcgcgtcctgtgttcgatcttgcgccggtaatcctgcctcaacaggtcgcgttcgccctgccgggcgtgacgttccaccaccatccgctggtattcggatcgcgcgtcttccaaacgcttgtcgtacgtgtcgagcgacaaggcgagcgcggcgcgtttggcgttccatgtctgctcgtcggcggggagtctgccttcgacgcgttcgaaccgttcggcgatggcgtgccgttgtctgcgcgcctcgtcggcgtcctggcgtgcgcgttcgaagtccttgccgagttgctgcaggctgccgccgtcgatgccgttcatgcgttctttgacggcttcgatttgcgtgtcgagttcgtcgatgcgctgctgagaccggtcgatggcgtcctgggattccttggctttgcgttgcgccgatggcagtccggcgcgtacttcgctggccatgcgcgaccatgtccatgcggcgagcgtcgtctcgccttgctcgcggtcggggtcgatgggcgtgtattcgcggcgttcgctggcttgtttggcgtattcgccgtagcgggcttgtatgtcctgcaggatggcgacgcgttccattttgtcttccatgctgtggaagttctcactgaaccggttgtagtcgtcgacggtttcgcgggcgagccggatggattcgggcacgtcgagcacaccctgtttgaagatgtcgtcgagtttggagggcgcgtcggcggattggatcttgtgcaggagcctgcatgcttcggcgcttaggcccatgtcctgccagatggaggcgtggaacgcctgcgcgttgacgtgcgtcgtgcatcctgggtaggtctgttccatcagtcctcgcgtgaatgacgtgtcgcggtgccggtccatgaggcgcgggtcgatggtctggttccaggtgacgtattggcggcgcagtccgtccggcccgtcgcctgcggtcaggtagaggaattttgcgcaggacaacagtcctccgtcgctgcggttcgcgtatgtgtcgacgatcgcgccccagatgttctgcggggtgccgtccgcgtccctgccgcgcaggaagatcggggtctcaccgttttcgccgtcgctgatgccgatcatgccgcgcaggtacgtgtagtcgttgcgttccgaacgtcccgaattcgacgccttattgtagggggtgccggatgggtagagcagcgagatctgcgcgtcgacgagcgtggatttgcccgattcgctcgcgccggcgagcagggtcaccggcatcgcatcgtccatggacgggcggaacacgtggtagccgccgtaggagccccagttgacgatctgccggctttgcagcatccaacggtcggaaacgattttcatgccgtcttccatcagtgtttccccccatcaaaagcgtcatcggccgaatcgaaatcgaacgcgtcctgctcgacgccggacgaaaccgtcccggtcgaatcggaagtatcgccaccatccgcgccgatggacgaatcgtcataaccatcgccatccgcgtctttcataccatcgccgtccgtatcatcggagccgagccaccggtcggcgagcttctggtcgagcaccatcggcaccaatggcgtgagcacgtacatgttctcgtcccccgtttccgcgagatacccgtaggtgcgcatgcgcgagatgacggacgtgatcttcttcgccgtgccctcctcgtcgttgctggccgtgaggaagcccgctcccgtggcgagcagcgcgcggatgtcgtcgaagctgatgagccagtcgcccggcttcgtcttctggttctcgtactccagcaccttgatgcgcagggccgcgagcgtggcggcctcctcgcgggtgaggctcacacgcgtcttcaacgagcggatgttcgtctccgcgtccgtgaccggcgacgcgtacatgatccggtatttcgtgttgtcgaccagtctgagcatgtcgttgttcaacgaccgttccacggcctcacggtactggcacgccctgtcgtacaggctgccgtcgatgtagcgttcgcgtttcagcgcgatcgcggccatacgcgcctcaagaggcatgtctcccgtatccccgtcgaacaatgccggcctgtccctcgtcatatccggcccttcggacggcatgccggattccgggcctgtctcctcttcgatgccgatgccagtgtcgaatccgtcggtgttgtccgtcatgctcatccctcctcgatgatctcgtcaagcgccgcctcggtggtgaggatcggcctggtgcgccacacgcgctcgcctccgtcgatggatacgcaatgccatgccacggttgccggtccgtcctgcgtgcgtagggcgcttaggaagccgatcagctcgctttcgcgccgttcctcccggggcagccggttgaagctcgccgcgaaatccacgaacctgccgtccgccgttttgaccggatcgcgcctgatgagtccgatcatgtgcgtcagccgcgggccgcacatctcgaccatggccttcaggtccggcgcgtcgacgttcgtcgaaggcgcgtcgtccaatccggccgtggccgcgcgcgccatcgatttcgccggcctggacggcaatgcctggaactgcgccgtaccggtgtccgtacggtatgggcgttcgtccgagccggggtgcgtcttcgcatcgtcgctggcccgcacgaacagtctgtggagcttgtcgagcatggtgcggtaatgcgtgtcggtctgctggcgcaccagacggctcaccgcctcgtcggatatgcggatctgccggcgcacgtcctcgatgccctcgtagatgcgtttgagttcggcgcgtacctgggcgagcaggatgccaggctcgccctcgagatacgggttctgggcgatgtctcgcaccgcctcgtcgatttcgcggcgtccctcgtcggtgacgatcacctggaacgcgtcctcgaaacgccggccgctgtcggattcgtggaacgacctgtggtattcgtcatggtaggtgccgagcgcctgctccacgctgatggagcccgactgcatgcttcggcgcagattgtcgccgttgtcgcgttcctcgagcgccagttcgcgcaggtcgatcggcacgccgcgcagcgtgttgtggatgacgccgatgatgtcgcccacctgctgggaggtgagcctgtccaacgtgtcgctgtgcttcaattcgtcgatctgcttttgccgctcctcgatgtcgcgttcaagcaggcggatgcgttcgcggggatcgacggtcagctgcatgcgcgcatgctcgatctccatgatgatgctgttggcctgcgctccggacagcgctttcgtggtgtcctcgagccggtcgagcgcctcgatcgcacggtgggcgcgcgccgtgagacggtacgggtagcggtgggctgcgacgtcgagcgaattggcgagccaggcgtagtcgccttcgccttccttcgtcagctgctgcaggatcgtgtgcgcggcttccgcggacgtctgcccttccttgggcgtgtaatcgcccgtttccgcaagtcgggtcagactgcgggagaaccgttcctcgacgatctcgcgtggcagctcgccggtgagcgggtcgaacgtggagcgcagcagcgcgacgtacagcatggaattgccgcgcagcagcaatcgcagcaccccggtctcatacacgggccggagccgttccatttcccgtcttacatccgccaacggcgtcccgtccttcccttagccacaagtttcccgatgcgcatccattgtaagatagcatgtccgttttcccgtgatcgcggcgggaaaaccgtccggcgcgaacgtcatttgaagatgacgtagcggcacagcaggaagccccagaccgcctgcatgcccatggtgacgatcttgaccgccatggtgggccagccgagcagtccggggatccaggccatcatcaggttggagaacagcaggttccagcagtacatggccacgaacatggctatcgaacgcgcgtagttcgacgaggatttgaatgtgacgttgcggttcatgacgtagttgaatgagccggagcagaagacggccacggcattcgccagacggaacggcaggccggccagctgaagcacggcgaacacgccgaattccacgaaggtctgcatggccgaaacgccgccatagctgaacaattgtctgacgatgccgtttttcggttttccgtccgtcggcatgcggtctcctcccggtcgtctcaaacgctacggctggaaagcatagtcacacatgtggctacggacgcgccggaggcgtttcggcccggcggaatgaaaaaacggaaggacgccccttccggagtttccggaagaggcgtcccccacgttttcggatcgtgtccgctcagatgctcatcgccatgagctgggccgcatactcctccacaagctcgctgtcgcgctccgtccaggaatggctggcggaatcgtccggcacgaaagtggtgtcgatgtcgatgttctcgttcatttccttaatacctccgttcgtcccacttgcccccggcgacattgccgactttcatggaacaggcaaaagtctggaccataaacgcgttcgatgcaagagtgtgttcacatcgtgatcaaacgtttttcctccacgcgtacatgccgtgtctccggcgtgaagacgatacgatggaggcatccctgccaccaaccaaagaaggacgatgatgagcgacgaacgcaatgaggccgaaccgatcgaactgggatacatcgaggacctcggggacatgatttccgttcaggaggggtccaccgtgtcccgcaccgtcatgcagaaggccggaggcaacgtggtgctgttctccttcgacacgggcgaggagctcagcgagcatacggccgcgatgccggtgttcgtgcagacgctgaagggacggcttaaggtgacgggcaacggcaggaccgtggagcttgttccgggaggcctggcctactttcccacccgcatcccgcacgcgatatacgccgaggagccgtccgtcatgatgctgacgatggtcacgccggcacgcgacaacatcggcgactgaaaaaacaagaccgccggcatcggattccattggattcgccggtgccggcgactgccggaaatacaagaaaagctccctcccaggagctttcgttttgtggagcggacaacgggactcggacccgcggtctcaaccttggcaaggttgcgctttaccaactaagctatgtccgcatgttttccaccttggtgggcaacgagttgaaaatatacaggagcgtccgccatcgcgcaagcccggcgtgtcgcgtttttgcggcgccggactcgcggcagctccgcacgacggtcagacatagtcgtacggcatgcgctttttaacgcgccagaacacgataagcgcgatgtcgaagagcagcgcgtagaagccacggtccgtccacaatccgtagaccgcgcaatacaacaccaacgcgcgtaacgtatagaacacgatcctgcgcatgccggaacgttccctggtctccaccgtcatgcgcgtgaaaccgccgcccaacgtgcggccggcgcgcctccacggaatgatcccttcgaacaggacgaacatgacgatggtggccacggcggagacggccgcattgacgttgttcgcgcggttcacatcgaacagcacgccaaccagatagataagcgccgtgacggacagcgacgccgtttcgacaaggaacaggtcgatcgcgagcgccacgcagcggcgcacgaagcctggctcggtggtgatggcgtcttcgtcgatgcgctgttggggtaggaagtgggtgacaatgcttcccatggcgtagccgagtatgccgccgagggtgttggtgatgaggtcgtcgacgtcgaataggcggtaggcgcatggatagatgccccagatgccggtcagctgggtggtttcgatgagcagcgaggtgaggaacatggccggcaacgccgtggcgaatttccagcggaagacgcgtttcatgaagtagccgagcggtaggaagaacacgacgttcatggccagttgcatgacgcctgtgatgccgtcggttcggatgtcgtggatgaattcgaatgggttgagttgtggcctgagatggtgggcggcgcagtaggtggccgggttttctggcattgggtacatggtgaagcatgcgagcgcgatgaggtagagcaccacgagatatgcggtcagtgcggaggtgaagcgtagccggttgtcgcggtggtagagcagtgcgagcacgggcagggtgagtaggagtgagaggaatggccagattgcgatggcgagcgcgaatggcttgctgaagtagaggacgtatgacatggccggtttcctttgctgggcgtgtgggatacgcgtggtgtgtgtgcgtgggtttcgtttccgttgttggtttcaacggtagtacggctggtcgtgtccgtggcatcgtccgtcgtattcattccttggcgtaaatgttggggtgactcatcctctggtatgagatggcccggcgtgtttcttcgtgtctttttcctcttgctttttccgttggattgcttggcgtctgatccgcgcggaaccgatttcggacatcgtcttcgccgtcaccgcgggaatcctgttcatggcgttcacgccgaaactgctcagcgaataacggaagctcccgccttccacgcggaaggcgggaaaggcgggagctcttatgggaagactaaggcggattttaaatccgaggaatagtcacctttttggcaccggtcatgtaatgccagaaatcttccgtccccggaataaggtcatgcagaacgcctgatgttttttcgaccgctacgctcggtgtgcccggcaccggatggtcatctgttgaagacgcgaaatcgagtccgatgattcacgcatcggcactctccgcggcaccaatcgccttcattccaggatattcggcgagaacgagattgatggcatcggccaatatcatctgaccctccttgcagcattccagtactgattcgtcggattcggctttatacgctttatacgcgtcaaaacgtcaccgtccatattcaaataccatgagtcgtttgccgatctcgtttgcggagcgggggaatcattccgcctgtttgacgcgttccatcgtagtatccgttgaagggcgttcttgttggtcttggtatccattcctcttatcacgtttccgctgtatgctttagggaaagctgttatgtgggaggatcatgcggaccacgaaaagcaagaaacccatcaccgtcgtatcggtatgcgtcgccgccgtggcatgcgctgtcggcgcgtaccggttcgtctacctgccactccggcctgccgatgtcagtcatgctcggatcagcatcaacgcgacgggcaagttcgacgaatcccagatcgacggcgcggtgaaggcggatcttgccaggctgaaatcctggaacggttgccgcgtggatgccgtccgatatgacgcaaagcgttcggccacgctgcttgcagccgaacacgacgtcacggcttccggtggcagttcttcgatttccacggccattgacgaatacgggatggacaatgtgatttacctgtccaatgacatctcttgccgtgcgggctcgcagaactcgtcccaagatggctggggaagctggtacgcgtggaatcccggttccgcgcgggcggaacacggatggatcttcatcgacgagggatattaaagttcaacggaataccgtgcaccatgccatgatgtcgaaaccatacgatgacgattggctttagtacagcattgataaaaagcgggcctacgcgtcctgatcacgcggaacgcaaacccgctttcgatggcatagtcatcgcttggcttatctgactacttggtggtggccactcatcatgactggccaccaccaatgctcccggatagtcggcaagacatcttgccagagccaccttggactctaagtcaagatagttcgccggctcgtccatgacaatcaactgaggccggtcaagaatgcccaagcacaacatgagcttgcgcagttcgcccggagacggcgcttcgttagaaagcagcttatccggatcggcgttgagctgggcgaaggcggccagcacctgcgagcgttccttaccctgcaatgcggcgagtcgtctcatggtttgagaaagcgcggcttctcccgtttgctgctggacgatcagatgcggcaagtcttccggcatgctgtccagcaatgcgttcatcacggttgttttgccgagtccgttggcaccggtcagtccgatatggtcttgctgtccgatgctgagttttggtatggcgacgcctggcatccgtggtttttcaccactcatccctggattatgcgcgaccttccattgatgtccgtcggcatgcagtatggattgtgttggcgttctcgcggcatcgttcgagctggtcatcctgccgctgccgaatatgataataccttccgtgagatgcaggagctcctttctgttgcttggccgtatgtcgatccagatgtcgccgtcgtagcgtttggccgctacggttagtgaatctagtgtgcgctgtgctcgttcaagacgcttgttcatttgtcggtatgcggcgcccgaagcggtatcggtctgtttttcgatccatttgtggtgatcgagggcgctgtgatctttgcggtcgattttccactcccgtttgcacgagatgtcgcatggcgaaggttttctggagattctcctgtcccacacgggaaagggtctctatcttatggacgaacccgaatccgcgctctcgacacagcggcaattgactctgctggagcacatgtaccgaatggcaaacgacggatcgcaattcatcatcgcaacccattcgccgattctgctcggtctgccggatgcggaaatcctgtcattcgacgaaaacggcgtccatccctgcgattatgaggatacggacagctatcaaatcaccagggtcttcatcaaccaccgcgaatcactgctccggcatctgcttggaaatgaaacgtgagatgaggtgaaacggttgcgggtgttcgctatgatgttcgattggcgtttgaaggaacacgaaagactagaggtatcacggcatggcgattgaggcgcagggacttgagattcagatcggtgcgcgcacgttgctgcatcccaccaacttccacgttgccaagggggacaagatcggtctggtcggacgcaatggagcaggcaagaccacgctgacccgtgtgatcaccggcgatatgctgccgaccgccggcaaggtacgtgtctccggcaaactcggctatttgccacaggacacgcatgccgccgacccggagcagaccgcactggaccgcatgatgagcgcgcgagacatcgccagcatcatcaaacgcatacgcaaggccgaaaaggacatgaccgatccggatccggatgtcatgaccaaggcgatgaaccgctacgacaaggccatgcaggatttcgaaaaggccggaggctatgccgcacagtccgaagcgaccgcgatggcggccagtctcggcctgccgcaggacgtgatgggccagcagttgggtacgctttccggcggtcaacgccgccgtatcgaactggcgcgcatcctgttctccgatgcggatacgctgatccttgacgagccgaccaaccatttggacgcggattccatcgaatggctgcgcggctatctgaaaaaatacgagggcggtttcctggtcatctcccactccaccgaactgcttgacgaagtggtgaacaaggtgtggcatctggacgcacagctcggccagatcgacatgtactcgctcggctggaaggcctacctgcaccaacgcgtggtcgacgaggaacgtcgccgccgcgaacgtgaagtcgcagagaagaaggccgaacgtctgatgcagcagggcatccgcctgcacgcgaaagccaccaaggccgtggccgcgcagaacatgatgcgccgcgcggagaaactgctggagaacacgtccgaagcacagaagaaggagaaggtggcggacatccgcttccccgagccggcaccttgcggacgtacgccgatcatggcgaaggacatctccaaagcgtatggttcgaacatcgtgttcgcaggcgtgaatctggcgatcgacaaaggttcacgtgtggtgattctgggctataacggcgcgggcaagaccaccacgctgcgtctgctcgcccatctggaggatcccgacaccggatccgtggaatatggacatggctgcaaaatcggctatttcgcacaggaacacgacacattggaccttgacgccaccgtgttgcagaatctgattcacgtggcaccggaacttgacgacacacaggcacgttccatccttgggtcgttcctgttctccggcgatgacgcgctgaaaccggcacgagtgctttccggcggcgagaagacccgtctggcgttggccacgctggtgacgagccgcgcgaacgtgctactgcttgatgaaccgaccaacaatctggatccggcgtcccgcgacgagattctgaaggccatcgccaaatacgagggcgcgattgtgctggtcacccacgacgagggcgcggtcgaggcgttgaatccggaacgcgtgctgctcatgcccgacggcgacgaggacctgtggaacgactcctacctggatctggtggccgaggaataatcccacttccaccatttccgacacgcatatgggaaagcccggacgaatcagatcgtccgggctttcccatattgaacggttcctgttacgcgggaaccggttacgcgtgcacgtgtttggcgctgtagatgtccggctcgacgtagatctcgaaattgtaccagggcaacgcggtgcgcacggccttctcgatcttgtcgacggtttccacgtcatagtcgcggtcgagcttgctggtctgcactttgacgcacaggaggatgtcgtcctccgacatgtgcacggtctgcatgttcagcaatcgttcgacgcccggcgtggtggtaaccgcctcgacgatcttcccgcgcgtatcggaatccacggcttcgccgatcagcagcgaaccggatttgaacgccagtagaagcgaaccgacgatcaggaccagaccgaccataagaccgcccaacgcgtcgaacacctcgtcgtcgagcgcgatagcaagaccgatgccgaggcctgcgaacgccaggccgatcaaagcgagcgtgtcctccatgatcaccgaagccaattcggcggacttggtgcgcctccagaaacggaacacgcccatacgcggcgtgttcgtgcgttccatacgctcgttggcctccttgatgctctggtgcaggccgaatccttccaggcatgcgctgatgacgaccacgatgaacgcgacaagcagttccatcctgttcacgtcacgcaatgccggatcggcgctgatcgcgacaagcttcttcaccgcttcggacgtcgagaagaaaccgccgacgaagaacagcagcgtggccacgacgaacgaggcgagatacttcgcacggtacaggccgaacggatggtcgccgtccgtcttgcgcttggagaaacgtccacccaccatcaatacgatttcgttggagcaatccgcgatggaatgtaccgactcggaaagcatggcggacgatccggtgaagaacgccgcgagcagcttcgcgatggcgacaccaatgttcgcacccaacgccgccttgacggccgcgccctgatgttcggcttcccgcacctcccccatgttgttcgtggtcgtactgtcgcctgcgggatcgcgcgattcgctcattgccttccattctcgaatgtgtaacggataacatcatccattcaagcacgaatactggccgagaagccgtgtgcgcccgtgtttcgggacgtgcgtgtaaccttcactaggtatttgtcgctttcccaaaaaaaggggtattcaatggtatactcgcataacgcgccgttccgcgccgacgtggtcggctcctatctccgcccggccgagctcaaggccgcgcgtgaggatttcgccgccggcaaaatcgatgccgcagcgctcaaggcggtcgaggacaaggccatcaccgaactcgtcgccaagcagaaggccgccggcctgcatgtgatcaccgacggcgaattccgccgcggctggtggcatttcgacttcatgtggggcttcaacggcgtggaccatgccgccgcagcccaccgcgtcgccttccacgacgaggtgaccccggccgacaccgccaccgtgaccggaagaatctccggcgagaaccatccgttcgtcgaacatttcaagttcgtcaagcagttcgaggacgagaacaccgtggcccgccagaccatgccctcccccgcgcagacccgcttcgtgctcaccggcaacgcggccgcctacccgtatgacgagttctacaagaacgacgacgagctgaccgccgacatcgtcgccgcctaccgccaagtcatcgccgacctgtatgccgccggctgccgcaacgtgcagttcgacgactgcacctggacccgcctgtgcgatgcgagcgtacgcgaacgtctcggctggagcgacgaggacgcgctacgcctgcagcaggagaacctcgacgtcatcaacgccgtgatctccgaccagccggacgacctggtcatcaacacccacgtgtgccgcggcaacttccactccacctggctttcctccggaggttacgcgccggtcgcggccaaactgttcggcgaggagaacgtggacgcctactacctcgagttcgacgacgaccgttccggcgatttcgcgccgctcgccgaagtctccggcgacaagaaggtcgtgctcggcctgatcacctccaagaagcccgaccttgaggatccggacaccatcaaggcccgcatccaggaagccgcccagtacattccgctcgaccgcctgtgcctgtccacccagtgcggcttcgcctccacccaggaaggcaacaagctcaccgaagaccagcagtgggccaagatcgcactcgtccaatccatcgccaaggacgtgtggggcgagtaaacacagcacgccatccacaatcagctataaggaagggctatccgtcttgttcggcggatagccctttgtttgtttgccggcgtttttaacgggcaggtcagcccttcacagcctcatcgatgcaacgaatcgcgttcaacgtacgcggatagccgatatacggcatgcactgcgagaccaccgcgattagaaacgccttctcattgccaacgaccatattcgccttggcatgcgccgtaagctgcggttcgcaaccaccctgcgcggccaggaaacacaacgtgaccatttcgcgctcgcgggtgtcgagtccgccgcgagtgtagtagtcgccgaagcagttgtcggccagccacttgttgatgtgccgggtctcctccggtccggattgcgcgaatccgcgcatgttctcgccgaagatctcgacctgcttgtcctctccggcctgcgcgcgggtctccgacgtggtcgtgccctgcggctccagcggcagatgcacgttcgcggctccaaggaaaacgttgagcttcttcaggaacggcagggttctcccgaatccgcagtatgcggtggcttggtagatcatctccttgatggccacggacgtcagtcctgtctcgtaggcgaccggcagcatcatttcgaacgcgtcgagaccctggcagccgaccagagccgcgaggatcgccagggagcgggtctggtcgtccagatcgggatggttcgcgcccggctcgttcaccacttccccgtaagcgaagtcggaaaacagcttgacatattccggatcggtctgcgacagcgtcctgtcgttgttccagaacgcgttcatcttcctatgcagttcctcgaacatggcttcctttccattcgatgtcttcgcgccgcatgccgcgttcattctatcgtcggaaatgttgcgtgcggatagcggccatcgtcgtctgaatgttcagcgtgcgatcgcgcccttgccgggctgtttcttgacgttttcgatgacgtctttgttttcctcgagaattcggttggcctcatcctcgtgtccttcggcgatggcgcgccaatagagcgatttgagcgacacgtacgcctgctggatgcgcagggcctcggcgttcgcggccagacgcagcgattgcgcgtcgagcagttcgatctgccgtcgggcgccttccggaccgtcgaaacggttcttcaggtattcgcgcatcgattcaagcggcatgcccgtcgccgccaggcatgcgatggtggtcagcgattcgatgtccttgtccgaatagactcggtggcctgaactcggatcgcgggcgatcggatcgatgatgccgatctgctcgtaataacgcaacgtcgattcgggcagtccggaaatcatggacgcctcacggatcgagtgccaggtggtcgtcgtattgctcataccccgcactctaaaaacttaaagtgctcgaagtccatattccggcgtgtcgtattggtccgacgtcaaacggcattgagcgggcaatggaagagccggtatccgaaaagtggatctgtcgcacgactccatttttatgtccgtttcggcaatcgtgcggctttttcgtccgtctgtatgggaaccgacggacgaaaaagcccacgcatgctcaggcggcggtgatcagctccgaggaatccatgtcgaaatcggccatcgcgtaggagcggatggcgggatcatcatacgtgttcatgtagtacgtgttggtcttggacgaatatccgctggtgaacagcgtgcgttcgaactggccgttgctcatcttcgccatgccgtcaaccatctgcacggaaccaagggtgtggaacaggcgagacacgttggccgcctcgccttcctgctgcggataatgcgtgttggcataagccacacgcacgaaacgcgacggggagctcacatcgcccggaatgccatgcatgctcacacccgcgccccaagcggacagggacgccttgccccacgtggccggctcggccatctcgttgccgacgcacatgtagttgcgcagattctccatatggaagccaaacgtcggctggttggtcagcacgtctacgtcgtcatggtgcacatgcatgccgtccgccatctgttcgacgacgatgctgcgctcgctgtcgccgatgatccaatgcagcagcgactcctgctggccgggcacgatctgggagacgagggtcacgttcttcaacgcctcctcgacttcgtcgacggaatcgaaattgcgtgccacccacagcgggaattcgaaggtcgcgacgttgtcggtgccttcgaccggctcatgcacgaactccgcgtagccggggaaattcaatcccgcgatggccagaccatgctcgttggcgcagtcgaaatacatcggacggtcggccatgaccacgcccacgccgatcaccgcgttcggcgtggctttgccgctcgcgccgaacacgttgtcgtagtggtagccgcgtggagtggccaggatgctttcgccgtatgagaagctccagtcgaggttgcggccgaaatacatgtttccctcttcgtcggagaaacgaacgccagtgcacatgatggacttccttcctttgtttgattgacccgatgcgttcatcatacgcatggacggctggacgaaccacggcttccgccgacggataaacatgaagggtggccaaaaatgccaagagtcgttgaaaatgaaaaaatccccttgtttccaaggggattttttgaatggctcctgcgactgggcttgaaccagtgaccgtccgattaacagtcggatgctctgccaactgagctacgcaggaatgcgctgtgcacaagacatgaatcatacgcggtaaaacgcaaaatgcaaatcccgcgcgtgtctcccctgctgcggcgggactaccgtcacatgctgatcttcgtcaacggcatggcggaatcgattgcgaaatccggttcggacggtttcacgccgctctccaccaggttcacgcccagcatggccaccatagcgccattatcggtgcacagtttgatttgcgggatacgcacttcgacgccatgcttggctccgacctccaacagtttggcgcgcagttgggagttcgcggagaagccgccgccaacgatcagggtcttcgaaccgtactgctcgcaaccgcgcatcgccttcctggcgagcaccgtcgcgacggaatcggccagcgacgcgcacacgtcgtcgatgggaatctcattgccttccgcctgctgctgttcgatccaacgcgccacggccgtcttcacgccggagaaactgaaatcgtacggatgctgctgccccgccttgccttgtgtaaggccctgaggcactttgatggcatgtgggttgcccagctgcgcgtgacggtcgatgtgcgggccgccgggatacgggaaaccaagcagacgcgccaccttgtcgaagcattcgccggcagcgtcgtcgagcgtggtgccgaccacgtcgatatgccgcgccacgtcttcgacatgcagcagcgaagtgtgcccgcccgacacaatcaacgcaagcgtgtccttggggaacggtccgaactgcagctgcgtcaccgcgatatgtccgatgacgtggttgatgccgtagatcggcttgttcgcggcccatgccaacgatttcgcgccggacacgccgaccgcgagacagccggcgaggccgggtcccgcggatacggcgatcgcgtcgacgtcggacagcgtcatgttcgcgtcggccagagctttggagacgcatggcacgaacgcttcggcgtgcgcgcgagaggcgatttcgggaatcacgccgccgtagcgggcgtgctcgtccatggaggacgcgaccacgttggaaatgagggtgcgtccctgtaccacggccgccgccgtttcgtcacaggtcgattcgatgccgagtacgattggttcgctcattgctgctccgttgtgtgtgttgctgaagtgtgctctgtatccgctgttgcgctgaagccgacgacgcgcggctccaagtcgaggctcatggtgtacgcgtcgatgccttctggctggtagtagcgtttgcgcaatcccatccgcgtgaagccgaacctttcgtacaacgccaatgccggcacgttgtcgacgcggacttccagaagcatgcgtttggcgccctgccgacgcgccgagacgatcagtgtttcgagaagcgccgccgctatcccctgccgttggtatggtctgccgacgccgatcgtcatgatttccgcgtcgtcgccgtcgtaccagtagcctgcgtagcctcggacgacgggatccgccgtctgtacggcatcgccttcaatgtcgagcagatacgtgcgtgccggagcgtggaattcctgccgtacggactgttcgctccacgcgccgcggccgaacaggtccttttccaatgcggcgatctgtccgacggcggtgtcttccggaatctgggaatggtcgacaatcatgggcgtgccgtcactccgttcgttcggcgccggcatggttgagcacatgcttgagcgggttgggcactgacacgtccggacgacgcagatataacggttcgacgggggtcggttctgccaacgcctgttcgctggtggtgaaggccgcgaatcgcgccaatccttccgcgccttcgtcgagcagagcatggtcgtcgacttcgccgagggaggcaatcgcattccacgactgcgcgtatttgaccgcaccatggccgatgacgtcgacgacgtacggcttgcccgtgtcggcgagcttcgtaagaacgtcattgacgcgcatcgtgatggaatccggatagtcgatgtccatgtcgatcaacgttatgggcgattgtccgacgccgtccgcaacggtgccgccgtcatacagcgcgaaatacagttgccggcgacgcgcgtcgttgacggcaagcgtcagatggcggcgatcgtccgtagcttgagtatgtgccaggcattgcggcgcgagcacgtcctgtccgaccagttgcgcgcctgtggcgaaggccaatgccttggccgcgacgatgccggcgcgcaggccggtgaatggcgccggtccgacgccgacgacgatgcgggtgatgtccgacgcctgcagtccagcctgttcgacggcttgcgcgatgttcacctgcagtttctcgacatgggtgcgcgaatccgtttcgacgatgggttcatgtccgaccacgcctacggtcgaaccatatgaggtgtcaatcaccagtgtctgcatatgcttgaaaactccttgtgccaaactgccaaccactgtacaaccggcgctggaagccacggcatgcggtgcggtcggccacgtcggatgcgtcttagacagggtcagcgttttcccgcggtgaaatcgaacgaatcccaggcagcgcccaccggcaccaacgtcaccgtgcgtgcgcccgcgctggtcagctcgccgtccgcggtcacggcgggcgcgtcaagcggacggtcgatgtggatttcaagccgttccggagccaatgcggcggccatctgctcgccccattccatcaggatgacggtatgctcgcccggatcctccaattcctcgtccaagccgagcgattccaattcgtccaatagccgtccgaccgtgtcctgtccgggcgcgtaggcgttgccgccgagcctgtaggcgtcgacgtgcaccagatgcgccggcgaaccgtccgcgaaccgtccctcaagctcgcgtgcgatggtgaaggtcggcgagacgatgggctctccgatgccaagtcccgcgccgaacccttgcgcgaacgtggtcttgccggcgccaagcggaccggacagcaacagcacgtcgcctccacgggcaagcttcgccaaacgctcccccaacgcctgcatgtcctcgccggtggcggctgtgatggtaatggtgttgctcatgcggcacgtcctttgcggctgatcagttcgatggaccgttccaaagcatagaccgggtccgagccattggttttgctttgctcgtcggcccatgcgagcatctggatgcatgcgctcatgccgcttgacgtccatccggatagttgccgggtcgcgttcttcaacacccaggggttcgttttcgcctcggccgtggaaatggtgcccgcacgcaccgccgacgccttcgccatcgtccgcagcttcatggccagcgcgccgataagcgcgatcggagcggtgccctgttccacggacgatcgcatggcgatgatcgcgtccgccgtacgtcccgacaacgcgaggtcggcgacacggaagccatccacctgcggattggaggtgagatattggttgacgcggtcgagcgtcatgggattgtcgtcgaaatcgaagcataactggccgaccatggccgcaagctcgccggtcctatcccccaacacggccacgagttgctgcgcggccatcggctcgacgcggcgtttgcgccgttcgaagcattgcatgacgaagttgagtttggcctcgggcttcttcaggtcggcgacagcgtccttgtacgctccggccttggtgagctgctccaccagacgtttgcccttcacaccgccctcatgctggcagatgacgatgcacgcgtccgccggctccttgcacgcctgtctgcagtaagagaccatggcgtcgcccagtttttcgtccgcgttctgcaggttggtgacgatgacgatggcgcgatccgcaagcaatgatgggcttaccgcttcgtcgaaggtgtaatggtcggcgtttgccgcgtcgagttcgatggtttccgcgtcgggataccggcgttgcgcctcgtgtttgaggtcgcgcaccgtctggtcgttcaggtacgagtcgcctccgtacacgaggtggaagggcgtggtggctgcggatggtttcggcataccattcaatctcgctgtatcggtggacaaaaccggcatggcctattcctcccattgcagttcgcgcaatgccttccgagtacgttccatccacatgcgcagccgttccacagggttggctatcagacgttttccgggcagatcgggttcctggaccatcatttgtccaaacagccggtgcgtcatgatcgcggcggccgcgcaggcggcttccaccacgcagacgaggaccgctcccccgacgcctccggcccacggtatcgtggcctggttgccggaacccagttcaagggcggtcagttccatgaccgcggtgccccaggaggccgcacgggccagttgcaggccgagccacggaatcagccatgagacggcaagactggccaggccggccaatgtggcgaaacccacgaacggcgccaccatcagattcgccggtatggagaacaccggcagttccggttcgatgagcacctggatcggcagggtgaacacttgcgccgctatggtcatggacagagcctcggccacgaaccgtggcaggaccggttccatccatgcgttgagggtgtcggcgaacagcacgatgccgagcaccgcggcgcaggacagggcgaatccgaagctttgcgacatgtgcgggcatgccatcagcatagccaatgtggtccagctcaacgacgccatcgcctggcctcgtctgccgatgaacaggcatgccgcgccggacaatcccatcaaaagcgcgcgggataccgaatccgacggaaacacgcatgccgacagcatgatgtacgacatggcgaccagcagtgcggtgaatcgtcgcggcagaaggaagaacgagcagacggaacgcaccaatgcggcggtcacggccagatggccgccgctgaccgccatgagatgcacgattccggacctttggaacgcgtcctccacctgtgcggcgtatgtggaatcgatgtcggtgccatcgccttcggccggcacatagtcctgtccgagaacacccaatgtcagtccggggacgagcactttcccttggtcggaaagacgtgcggtttggacgaagaacgcctcctgcatcatgccgatggcgcgcatcggcaggtttggcggcctgacgtgttcgactgtcgtgacgtcggtcagccacaacggcatggcaccgtatcgcgctttggagatgcggcccgcgatcttgtaggtgccgtcctgtttgagtttgccgcattcaggccggtccgcgtatatacgcgctcgtgccgaactggtttgccgtacgccgtcgatggtgaccgatgtgatgcgcgcgtcggcacggcagtcgttcgaccgtctgtcggagatgacggtcggcgaggtggcgcgcgccgtgacgacgacggaagcgtcgccttccgcggccgcccgagaagccgggtcgcgccattgcagcaaatcataggtcaacgcgcttgccgcgcaaaccatcgcagcgatcgcgcagaccgtgacgctcgcatgccagagcgttatccgtcgtcgaacggacgccggcaatcgtgggaagggcagtcccgccaggaccgccagcggtatcatgcaggtgagaacggccggcaaagcgccgagcatgccgtcatgcgacatgcaatatgcgaagccggcgtgcgcggccagactggccgcccaaccgcatattgcggccggcagcagtctccagtctcggctcccgcgctccctggtcagccaatcgcgtgtgcccgtcatctcacgcacacttggtcacggaacttcgccagagtcttcgaaccgatgcccttgacttccagaagctggtcgacgttgtcgaaccgtcctatctgcgttcgatagtcgaggatgcgctgcgcggtgaccggtccgacgcctttgagggtctgcaattcgcctaggtctgcggtgttgaggtcaagctggttcgattgctgcgctccgtcttgcccgtcatggctgtccggtgtggacgcgtcctgcgtcggcccgttttcttgcggtgccggcgtttgttccgtttgcggggcctgttgcggctgctgttgggcctgtgagcgtatctgcgaccgtgaatgctgcagttcgctgtagtggatcgtctgttggacgagcatggtcaggctcgcgcacagcgcgcacgacaaagtgaggatcgccatgagcgcgtggaacgggcggaacgccaatcgtggcctgtcgcgtttcggccgctccccctcgtcgggtttgtccgtcggccggacgccggcgagctccgccaatgtcggtttcgcgtcatgcgtcttccgctgcggcatcggtcgtgcgggttcgtgtgatgcggacggttcgtccgattgcgcctccatggccgtaaggctgttgggtcgggacggtttttcgggcatgcccaatccccgcagccgcttcgtggcggccggcatgccagtgccgccgtccgccgtgtggatggcacagatggggtgagtgccgcaaaatgcaaatatgcccatgcatccaacattggaggatgcatgggcatactgtccagccgaaacggctcctgtggtcggagaacgcgggttatccacattcctggcgtgtcgccatggtgcggaagaacccgcgtcctcttatgcgggccgtctcgtcagaagatcattccgcgggaacgatggagacgatcttcggagccttgacgatgaccttgcgtggctccttgccgcccagtcggtcggcgacggcttcgagcgccatcttctccagctccttcggatcgatgtccggggagacctcgagcttggcgcgcaccttgcccttgatctgcacgaccgcggtgacggaatcctgtccgacgtaacgttcgtcggccttcggccagtcggcgtgcgccagggattcggtgtggccgagcttgctccacagttcctcgcagatgtgcggggcgatcggagagagcatcaggatcagcggttcgacggcggcgcgcggcacggcgtcgaggctggtcagatggttgttgagcacgatgagcttggcgatggccgtgttcggacgcatggcctccatctcgacggtcacgtcggcgatcgtgttgttaagcagcttcagcgtcttcgtgtcaagctcgccgtcggtgacgcgcacctcgccggtggtctcgtcgatgacgttacgccacaggcgctgcaggaaacgcatggagccgaccacgttgcgggtgttccatggacgggattcggccagcgggcccatgcccatctcgtacaggcggaaggtgtccgcgccgtagttctcatacatgtcgtcaggcgtgatgatgttcttcaggctcttgcccatcttgccgaactcgcggttggcatgctggccgttccatgtgaacgtcggctcgccgttggcgtcggcgggaccttccaccacttcggcggccggcacgtactggccgcggtcgtcggtgtaggcgtatgcctggatcatgccctggttgaacagcttgtggaacggttccatggagtcgacgtagccgaggtcgaacagcaccttgtgccagaagcgggagtacagcaggtgcagcacggcgtgttcgacgccgccgatgtacaagtccacgccgccggacttgccggcggtcttgttgtggtccggacccatccagtagtcgaactcgtccttctccaccatgtgcttggtgtcggtcgggtcgaggtaacgcatgtagtaccagcaggagccggcccagttcggcatggtgttggtgtcgcggtagtaggtcttcttgccgtcgcccaggtcgagctcgaccttgacccagtcctcgttgcggctcagcggagcctccgggtcggattcggcgtcctccgggtcgaaggtcttcggactgtagtccggcacgtccggcaggttgatcggcagctgctcgtcgggaagcaggtgcggagtgccgtcctcgccgtagacgatcgggaacggctcgccccagtagcgctggcggctgaacagccagtcgcgtagacggtagctgacggtgcccttgccgacgccggcggattcgagccaggcgttgaccttgtcgatggcctcgtccacgcgcaggccgtcgaggcttagggaatcgcccttggccttggtcgcgtcgatggaggagttgatgacgatgccgtcatgggagacgaacggcgccttgccctcatagttggcgaggtcgtcgccggattccggcagcggcttgacggtgtagatgaccggcaggccgaacttgacggcgaaatcgtaatcgcgctgatcgccgcccggcactgccatgatcgcgccggtgccgtagtccatgagcacatagtcggcggtgaacagcggcagcttagcgccggtgatcgggttgatggcgtacaggccggtgaacaggccggtcttctcgcccgcctcgtccacgcggtccttggcggtcttggcttcggcggccagacggtacgccttcacggcctcgaccggggtggcgtagccgcccttccaatcctcgggggtttccgccggccattcggcaggcacgtcctcaagcaggtggtgttccggggagacgactgcgaaggtggtgccgaagagggtgtcgggacgggtggtgtagatctccatgtccttgacgccgttcggggtctcgacgtcgaaatgcacggaagcgccgtgggattcgccgatccagttgcgctgcatgagcttgaccttctcaggccagtcgatggtgtcgaggtcttcgatcagacggtggccgtatgcggtgatgcgcatggaccactgacgcagttcgcgctggaacaccgggaagttgccgcgttcggacttgccttcggcggtgacctcctcgttggcgagcacggtgcccaggcctgggcaccagttgaccggggacttggaaatgtaggccagacggaagtcgttgagcacgtcggcctgctcggcttcgctcaggtcggcccaggccttgccttcgaagcccgggatggcgcgcttgccggattcgaactgttcgacgagcgtgctgatcgggcgggcgcagcccctggagccggacgggttggtggcgtcctcgtcgtaccaggcgtcgtagatgcgggagaagatccactgggtccaacgcacgtagccggggtcgatggtggcgaaggaacgacggttgtcgaagctcaggcccatgcggtgcagctggcggcgcatgttggcgatgttctgttcggtggtgatgcgcggatgctggccggtctgcacggcatactgctcggccggcaggccgaaggcgtcgtagcccatggcgtgcagcacgttctcacccttcatgcggtggtagcggctgaccacgtcggtggcgaggtagcccagcgggtggccgacgtgcaggcccttgccggacgggtacgggaacatgtccatcgcgaagtaggacgggcggccttctgcgttatggcccttgccgtccttcaggtcgccgttgacgttggcggcccagaaggtgccttcgtcatcccagatcttctgccatttctcttcgatgccctgcgccagcttcgcgttgtagcggaacgacggttcggcggattcgttcggttgcgcctgcgcgcttttctcagtgtcactcatagtgcatgaaattagccgcgcaactggacacttcgcaaggaatcaaccactattcaggcacgtgcgccgccgttatttttccgatgccgcggacgcgccggaggacggggccttggccgttgccttcggcggattcatggacgcgtcgggcgtgtatccgatcgacttgcccatgtcggccgcggccttctgccacgagccgtccttgaccatggcgcgcaatgcggcgtcgatttgcccgaccagctcgtcctgtcctgatttgacggcgatgccgtaggaccaggtggtgtcgggaacgtcgacgatcttcagatggtcgcctgtgttgttcgacgccagtccggccgagatcgcgtcgtcggcggcgacggcgtcggcctcgccgatcatcagcgccgtcatgcattgcggatacgtgtcgcgttccgccaccgtcgtgcgggtgtttttcgtgcggttgcggatgttgtcgtccgccgcgcttccagcgaccgcgcatacggttttatcggacaggctgtcggtcccggtgatttcggatgcgctgtcggagcggacgagcagcgcctcccggaccgtcagatatggtccggcgacgtcggcctcaccatcgtgggtcccgtccatggagaaggaatccacgaccatgtccaccgtgccgtcggtgagcgcggaggctcgcatggccggggacagctgtttgaacacgatctgcttttccgcgtatccgagggttttcgccacgtatttggccacgtcgatgtcgaaaccggagtattcgcctccatgcaggtatccaagccccggctggtcggcggccactcctatcgcgattgtcggcccctgcgccgcgccttcggtcaccacggaaaccgatgtgccgcacgcgccggcgccggccgcaagtaatgccgcgcatgccgccgcggccacgtatcgcgcttttcccatcatggacgtcacttgaacatgcgcgaccgggtgaggaaccaggtgacgatcgccgaaaggaccagtgagatgccgatgatcaccgcgaagccccatggcttgtccgtgaggggcatgccgagcatgccttcctggaagttcatgccgtacatggagaagatcagggtcggaatcgacagggtgatggagatgatggtgaagatgcgcatcacgttgttcaggttgttcgacacgatcgatgcgaacgcgtcggtcatgttggcgagaacgccgctgtagatgttggccatctcgattgcctgcttgttttccgtgatgacgtcgtcgagcaggtcctcatcctccggatactgcttgagcctcggcagcgtggtcagcttctccatgacgatttcgttcgatttgagggatgtggtgaagtagaccaatgtcttgctcagttccagcagcatgaggatctctcggttctgcatggagtggcgcagcttcagttcgagcttgtcgctttcgcggtcgatgatgcgcaggtaacgcaggtacatggtggcgttgcggtacaggatctgcaggatgaaccgggtcttcatgtatgtgttgaagccgcggatggtgccttccatgaacgggtgcagcacgggcgtgtcctgcatgcagacggtgatgatggcggactgggtgatgatgatcgacaacgggatggtctcgtaccagtcgcggccgccgcgttcctccacggtaggaatgtccacgatgatcatcgtgtagtcgtcctcgacgtcgacgcgcgagcgttcctcgtcatccagaggggcgcgcaggtcggccaggtcgatgccggtttccatggacacgttggcgagctccacgtcggtgggcgccgagagacataaccaggagccgttctccggtttttggatttgctccacctggccgttaatcgttctgaacattctcaacatgtctctcacccgcctttcgcgctttccaacgttctatcgctgtacggaagcccgatccgcatgcggaacgatcgccggattcccggctcgccgcatggtcgggcaaacaacctcattaaggatagtcccaccgtgagaatttgccgtacggacggcggtgattccatcaagagttcactttggatgatgttttcggcgccgtgtattggatgcttattggatgatcggcttccacagcggcatgccgggcgcgcgcaacgattcgggaccgttctcccagtcggcgaatgatgcgatggcggggccttggttgaattcctcaagcttccaagtgggacggtccgcgttcctggggtcggtgtgcggggtcatgcgcgtccagaaggcgttgcgcatcgcgccgacgttgttgagatcgtcggggtccatgtcgagcagcaccgccacggtggccacgatccatgagccgtggccgacgagaagcaatgtggtaggcattgtctcgtcatggtgtttggcgacgatgtcgcgcacggcttccgcgccgcgtcggcccgtatggatgcggctttccacgccatgcttggtttcgcctcccgtgtgggcgcgccaggaatggtagtcgtcggcgtaatgctcgcagatctcctcgcgggtcatgccctcccattcgccgaagctgcgttcgcgcagacgcgggtcgagttccacgtccagccccatgaggtcggcgaaggcgtgcgcggtctgctgcgcgcggaacagatccgatgagacgacgagcatgcggcgggccgtggcgggcgcgttgttgatttcgctgatgtctgcgagatgcgcgccttcatacgtgggttgcgcgagctggtcgttatgttcggcgagatgcgcgactttcgcccaatagtaggttttggcgagttcgtacgcgctttggtccgcctgccaccgtccgacgatgtcgaggggaatgtcgatttgtccttgcagccgtctggcgagattgtatgcggtgcgtccgtggcgcaggaacagtacttcgtcgatcatggttctcgctttcttggttttcgcatccgatcagcggattgcccggaagccgacgggaaacggtaaagaaaaaggcttccgaatctctccggaagccttccaatcgtggagctaaggggattcgaacccctgaccctctccatgccatggagatgcgctaccagctgcgccatagccccaatatctgctctgcaaaccttgtataagatacaacacagagcagaatcatgcaattcgcggcgtgtcgggcacgtggtcgaggaaagccccggacacatgcctcataggctatttcgaagtgtccgtcccattgcctgacgtgccggatgacgtgccattgggattcgaaccgttcggcgtcggattctggttcgtggatgccgaaccattcggcgtggtggtcgtccccgtacccgactgtcccgaattgttggtgcctgacgtcgatccgtcggatggcgtagtggagtccgtggacgaatccgtcttgttcgaatcgtctccggtgtcggtggacgagtccgagccgtcggtggacgttccggtgccgccggttgtggaatccgtcttcttcccggtgtccttgccgttgttcctgtcggagttcgtggtggaatccttatcggtgtccgtcgtgccggactggttctgcatattgtcctgcgtgccgttgtttccgctgccgtaggtggaatcgccggcattgtcatccgacggcgtctgcttgctgttgaccatgtcacgcaccacggtatcggttccatgtccgcccgtgaacgcgaggatcagtccggcgctcacggccacgccgataagcgcgctgacgatcgcgatgacgatcggcgcacgcttgccatgcagccaagcgtcaaacgacgcccggcgtccagcatgctggatacttccgccggcattgtccggaagcatgttcgattcgcgtcctccggcctgcgtggaggaaatgacacggcctgacgttgcgggcatcgccgcggtcgtatccccgtccacggacgtcatgaccgtggtctcatcggattcctccgcggacagcgtcttggtctgctcgccctcggattcggcgggagcgatcaccgtggtggcgtcatcgccgctcttgccggcaccgtccgtaccgtccttgtcgttggtcacgaacggtacggcgttttgcagcttctcccccgacgccttgagcacgttcttgtacacctgcgtcgcaacggccgagacgatggaaccggcggcgacgccaatcaccgatcccgcgatgccgatttttgcggacagcaggaacgaggtcaccgcggcaagcgcgcccgcgaaaatcgatgaaaacgatatgcccttgaaaaaattcttcacagagcatgacggtagccgattacgctttgaaaaaacttgcgattctgtgaaaagcttggaaaaaacttgggaacgggacgcgcgtcatcccccgttttcgtcggcggctatagctgcggatgctcccactgctcggtgtcggcgatcgccggaccatggttgtagtcgaccagacgccaccgcagcgcgccctgtagttccaacggcgccagccgcacccaatgcgcgttgcgcatcgacagaatgtcggcgaaatcgccatgcacttcgctcaatcccagcagcgtctgcaacgtctgcgagatccaggcaccatgcgagaacacgtacaggtcggtatcggagccggccttcgacgcccaatcgttcaacgcctcgacgccacgcctgccgacgttctgcttcggttctgcgccatacttgagctcgccgccgcggaactgggcccatgacagataatcctcggggaaccgtttggcgagctcttcgacggcgatgccttcccaatcgccgaagctgcgttctcgcacacggacgtcgggatgcacgtcgagtccgagcgggtcggcgaacgcgtgggcggtggcggccgcgcgtttgagatcggagcagacgaccagctggcatgccgcttcgggatgacggtccacgtacagttcacgcaatgcggacgcggtctggcgaacctgccacatacccacttcgtcgagcggaatgtcgatctgtccctgcagcctgtgctgcgcgttgtatgcggtgcgtccgtggcgcaccagtgtgatggaacgcacgtgtggcgtcatggtctcatcatggtcgagttcgacgtttctgggcatgcctctcccctatctgccggttgtctttccgatttattgcctgtctgccgtcgtattcggattgctgggacggcgcataccaaaacgtgccttccgcaggattttcgggaaggcacgtttcgatgatggatgaaaaatcacgcttcgctggaagccgtcggctcctgctcgccctcggcgtgttcgagctgcagatcgatgctcgggcagtccttccacaaccgttcgagacggtagtattcgcgggattcctggtgcatgacgtggatgacgaaatcaccgtagtcgagcagcacccactggccttcggtcaggccttcgcgggagcgcggctggcgtttgccggccttgaggtacaggtccttctcgatttcctcggcgacggcgagcacctggcgttcgttcgaggcgctggcgatgagcatcgcgtcggtgatggccaatggttcggtaacgtcgaacgccacgatgtcggtggccttcatgcggtcggccgcggctgcggcgatgcggatggcgtcgatggaatcttgcaatgcaggcatgttcagcgctcccattcgggcttccagccctctactacgtgttgcgtgttttcggaatagaccatggagtcggacgggacgtcgtggcggaccacggagccggctccggtggtgacgccgtcgccgacggtgacgggggcgacgaacaggttgcccgcgccgacgtgcacgttcgatccgatggtggtgtggtgcttgtgcacgccgtcatagttggcggtgatggtgccgccgccgatgttggtgtgctcgcccaggtcggcgtcgccgacatagctcaggtgcggcaccttcgtgccgttgccgatgtgcgccttcttcatttccacgaacgcgccggccttgcttccctcgccgagctcgttgcccggacgcagatacgtccacgggccgatgttggccgcgcggccgatgtgcgtctcctgcacgcgggagcgttccacatgcgcttcggcgtcgatggtggcgccgatcagcgtggtgtacgggccgacttcggcggcttcgccgatcaccgtatggccttggaggaagcagccgggcaggatcaccgcgtcgcgtgcgatctgcacgtcgtcctcgatccacgtggtgtccgggtcgaggatggtgacgccttcgcgcatccaatgctcgcacacgcgcttgttgtgcgccttggcgagcgcggcgagctgcacgcggtcgttgacgccttccacgcttagcgggtcgggggcggcgaaagcgccgacggctccattggctttggcggcttcgagcgcgtcggtcaggtagaattcgccctgcgcgttgttggatttgaggttggcgatggcttcggcgagcagtttggcgtcgaacacgtatacggaggtgttcacttcgcgtacggcgagttcgctgctgttggcgtccttttgttcgacgatgcgcagcacgttgccttcgctgtcgcggatgatgcggccgtagccggtcggatcgtcgaggatggtggtgagcacggtcgcgccgttgccgcttttctcgtggaaggcgagcagctggtcgagcgtgtcggtgtcgagcagcggcatgtcggatgcggcgatcagcacggcgccgtccagatcgtccttctgcgtgagctgcgccatcgcgcattgcacggcgcggccggttccggggatgtcgtcctgttcgacgatggtgacgtgctcgttgtaggagcgtgcggcttcggcgacgcgttcggcctggtagtggaccaccacggcgagcgtatcggggtcaagggccgccacggagtccatgacacggttcaggaacgttttgccggccaaggtgtgcagcaccttcggtttgttggaacgcatgcgggtgccttcgcccgcggcaaggatgattgcggcgctcagtgccatctttcgccttccgttttgctggttttcgcgggaaacgtccattccagacggattagtggaggacgcttcggatttcaacgcaaccgtgattgtataaatagggttcggacaatgccgcagccgtcggaaacgccttacgacgcctgcgaaacggagcgtgcgacgcatccgtacgcttcgacgagtccgggcaggtcggctttggcgttcgccggactggtggatggcagctgcgtcatcggcatgccgtccaatccatgcgcccgaagcagcggaacgcagagcttacggtacagttgcgcggctttcgcgccagtggtgaagacatgggcgattttcgatcgcatgattatcggggaaagatcattgggcaccgcattacggatactggcatcgctcgctccatcgatgtcgcacgactcaatcacatcccataacgccatatggtgacgcaaagcgaaatccctacgcaaccccacaatctggtccgggtcccggcactcgcgcagacaaccgtcatcatggaaaacagccgccatgaccggccagaaacgattgcgcggatgaccataataaaaccgcatctcacgcgacttcggacttggcacggaacccaacaccaacacgcgcgatccggcatcccaaaccggaccgaatccatgttccacacgcatgggccactctcctaccaccgcatcgaataccgcgatgcgccttattgtattgcgcaatgttgcggcacgacaaacggacgtgtatgttgattgcggatacgacatgagcagcatattcaaaggagaaaacatgctcgaaccgaccaccgtctatacgccatcgccaaaccgatacgacagcatgacctacaaccatgccggcgaaagcggcctcaaactgccggccatatccctcggcttctggcacaacttcggcgacaccaccccatacgacaccatgcgccgcatcgtgttcaccgcattcgacaacggcatcacccacttcgacctggccaacaactacggccccgaacccggatcggccgaaaaaaactgcggacgactcctgcacgaatacttccaccaccaccgcgacgaactcatcatcagcaccaaagccggctacgaaatgtggaccggcccctacggcgacctcggcagccgcaaatacctgctcgcctcactcgaccaaagcctcaaacgcctcaacctcgactacgtggacatcttctaccaccaccacatggatccatccacaccactcgaagagaccatgggcgcgctcgccacggccgtgaacagcggcaaggcgctgtatgtgggcctgtccaattatgatggccccacactcgagaaggccaccgccattttggatgagatgcatgtgccgttcatcatcaaccagaaccgttacaacatcttcgaccgcaccgtggaacgcaatgggctcaaggagaccgcgcaccgtcttggcaagggactcatcactttctccccgctcgcccagggactgttgaccaaccggtatctgaacggcgttccggcggacagcagaatcgcacatgacggacgattcctgcagcagagcgcgttgacgccggaacggcttcagcagattcgcgacctgaacgatctggccgccgagcgtggacagacgctcgccgaaatgtcgctggcttggctgctgcacgacggcatggtggcttcggtgctggtcggagcgtcccgtccacagcagctgatcgacaacatcggtgcgcttagaaacacttcgttcagcgacgaggagctccggcgtatcgacaagatttcactgtagccgggccgcccccgcgcggcagccgcgcacgaggaagccgggctccggacggaaccgcaacaaatgagccgggcgcgtacgacatcgatcgtacgcgcccggctcatggcttatgcggtcgtggatcgcaggctcactcctgcgggtaggagtcgtcgaagaagcggcgctccagatgcacgatggtgcggaacacttcggcttccggaccatcgatggagcagtattcgttgaccagggagatgaggtcgccgacccacttgcggaagtgcgcgccttcatgcaggtcgacccagcccttgtgcgccggcacctgctggatgacgtcggcgtcgacggtgcgcttggcccatgcgaggtacagccattccatgcagcagatcgcggtgatcagttccggccagctcttgtcggacaggctgtcgaggtatgcgccgtactccttgttggccggggtcggttcggtcgcgtcgtattcctcctggctgacgtgataggcctcgaggaagtgctcgaagtaggtggcctcgttgtcggcgaaccactgcgattgcgccgcgagcatgtccttggtctcctgacgtggggcgagtttgatgagacgcgccatcatgccgttgttatagaacttgaaatcctggatcaggtacgccttgaggatggattccggcaaggtgtcgtcaagcagctcgctgacgaaacgcgagttgatggcgtcgtaccagtcctcggtgttgagcatgtacatgaggtcggcgacggagccggcttccgcgcccagccaggcgtagtctccactggcgggtttcgttgcttctggaacgtggttggtcatgattttctcttttcttggatacgccggcggacggccggcatgttttctgtgtttgttgttggattgtgagttgcgtggttcaggccacgacgtcggccttgcctgattcgaagcggtcgagcacaccggttttggcgagcgccttctgtacgaaccacatgagcgctccgccgaatacggctccggagatgacgcagcagacggtgaacacaacgccttgcagtgtcgaccagccggcggtgacgacccactcgtacaggccattggataggccggtcaacgcgccggccagggtcacggtgagcaggttccacttgcggtatgcgaagaccgcgaagccgatttcggcgccgagtccttgggccatgccgatcagcagtgcgtgcgtcacgccgaatggattgcccagcagcgtttcgatgaccgcggcgatggtttcgccgaagaaggccgcgccgggcttgcggatgatgatggccacgagcgggccggcgaacagccacatgaaatggaagagtccgcccagtcccggggtgaggctgtcgaacagggcggtcgggacggcgtagatgaagtcccaggcccagaagatcacgccggatgcgacggcaacaatcgcggccacgacgatgtcgaccacacgccatttgacgttgggtttgcgaactgcggaagactggttttcttcagtcataaaggtatgtgcctttctcttatgcaaaggcacgggaagtagagagacgtccgtgcgccggcattatccggtatacgttcatacggttgaagcggtcgcttcctctcagccataatggcccccgtgtccgcaagcgatattacatggttcggcgcgtttccaggctggtattccacatgtcggccaaaagtctcgtgaaatggaaaaatgggttccgtgttttcccgaaagtcctgggccttcggaaaaacacggaacccatcgatatgcgggaaagccgctgtcggctatgccaggatcgacgccgtgtcggttaccgtgatcagcggttcgaacaagcgcatcgtgttgagcgccagttcctggttctccggggtgctgccggcgcaggcgtcggccggaacgcgcacggccacgccgttatcggccgcggcgagcacggtggtgagcacgcagcagtcggtggccacgccgcagaccgtgattttcttggctccgccgatcgcgtcgatcagctgttgtccccatttgccgaatgtggtgcggtccaccacctgatggccttcggcgagggcggcggtctcgtcggtcaggtcgtacatcgggtcgtccggcggtaccaggaactgcggccagtccttgaagtagtcgacccaggcgtcctttggcggaatcggcgcgacgtagcgcgtgtagaccacgcggtcgccgaacgccttggccagttttgcgaacgcttcgttggtgtcgtagtaggttccgtcggcgcaggcccaagcggaccattcgctttcggcgaatactttctgacggtcgatgacgaccagccactcatcttcagcgatcatcgtatgttccttcctgtgcgatcgcgccgttcgtcacttggcttcgatggcatccgccgtttcggatgccggcaggtcggcctcctgcttggcgatgtctccacgctggaacgccaacgcgccgaacaggccgacaagcagcgccacgatcacgccgaggttggcggatgcccagctgccgtccttgccgccgatcaggaagaggaggtagccctgccaggtcagccagttcgcggcggtgttgaccacgaggccccatacggcgtggatacccccaagagatgaaaagcgcgccatggctcgaaggcaccctgttcatcgatatgaccaccaaacgaatcgtctgggccgaagaaagcgaaggctgctaccttccccggctcatcaacgccctgatcgaactgacatggccaggatggaccgcaatctggtcccccgaagacacacgcggcacattacgcgccaccggagccgacacagacatcatctacaccgatcattcgttcaaagacctcggcgacttcgacgccgcatcggatatggccccatggaccatatccaacgaaaccgacgcattctcctgcacaacagaaaacaacaaaacaatcacttggggaaactacatcgacctcgaaaacatagccctactcggccccaacaaaatgcatacgctcgtcaacaaagtcatccaaggctgcaacgaaggcaaaccctggcaatggaacctccaaacacacaacaaacaacccgaaaaaggcatccacatcgactacataaacaaaacaataaaatggtggtccatctacgaagacgactgggccatcaacccattcaacgcactatggcccggatggacgctacattcaaaaggcgacaactacgaatggcacgaaaacatcaccggatataagatgcgcgactggaaacaaaacgtcgcacaatgcaaaaactcactcacacaaaccatcaaacaaggcataagaaccaaccccatcgaacgactgacaggagcgctcgcaaaacagggagttgacatgcggattcgtcccgccacgttccaattcgtcccttcaagaatggagcaaccgccggaacgcatcttcgcgtatctggaccgcttggagtcggacgagcctctgtcaccggcgcgtttcatcaacagagatggcgaaatcatcccggcgtgccagtagacgcgcctctatgcacggccaaatctaataaatccatcacggttttcttatttgaacaggtcaaacaggctgaaagtggtcttccggtagacggtgttgtacagcttgcgcttgggatgcagccagcccatgccctttttgccgtatcctggaatcagcgcctttttgacagcacgcgtcgcgcgacctttcgtacgtgccgacaggctcttttttcaacttggcttcctcataccgtatttcatttcgaccccatttccttcctatgctgtttcgattccgctatcgacgcgagctgtcgcatgtaaaggctttccggcgtctggtcgtacgcgaccggcagaggatcgacggacagcatcgattccaccgcgtcacacagccgtcggaaatccttctcctgctttttcgtgtagatcgcgcagtacggcgacttgcgggactcggacgcgctgcccagcatcggcgtatctccgtccaacgtgcgcacggacaggcagaacaggccgttcgcgaagaccgtcgccttgccgggtgccacgtccacgatgctgccgaccggtatctcggtccgcgcgaacccgtacatggacgcgacgattccgccgcgttcgatggtgaccacaccatcacacagcgtgaccgtgtacccatagcccctcgcgcatattggctcaaatccgacgccggctcttaccatttcctccgtcatacccccattatcgctcgggccgacgggtgaagtggtgcatggcaagtcaggcatgaccgtcacgcgttcttcgcgtatctccatgtcatgccccgtccgtttaaggctgggattgctcataggtcggatgccgtcccgcatgcggattccccttcgctttcgatgtccacgctcccctgcttgctttcattggggcttggatcgagtagtggctgccggcttttccttcccgcgtccttcaggaccttcaccagctccttgttggcgcgtttcatgtatttaaggctgcgattgagtatcttgagcatctttttgggactggccttcccgtcgccgtccccgtccgccccaccgtcgcgtatgccgcgtctgaccgcttcggttcttgcctcgagttcgattatccgcctgttgagcgcgacgttgatcccatacgcggacgcgaggtcgccataccgtttgacgagcacgtccttgcagaacgcggtcagtttcgcgcattcctccaacacgtagtcgccattcgtggccatcgccatcgacgccgccgcggacattcccgcgccgccggccgcgcccaacacggccccgccgccgacgatgagcatcgtcccgccggccattcccgcgccaccggctatgagggaaccaccgccaaggaacgcgaggctcgcgctggtgagcgccgccccgtacaatccggcggcctcgaagccgaaggcggcggcgaacaccggtgtttatggtcaaataaacgtgtacggcgtcaccaccaaatctgaacggcataagcgttcatattggacacggacggcggacggaaatggcatcggcggaagaaaagcgccggtgccgtacggttcctgatagattcccgagtgctaacaaccaacacatggtcctcgggaggaaaggaatgacgacaccggtgcgtattcaacagagtatcaggcagctcgagacgaaaggcctgacgcatacgcagatagctagggaactgggcgtttcgcggacgaccgtggtcaagtacgcgacccgcgattattcgcccgttccgccgaccgggggaactgcgagccgttccctggtcgcgggcgagtacgcgcgcaaggccgacgaatggctcgaggccgaccggcgcatgccacgcaaacagcggcacaccgcccggcgcgtacacgagcggctcgtggaggaatgcggcttcgagggcagttattcgtcggtgcagcgatgggtcaagcgctggcgccaacgccaccgcggcgaggccgaggggttcagtgagctggaatgggcgccgggcagcgcgcaggtcgatttcggccaggccctggccgtggtcgccggcgtggaacggaccgtgcatttcctggtggtctcgttcccgtactcgaacatgagatacgtggccgcgctgccgggagagaccgcggaatgcgtgtgccatggtctgaacaaggtgttctcccatgccggcatggtcccccgcgtgctagtgttcgacaacgccaccggggtcggccaccgcagggccgacgggaccgtcacccagacgaggctgttctcgctgttctgcgcgcactacggcttcgagacgaggttctgcaacccctattccggctgggagaagggaagcacggagaacgcggtcggtttcctgcgccgcaacctgatggtgccgacgccgtccgcggagggatgggaccggctcacggacgcgtggttggaacgctgcgacgagatcgcgcgcggcgtccactaccgcgaggacgtgccgatccgggacctgttcgagacggacctcgaccacatgctcccgctgccgccgtccatgttcgacgcgtgcgactggcgcggggtgaaggccgacaggaccggaacggtcacgatcgactcgaaccgctacctcgcgggcccgaaatggcattccatgcgtctcatggccggcgtgcgggccctgcgggtcgagctgcgttccatggacggcgagccgatcgtcacgttggagcgcaggtgggggcgcagccccgacaccgcgatggacccgctgtcgctgctcgccatcatcgcacgcaagccgcgttcgtggggcgagagtcccatacgctccgacttcccggaggagacgcgcgtgctgctcgaccggatggagccgcgcgaacgcggcctgctggtcgacgacatccgccacgcggccgtggtgagtggcttccgtgcggccgtcatggccgtcgtcgagatcgtcgccgcgggcagaaggcccgacagggccgcgatcgaccagacggccaggcggatcgcgcagggcgacggtcccgaatcgagggccaggctcgacacgtacagcaggttcatgagggaggacggcgatgagtgagtcgacggacgccgcggcgggcggacgcaggggcgggcggaccgtgagcaagtccaccccggacgaggtcatggagctcgcatgcgggctgccgttgaccaggagcgtgctgcgttccgtggtcgcgggcgccacgcccggccagctcggcgtgctggccgacctgttcagggccgagaacgccagccggacggaatccaggcgcgccaggctgatcaggaacgcgggattcccgtgcgtcaagggcttcgacggatacgactggggcatggcgtcgttccccgccgactgggggcgcgagcagctcatggacctcggtttcgtggaccgggccgaggacctcgtgctctacggcgacgtgggatgcggcaagacgcacatggcgatcgccacgggcatgctggcgtgcgagaggggcatgccggtgaggttcttcaccgcgtcgtcgctggtgatgcgtttgcggcgggcgagggacgagaaccggctcgacgcggaactgcgcgcgataggccgcgccaggctgctggtcatcgacgagctgggctacctgccgatcgacatcgacggggccaggctcctgttccaggtcgtcgcggattcctacgagaagcggagcgtggtgttcaccacgaacctggagttcggacggtggggcgaggtgttcggagacggcgacatggccgccgcggtcatcgaccgcatcgtgcaccacggaaggatcgtcaggttccgtggcgagtcataccgcaacagccactccctgatgaaataaacgaaaagagcggaaccaacccggccgccggtgacggtgtccattttgaacgccgatggtgttcagattaactggtgacgacacgcagatttatttgacgaaagacatttggcagaagacgtcgccgatgtagtccgaacgggctttaaggcttttatactccttgtcgttgtctccatgcagagggaaatagggtttgaacatgacaagctccaaagccacgagccagagccattcgccattgccggccccgacggtcccgttgatctcgtcatacagggattttccgtcgaggaagtacccgtccccttcaacgccgatggtctgcgtgatccgccgcgaccactcatcaagccatttccccttcctctcggcgtgcctgtcgtgtttctcccgttcgatgtcgtacaggaccttctgtcgcatgagggaatggagcacgcgcgccttttgggggtcaagttccagacaatcaaggtccgccagctcgtgttcgatggcgtccctctcgcgctccgcatcgtccttccacctttccgccatcacagctttcgcgtccacgacgcaggacaccacgaaagttgcgattccgacgtagttgacacgcagcaggaacacccgcgccttgtcttcgcccgccatcgcgtgcacggcggcgtcggcgatgtcgacacccacgaacacgccgctggacacggtcagcatgcggcgcatggccggggttccccacggaaggacatcctcgggggcgatacgtccgagatccccaacgccgccgatgccgagggcgtcgatctcgcgggagagcctgcggcagaagtagaaggcgcgcgtgacgcactggttgatgacgacgggcatcgactgcctgccgatctcgcccaggacaccgatctccatacgcaggtcgaaccggcgttccgtgcctttgatgatcctcccgtccgcgtcatgctccgccaggaacgtcccgttgaacattttggacagccacagtctgaagcccatgccgtcggttccggaatccctgaagaacggcaggacggacagttccttcatgaacgagagcaacggtccgggaattcccgtccccgcgccggcgttaccgctcgaaccggccatgtcgctcaccatgtggaagaaccattcgacggttccgaagacgagtttttcgggaacgtccctgcccagataccgcctatggtcctcgggaatccgcacgacgaccagccttccggccgtgtcggttccgatcgacagtccggtgaactgcgtgaagatcgacgcggccaaaccaccgatgccgaaatggtgggcgaaatccctcaaatggtgctgccgtccccctccgaaatccggagtgttcccgtccgccgccagcggatggaccttctcgaggtttcttatagcctccttgagggaatcgcctttgtatccctcggcacaagcgattccgacgaccaggcgttcaaccgttttggaaccccattccccggcgcggtccaaggagagctcgcctacgaacagggaatcgaccagaccggcgacgacgccgctggccgccgcgacggcatagtcgaccctgtccgccagatccaaccggggatcccattcgatatggtcggacaaccgttctggcgtgtcctgttccgtctggtccggaaatccatgcgcagaactggtgcctccggatacgggcaggagccgtcgccggtccgggaacaccaaatcgtaactgacgatcggcatgtcttcatcaccataatcaaaccgctgtgccatgcaataacatcctccacgtcgctgcgtatcaagcccagagagaaagcgttactttcaacgatactcgcagaagactgaattgatgggttctagcaagccgacatgagcactatcaggaattagttcgacctcaaccacacggaagttgacaaaatctcgtaattatgttgggaaccaaaaaggaaactgccgacgcttccaagctcattcgattcaggacaaatgcatgacaaaaaacgttgtgatggcgatgtccattgctgattcatcaccatcacaacgatttccctttatcactgcagggctttcacctcgtcgagtagggtctggtaggttgtcgcctgctcgtagcgggctccgtcggcgaggtccaggtcgttgaacgggcgcttcgtgcaggcgatcttgctgttctcgattccacgcaggtcgaacgactccaaggtgcccttggtctcggcgacgaagaacagacgcttaaggccactgtcgtcgcggaacgccaccgcccagtcgggcgcgtagttgcccacgggggtcggtatctggaatcctcgaggcagcttcgcatacaccgcgacctccgcgacgccggcgaattctaggccgaattcgccgtgcgtgcgcaggttatcgtggatgacgatgcagccgaacacggcatgatcgccttgcagtattcttcccggtgtgagaccgggatgtctttcctcgagttccgtccagatgccggctcggtctgcaaggtcgcgcagtgactggctgtcctccgtcagaagcgtcacgttgcaacctcgcccgcttctggtgtcgtagatgtcggagaatatcaggatgtttccgctgttctccatgtagccgatggtttgttctagatgcctcggcaccagtatgcccgccaatcccacgttcggcgatgacaggatgatccgctcgtgtcccagccgtttttccggagttggacatagagggaaaacggtggcactgtcgttcagaagtagattggcagcaaagctctgtttgttggcgagcgcgcattatatcgcgcactcgcaatgccaattcgcgcactgtcgcgcattggagagcgaatcgcgtcgtaatcgcgtcttcacgaaacaagccgcgtcgtaatcgcgtcgtgtttgcgtcgtaatcgcgtcttcggaaaacgcgcaatgctctgcggagaagtccgaagagcattgctgtttgccaaccgctgcggcacaatgcctgatttgtcagcgttcggtcatttcgacgaggtccagtttgaaaatgccgttgtcaggattgtatttgtccactgttgctttgatgtggacgttctgtccttcgcgcacgaaggcgggaatgccgaccgaaccgtcgtggaaatcgctccaagtgattccttcgaatctgaaacttggtccattaacgctttccgtgctgtaatcacctgcgtataccagcgtatcgtcaaacaggtaacgtggatgcttatcgttgggtataatgcttgcaatgttgccgtcgaattcaatagtgcgtcccttgtatttttcggcgaatgcggcaacggacgaatcgaaaggatctttcactccaagcagagcagcgaattccggattgttggcagcggtgatgatgccgttgctgtcggcctgctgcggtttttgctgttgtgcaggttccttttcccggacggtcagggtgacttcgccatccgtcatggactggttggcttcggtgacggtccattcctcaccattctgtacagcggttttcactgttgccgtctggtcgctgccgtctcccccgtcaaccaagaacttgtaagacagactcttcccatcaagttccgatgtcacctctttcacggaacggttcttcagcgaattcgtgttgaccttctcgaacgaaggcgtggacggcttgttgttatctgcagaatcgtcggaatcggtcgtatgcgaatatgacggggtggtcgccggtttgtcgttcttcgaatcttcggatgacaggctcatgcagaataaggcaatgagaagcagcacaaacgcggccacacagccgataaggatcgtacgtttccgcttgtcctctaatagggccgcaaagccatcggatgccgttgccgtatgcgtttcaacttcatggtgatcggaatacccgtcggactgtgcttgtttcttatcggaaggccaatgcggtgtagatgaaacggcgctttccgtcatcgcgacggttggttcggaatcggcgtcattcggggtaacgggaattgtgaccgtcgaagccggttcctccgtccgcacttccgcccgttcttttgaaacgatttccgcggcgggttccggttccgacgaaacgttttctttcgtggactccggttccgtcttctccggaacgattctcgtatcggtaatcgaatctgccttcttttccgcgatttccgtctgcttattcgattcagtatccgagccagcgttcttgcgatcgccagggaacgtcatacgcggcatatcttccggaggaatcggcatggttcgctgtgatggggaatcgtcgtacaacggtttgttccaaacctgtggcgtatgggtggcgtgcctttcagaatcctgttcctgcacccgcttcttttcctcatatgccgagcgtgcctcttcgattgagtctccgagattttgcgcggcgcgactggcttcgtttttcgctttggacagtgcttctttcgccttggatttaccggtttcgagtttgccctccaaatcgttatctttcgcgaacttctcagcgtttttcctggctttggaaagaagaccacccaacgtcgtcggctgctggactggatattgaggcattgaatactgtggtgccggctgggcttgcaacggcatgggcgccgacgattgcggcgttgccggatacggttgagacggcatcggatattgcgattgaaccggctggttttgaggaggcatggcagcagggaattgcgatgccggcggatactgttgagatgccggatattgatttggcataggctgcgcatacggttgcgccgtaggcatggcccgtctgccggacggccggtttttcaacgtccaagctatacggtcaagcagcaaatccacgtcgcctatagcatatccgcccatatacgtagaggtgaaggagtgccgctcgacctcttcggcagacaacccatatccgttacgtaaagtgtcggcgcattttccgaggaacacgtccacttccgccactttgtatccttccgcgaaatttactaccggaagtttgactgactgaagctcttcaatagtaatcgtcccagttggataaatcatatcggcaccctcgtctactctcttggaaacatgccctcatgctacaccttgacgaaaaaaataattcagttgaagtgtcgcgaatgacgcagcagcacccaccacggatccgaagacaggcacctccacatgacttctcgttacaatcagtcttctgtatatccgaaatgctctttgactttctgatatgtcgttttgtcgttgagcatgtaggcagccagcgggacggttgtcatccctttctcccaatagccatcatcaacatccgtcacacttctcttccatgcaacgcctataaacacttctttattggaatcgagcttctgctttagttcttcggattgccatgatgcatcagatacgggtgtcggaatgccatcggccatcactttgaagttcttcattggcaccgcagtggacgtgcattttcctatgccaacgaatccgcatccggcaatgtagcagtaaaccgtgtctccaacttgaacgttgtagatcgattttccgctgccgccaaggctcgcggacaagaacccgtatttcaaggcatcaggccaacttctttccgcgtagccaatcgtgaattcgcgtcctttttcgtttttgaaaaaagctttttcttcatcgtcgtcccagccgcctgcaatattcttgatgtcattcggattccaaatgtcactggccattttcaaataaatctcagctcggtcaacaatgctctgcctatcgaaatcgggaatatctcggaagccatatttggcaacgactgtcgaaagaaaactcgggtttttcgagtatgccgtactactcaatgcttgagcaagaatgttgtctcccgcatacttttgaaccttctccgagtatttcattgcctggtagcttctgttcttgtcacgagtgagcagaatcaggttcccgatcagattgcgagtggactcgaaatcctcaagatccgcaaaaccatctttgtaatcctcgtatttgtcgggaagaatatgttcgatatcgtaagtgtttccttgtcgcttacggtcgacgtattcttcaaagtgcgacggattgcccatcagcacgttcacataggaagtgaagcgtgcaagaatgtgcagcatataccgtttggagaactgattcagaccaaaacgggtgattccttcaacggacatgcccatacgacgaagcgcacgaacataaaccataccaattgttttgcaatctgcattgcgaatgtcctgcattacatggaacaactggtatttattcgtattccagttggcctttttgaaattcaaaattcggatggtagcgaagtcatctacgaatttcgccgtcatccgtatcttcttttgtattatgtcatcagtgtcatcatttttgatggcggcaatggcgagcatggtttgataggtcaagtcccggtttgcgttatagaaaacctcttcatatcccgtcgtgaatttactgccgtaatccatcattcgtaaatagacgtcggtaacacgcgtcatttcggtaagaacaaaattcttgtagtcattcggcttggcaagccccatcacggtacgggcattattgcttacccaagcatggaatttgtccccaagaagctcatagtcctcatctttggcaccgcgtttggtatcgcgcatacggttggcgtactttgcgcgaagccagatggagacaaactccacatcctgcgtgttcaccataccgctcgtatcataggaggacgcgttcttgatacggctgatattgctctgccactcctggttgaccttaatgcgatcctcttcagcaacatgctgaatgacgaaggccttcatcatttcagcactattcaagctcaatccgcggtcgttcatagtaaggaatatggtgtgcgcttcgtcttcagatggtgtgtcgatttctagaagaagcactttctctatcagccagttaataaagtaaggtagcgcttctcctttcaactcatccgggaaaagatcctcaatatcctgatatcgatcaagcatattctgcacactctcactcatgggcaagtaggtttgatctttctgtaacagagcttgcatgcaaggcttgcgatcctccacgtcgatattgaagcttttcttaccgaaagcctttgaaaaaatcatgtcatccaacggaacaataagatcctcgtcctcaactgtttccttctgcaggttgttcaagtaaatgatgagcaacgtcaacgaggtcagacgctgctgaccatcaataagcttctttatggatccaccggtgcaaatgatgcaacccatgtaataaaacccgtagtccatgacctcttctggcgtatcatgatcatccggtttatagaattcctcaaaagtgttttgaaagtcagcaagcatctgctcaatttgcttccttccccaccgatattccctttggaaataatcaatggtgtactttcggccactcagaatcgttctaagcgtgtctgttttatcgattttctccataactctttgccccatcaatttgtttttcggctttaaaatcttcggtgaattcagccgaatccatatgacctcgtcgcagacattgatacgacatctggaagtcatattcacgattgtttccggaaactattatcctccggctcagcccgataaagggaaacgacacgatggtaattccgtcgccgttagcaaacatcatacggttttgccatttgccagccaacgctgcagggttgcggattccactacaatgcagcattggtttcgttcgattgatacggaaacgcgaccaacgaccggcacactggctcagggagatggggtaaaggatgacgaagacttccaaggatgcggaaaacctatgagaccggtctctcaatcgccattcatgcaaaccggcgattcagtccgcagcaccatgcaagcggaatacatcaggcttcccttttcgcctttcccagcctccttgacagtctggtagcaggccgttccacggcaagatagaacgcctccgccaccagaaggcacaatgcaaacaaaaccaccgggcgcaatagaccctgcacgggaatgtacggcacaatccagtcgcggacgggaagatgggtcagatacaggctgaatgaaatgcgccccagccaacggacaggtggcgtggaaagcaggttggataccacgttgcaggtaagtgcgaccaccaccaatatcaggcatccgcacacggccaaaggttgggcgacaataccaggcagcaaaccgaaaccgctttggcaaaccaagacgatgccacacagggcgagcggtacggcaacgacgtcgcgcatcgtctcgcgcccgttgtccgtaagccgtttcgccaacgcgacgccaagcgcgaacatggccatgtgacgcaacggcggccactgcgtccactccgacaacagcacgcatgcgagcgcaatgggtgccacgaatcgcatgtcggtggcgatgatgacgtatacgggcagggcgaggctgaaaagcaattcccagcacatgctccatgatggcaggtcgaccattgccaatgtggaaccgtccactctggtgccggcggtggtcattgaaagcatgtcgagttgggtgagcagattgtggagccagactgatggcgaggatgtgctgaacgcgtttgcgtattcttccgctttccaccccatatgcatggcgattgtggagacgatacagcagatcccgattaccgtgcaggtggggatggcgagtctggcgatgcgacgcagctggtagcgaggccagttgtatgtgtcgattccgacgcgtagcggaacgatggaaagtacaagtccgctgagaatgaagaatagggtgacgaattgggcgcctggcaatagttggcggagggtgcctcccgtgtaatggtatgcgaccactgccagggccgcgagtcctctgagcccgtccaaagcgtatatgcgtgtgtcggagtccttctctttttcgttcacgggtgtaccctatcacgtgcgctggctgtcatacatccgcctacgtgcgtttggcgtgcgttgttcggcgtgtgttcgacaacagtgccatcgtcgaacacgacgccacataacttccattcgtctctcttccccgcccgactgtagtgtcggatcatatggagatccgcgaatacgacatgatgacggacgaggcgcgcggcatccgcacggcggtgttcgtcgtggagaaggattatcgtccggaattcgacgaatgggatgagccgggccgagccacgcatctgctggcttttggaaacggccgcgccgtggcgacatgccgtctctaccctgatctcgaccatgccgatcaacccggacgttgggtgattggtcgtttggccgtggtcgccgacgaacgtggccatggtatcggcaagacggtgctggccgaggcggaacgtctcatccggaaggccggtggacatgttgccgccgtacactccgaagataagaatttcgcgatgtatgaacatcttggctaccgcatcaccagcgagcttttcgacaacggtacgcatggttggctagtcaaggcattgaactgaatccggaggaagcggccatcacctgcgaaagcgtccgacacgcggtatcaggtgatggccgcatatggcataatagacacttggcggaaaacctcgggttttatcgccgttcccccatggtgtaatggcagcacacgggtctttggaaccctttgtcttggttcgagtccaggtgggggagcaaaaaggactatgtctagggggctattccgaccccctagacatgaccggtccgagtccacctattcgtactggcaccctctcggatacggctcgtccgaatccatcgcctacgaccgaaatcttgccgtgcggacggccttttcttcgtaatttgcttgattccacggtgcaaggcggcaataggttgtgttgagccaatggattagcgattattcacagattgtgcattgattgcgcctaccgtatgattcgcagtgttgcagatgacggggattagcctaccgtttcggacaatctccgtgcgaacagcggaaggcgcaagacgcgcaaatgctcgatttcctcgctcatggtacgcggcggatggcgtttggagctgaccagtctgcgcatggcgtccatcgcttcttctggatgtgcatcgaacacggaggtaaggaaaacatccggcgattgagcgtgcagtccgtacctggaaagttcgtctgcggggaaatccttgaggttgaatgtaacgatggtttccgcaccggcccgacgggcggccgcgaccacatgcccgtcgttggggtccgacaaattcacgtccggttcaaaccgctcccaatcctccgccatggtcatcggaaaggccctgcagatcgcgtcaagaaaaccgcgggcccggacgtcgggcacatgccgcacttccatgatggccaagcgtgcctcgtccatgaccctcgcagaccatgctggctcgcgcagaccagcctcggccaagctaagcagtgggtcgatgatccacgtaggtacgaacaggttggcgtcaagcagcgcaatcataagggcactctacttatcgaaccgggacaggtaatccgaatagtcgatgtcgtacgcgccgtcctcatcggcgatggaacgcatctcatccaacgccttggatgtggcctcgtcgcgtctgcgcttgtagtcggtcacatccgaaagccgcaagaaacggtaactgcgctcccccatgcgggtgtacggaatcatgcccgcatccagcatgcgtgtgagcgtgcgttgggagaccccaagaatacgcgccgcctcgccagtcgtgatacgctcgtcatccgccaccgcccgttccggctccgcaagcagaaactccctaacgcgcctgtagtcgtccggcgtcaacgggatacgcgtgccgtccaccccttgcaggaacgctccgggaactccgccagcagagcgccgtgccttagacctcgtcctatggactttgccacccatcatcatggtcatcgcaaccacctccatccgttttcatcatacggcaaatggacacaatggacaatatgtggatcgggataatctagactgctttcaggttcaccgcggccaccttgaccgatacttctccttcttcggcgaatcctcgtcgccgtcggcaatcgcggtttcggaggtcttgccgtttcagtagctccagttgttccaatgcaggctcgctcggtccgcgttgtagccgaacggaatcatgacgaaccgttttcgcgagcggcgagaacggcattgcgaaggtccctcgaccctgccagcccatgaatcgtccctcgcttggcatgtgcaggtatcgaagactcgccagatccgtgcagcatcattgccttgcgattccggcgaaacgtcaaatcggccatgagcggccaaaacctcttgacgcaaaaaacaacgccgccttataatcagcccatactgccgatagatcgaatcgtctgcaaccgaatcgagaggaggcgaaatcatgtatgacgagattccgagtctgctgtatgtcgccggagctttaatcaccgtgctttcatggactcttttcgcattctcgaaaaccatccgtccagaaggtcgaagagccttcatcctgtgcctctccgttatctggatattgttctttgcgagttcgacactggcactcgtgccatatccgcttttcgaggcgtactcaggattcatggatcccgatgtcctcgatttctatgaccagccggtcatacggctattgccggcggtgacctgcggagtgaacctgtgcgtgtcggcaggctgttccatggttcttgtaggcaagcgttcgaagcgataggccttcgctccggatgccgacggaaggtcaatccccactggtgcagaaaaaggccgagtccgtccacgtcgagaccgacagaaatccattggtctttccattcaaaacgacgcaaagtctgccgttcgcgttgagaccggcagacgagccgcacttcttctgcttgaaacgacgcaaaccgggctgccagcgttgaaatcaacagaaaaccgttgacttttctgctcgaaacgacgataaagctaccatttgcatcgaaaccagcagaacaatcgcacttcatctacccaaaacgacgctgcggcaggctgcgcaacagaatatatgaccgttttttattctttctttaagatgaaccgatgagtctacaatagaaatggcgattgcggcatgacgtacgcatactttcctgcctatagtgaaggcacaacagaaaaacaacagaagatacagagacaagaaaacaacgaagcgacgagccgcgcgacgcagaagaagacaaaagaagaagacaggcggccgtccgaaaggaaacaccatgaagaacgacaccttcaaccagatcatcaacgccaacctcgcctccatcgacccgggcttcggccagttcgcactcgccaaggcctcctccgacctgatgaagaaggtcctcaacaagtaaggctttcccgattccaacgaatcacatggcgggctgccgcgtctaccgcagtggtcgtgggcggccgcctgggctatcgggcatatgaggaccacaggacggccatggcgcgcggaacgtgcgtgtcggcggccgccgatctggacagggccgccaaagagtgtaggaatctgctcggcgcggacgcgacaaagtcggcaagaccctcgagcatcatacagatcgaccggaacctgctcgagaccaagctcgaccgcctggtcgccgagaaggtcaccgaaccattgaacgcgatgcccggcgcttcaggccgacgagatcgccaacgccgccagatacgagcgcgccggggagcggaaggcgtaccgcgccggccactacgaccggagcctgaccgccaaggccggcaggctcggcctgaaggtgcccaagctcaagggcgaggtcttcgaatccgcggtcatcgagcgccacagacggcgcgaggaaagcgtcgacccgccgctatctcgacaggtcccggctcgatgacaaactcgcggaagcgaactgatcatcgtgccatggacggccatggtccaaagtgcacatcttttcgggcactaccgagaaggtcccagctttacagggggtattaatgacctttatctcacgggcggcgcgctatgtgctcagaaaacgagtgcgcaccgcggtgctgttcattgtgctgaccatcataacggcgagtatgctgtccgcaaccgcggtttctcaggcagctcaacatgaggccggacagattgaaaaacaggcggtcggcggattcgtgctggccagtaacctgcaaggcagcatgctgacgcctcgcggaggcggaatggttcgtcccgctgatgtgcaacgaatctcgaagctgtccggggttggctcgtgcatggtcaggcagaacgccaccgccgatctcgtgggagccagcgtggtgaaggtccccggcggcgatgattacgatgcggagaaagaacagcagttcggcaatacggccaacgtcataggcacaaacgattcgtcaaaactcaatgtgttcacgtcccacacgctcggcatggtcgaaggacgtcatctaaaggcgtccgataagcatatgtcgatggtccatgaggatctcgccaaaaccaatgggcttaaagtcggcgataccctcacgctcaaggccaatccatatgatgccgacaatgagtcgcattcgacggcaactgtcaaaaccaccatcgtcggaatattcaaaggggacagcgacagaaaggtatccagccgcgcggaactcacctccaacactgtgtacaccgatttggacactacaagtactctgtaccagtacaaggccggcaaggaaatataccaggatgccactttcgttctggacaggggtgtcgacgtggagaaaaccatggaagcggcgaagaagcttccggtggattggaacaactaccagatcacgcgcaatgaccaatatacgtcgagcatgctgaatgccgcccgaagtgtgcgctccatgatgcgcggcgctttgatcggcgtgaccatctcggcagtgatagtcctcagcctcatgctcttgctgtggatgaacgaccgacgtcaggagatgggcgtattggtgtccctcggcatcggcaagccatccctgatcgcccaatatctaaccgagatgattctgatcggcctgccgtccctggtcctcggatggctgtgcgcacggggagcggcccaatggcttggcacctcggccctccgttccgtgaacgcctccgcggcgaaggaactgagcagcatgggacaggtcggcggcgatcttgagtccaatatgtcggttcgtaccttggattcgctcacggtatcgatcgacacaaccgccgtactgtatgtatcgctcggcctgctggcggtgatgctggtatgcgtcgccatatcgtgcataccgatgctgcgcaagtcgccacgaagcctgtcggagctccgatgacgggcatgaacgtgtggaagcgtgccacgctggcaatcgtacgtaaaccggtacgcagcggaatcatcggactgttgatgctgatggttttcaccagtctcgtggctcaggtcggagcgtcaacggcgcttcagaaaatgtccgacgatatcggcggaagcctgggaataggttttaccgtcgacaccggcgagaatcccgtcagcccaaaggaagcgagccggttctcacgcatccccggcgtagggaaaaccgtttacgaacgtaagaccctggcgcaggtggatggcgcgcatccggttgtccccgaacatggtcctcgactggattccggcctatccacgcaggtcagcgtgctgggcaccactgactcctcgttgtccgaagagttccaaagcggcctgtaccggttggaacaaggacaccacatttcaggtaatggccggaacgtactgattcaccgggatttcgcacgtgagaatggactatcggtggaatcgaccttccgactcagtcaggaaggccgcgattccaccgttcgcgtggccggaatcttctctggcaatgtacaggcacagagccctataccatcggacgcatcggagaatctcatctattcgggcgctcaagtggtttccgcgctgactggagaggaacgggtcggcacgatccggtgcctctcggataatccgcgggatctttccgcagcaatggcccaagcaaaaaaaatcgccggaagcgagtatggcgtcaccgatgactcggcgcagctttccggcgtgctgcagtcggtggaaacggtacgcgatctggtccgcatggtgctgttgtccgtctgcctggccgatgtgctggtattgggcatggcgcttgtcttctggattcgctcacgcatccatgagataggcacccttctggccctcggcatcggcaagatgcagattatcgcccagttcgcgatcgaaaccggtctcatggctgtggtcgccgccctgtgctcgctgggaacgggctccctattgtccggttacgtgtcctcgctcctgctgcacgattcgggagtcgcacctcttgaatcattgcaggtggaggctctgccgccagaacagacgctgctcatcctgctgctcggatgcgcggtcatcgcaatcgcgcttgccgtgtcgtgcgccgcagtgctggccaaatccccgaaatccattctttcctctatgcgttaggagatactaatcatgactatctgtctgcaattggaccatgtcaattactcatatggcgcggcgaagattcgcgttctttcggacgtgaacgcagatttcgaatccggaaagatgtatgcgataaccggtccatcgggagcgggaaagagcactttgctgtctctgttggccggtctggatgccccctctgatggagtggttcgttttgagggcgaggatatagctacgacgggttattcaaagcaccgtcgcgagcacgtgtccttggtgttccaggaccataatctgatcgactatctcacccccgaagagaatctgcgcctggtcaatcccaaggccgatatgaagatcctcgaggatctgggtctgagccgtgaggaatcgaagcgcaacatcatgcacttgtcgggtggccaacgtcagcgggtggcggtcggccgcgccctagtggcgcccggccgcgcgattctggcggatgaaccgactggcagcctggatccggaaatgactgatgaggtgattgatcttttgcggcatgccgctcatcaactcggtaaatgtgtcattgtggtgacgcattccaaacgtgtcgccgattccgccgatgccgtttacaccctcagacataagaagctagccaaggcatagcactctcgcacagaccacgtcttccgtcgtggccggcaagaaccgcgccaatgccccttccgccatcgtcctcggctgcgaaacgggttcgggattgcgtcgtggatcggtgacgtttttgggactcgtcgccgatccatgacgcccatgccgacccccgtcctgattcgcactcgccctgatcggaccacacgcccgtccggcatcgacagaagtaagaacggccgggacatgccccggaaagaaacgaacccgcctcatcgaaaaggaaccaaaaatgaccgcacgacacatcgacgccacggacaagacggacggaagccatgtcgtcaagatcctatggaacgaaaacgacggcgaacgggaactgaccgtccgcatgccggcagccggaacggacgccacggaccgcgtggacgtggacctcctgcccgtcccgggagaggatcccgccacgacgatggacgatgccgtcgcggcgttggagggattcctcggcaacaacaagtacatccacatcgatggggacgacgtcagaagcgtctgcgtcggcgccctgaccacggtcatccgcgtggaaagcgggtcgtcgacgggcatcgtggaggcgctcgacggacggttccatgattcgagcgtcgcatccgacgaggtcacgggagcgataatcgccatcgaaggtccgaagagcctccaactgtccgacgccacggcgatcgtcggcggtgtgcagaagcgcctcaccgacaaggtcgagatcatatggggcctgaatttcaccgacgaggacgtcctgcgcgccaccgtactgctcgcaatacaacagaaataaagaacacgacgggtttgcatgcaggaaaatcaaacatcatcggaatgcctgttgcacttacaagtacgagtccccatgctaaccgctggtttccatgtcaccggggcgtcttttatccgtttatccgcgtcaacacgacccgcacggtcaggcaattcgggtcggactcccctgtggtttcgctgaagaaaaccgggggtgctacccaatcagctgttgtgggatttgcgccagatgagatacgagtaaacatacatggctgcgaccgagccaatcgcaagcaccataatcactgccagaatccaggtttcgggcaatatacctcctaaaaatcccagcacaatcaggctaacgcccaccaccatgaaacaggctccgccgaaacggtgggtgcggcgccagttgtcggggtcgtcgaacgcccatggcgttttgatgccgagcgtgtagttttgccgcacacgaggtagataattacccatgccgatgaagaacgcgccgatcgccccggacacgatgacgttgaccgcgcccttgccaggaaggaggttccagacggtgagttccccaagccagctgatggcgcacatgaataccgtgaacgagatcacgaatccttggtagaatccgccgaacttggcatatgcggcacctttcggatcaatgcgcggcaccacatagaacagtgcgagaaacgtcaatggaagcgcacccagaacggatgccatccaacgtggcccccatccgttcacaccgccgtcagcaccccaatgcatgggaatgcgctcaggtagccccggcatggcggcaagatgcgccacgacgttcagcgcgcaaagcagcatgaggacgacccatacacgggccggaataccggtcgaggctttggttgtctcgggtttttcctgcttttgcattgtcagacctttcattgcctgtcttccggatcgtccgcgaagcccatgaaccatccgaccaagtcctgcataactgtggtattgaggctgtacacgatgttctgcccatgtcgttcgtccgttacgagaccagcgttcctaagagtcgccagatggtgactgagcgatggcttgctgatgtcgaaatgctccgcgagctcccccgcggtcatatcccccgcacgcagcagctcgaggatacgacgccgcgtggggtcggcgagcgccttgaatccttctcctgccatcatcgctctctttccagtatcggattgcgatattcatcctaccagatatttagacgtttgtctaaatatctaaaatacggaagtctgaaaacgtcatggaaaccgaaatctcgttttttcggagcaacgctgatgtcaaggaacggcgccttccagcagactcggcaataatcccacgccataggcggcaacatgggcggaaccgcgcaagacaaggaggtcccgaatggaatacattcgaattaccagagacaacatcgatgcagagcacgtctgctgcgccatgtccggcaaacaggcccttgcgaaaaaggagtggctcaaacgtcgattcgacgaaggattgatcttctaccgcagcgtagaacgcggaaaatgcttcatcgaatatatccccgcggagaacgcgtgggttcctatccaagcggatgggtatctttacatcgactgtctatgggtcgccggctccatgaaagggcacggatattccaacgacctgttacggggggtgcgtgagggatgcgaaggagcaggggcggaagggattgtgtattttgtctgccgaaggacgcaagcgcgaattcctctccgacgcgaaataccttgcgcacaagggtttcatggttgcggacacgtcatcatgcggaatcatgctcatgtacctgccgttcggttcggacacggagcctccgcaattcaaagaatgcgccaaatatcccacggcggatggtgatggattcgttctctattacacggaccagtgtccgttcacccactactgggtgccacgcgtggaagcggtggcggaagagcacagcattccattaaaaaccattcacatcatcagccgtgagcaggcccagaatacgccagctccggtcacgacctacgcgctgttcaaggacggcgagttcctgactcaaggcatccagtccgacaagaagttcctgaagctcgcaggcgtacaggtctgatgccggcctgacgttttttaagatgcgggggcatcatgacgttccgcacgcattaccattcgaacaagtcggatcggcccgtacggcatggcggaaacacccccacccgcgcaaccgtcagcgtgcaatgcagcgaaaagcataaagaaaacgggttccgaatgaaccggaacccgtataacgtaaaacctcgaaatatctgaagtgtcagaagtatccgagtttcctagaaaatcaggcgaacaggaagccctggccgtgatgttccggatacgtgtcgaacagttcggcaacggaaccgtcttcgaacacggcgcggatggcacttgccagcaacggcgcgatcgacagaacagtcagaccgtcccaacgcttttcttccggaatcggcacggtatcggtgagcacgacctcgcgtgcgccgcagttcttcagtcggtccacggccgggccggacagcacgccatgcgtggcgacgacggtcaccgacttggctccggcatccttaagcacgttgcatgcgccggcgatggtgcccgcggtgtcaatcaggtcgtcgacaagcacgcagtccttgcctgcgacgtcgccgaccacacggttggcgaccgcctggttcgggcgggtgatgtcgcgggtcttgtgcacgaaggcgagcggaccgccgccgaggcgctgcgcccactgttcggcaacacggatacgaccggcgtccggggagacgacagcgacgttgtcaagttggttggagaaacggtcacggatgtaatcgaccagcaccggcatggcgatgagatgatcgaccgggccgtcaaagaagccttgcgactgcgccgcatgcagatcgacgctcatgatgcggtcggcgcctgcggtcttgagcaggtcaaacaccagacggcaggagatgggctcgcggccgcggtgcttcttatcctggcgggaatagcccagcagcgggcagaccgcggtgatggaacgcgcggaagcacgcttcaacgcatcaatcatgatgagctgttccatgatggcctggttgaccggattggaatggctctgcagtacgaacacgtccgcgccacgcacggactcggtgtagcgcacgtacatttcgccgttcgcaaaatcgtatgctgtggtttccagaacatcaatgccgagctgttcggcgacttccgccgccagcttcgggtgtgctctgcctgtgacaaggataaggttcttatccggctttccttcaaggattgcgctcaccgtgtctccaaacgtctgttctagcgaagtggatgtgacccatactaaccggccgcgcagacctcaccgaccccgtgtgttcggggggccatgcggacggccccatccatcttctatcggtataggccgtgtttaccgatgtattgcaccacgccatcgggtacgagataccaaacgggttcgccatgttcggcgcggcgacgcacatccgtggaggaaatcgccaaagcgggaatctccagcgtatccaccttgccttcaggtaatttcacgccgtccggcgaggaataaccgggacgtgtcacggccacgaaatgcgccagctcccacatcttgttggcgtccttccattgcatgatctccgccacggcgtcggcaccggtgatgaagaacagttccgcatcgggatactgggcgcggatgtcacgcagggtgtcgatggtgtaggtgacgccgggacggtcgatgtccacgcgcgacacggtgaatttcggattcgacgcggtggcgatgaccgtcataaggtaccggtcctccgcattggtgaccttcttgtccaacttgaacaccggccgtccggtcggcacgaagatcacctcgtcgaggtcgtacacccaggacacttcggaggctgcgaccaaatggccgttatggatcggatcgaaagtgccgcccatgatgccgatgcgcaaccggttgtgccagttgcctcgtgcggacctgcgtccggtggtcacggctgattgcggccggtctacggatagttccgacatgcgtcgttccggctcgaccacgtagctgacggtcagttcgggatcggcctccgcagattccggccgcatgcgttttggtccggtcatgcggacgctccgctcttttgcgcgccatcggcctgctgttcggcctgtttctcggcctgctgctctttgtccgcgtcggcggtttcctgctcgatgctgtccgcggtcggtgaggcgttgtcgggatcgatcttgtccatatcctcatcccactcgtcctgcaccacacgtcgaatctcggcgaatgtcggcagcgggaaatccggctggtatatactgcggattccggcaacgcgctcggtgacacgaatcagcgtgtcggtcatgccgacgatgtcatgatctcgttccatcgcgctgaacttggcgatgtgctgttccatgacccgcatctgctcgtcgatatcgtcaagctgggcggcatcgggagtgatgacgtccgaagcgtcggtttcgggccagccgatcaacaccgcgtcggcgtattcgagcgaggcgcgttcgtccgcggacgcgataccgtcttcgacctgcacaaggaacacataccgcacgatgctcaatcgttcggatgccaatcgcaatctgagcattgggtcggtcaagtccgcgttccatgggttcttgttgtcctgcatggtgtgctgcatattgtcctgcatgacttcgtcgctcattctctcacctgtcctgttccgtagccaatccatttggtcgtggtcatctcgtgcagccccatcggaccgcgcgcatgcatcttctgtgtggagatgccaagttccgcgccgaatccgaacacgccgccatcggtgaaacgtgtggaggcgttgaccatcaccaccgccgagtcgatgcgggcggtgaattcctcgatggccgaatagtcttcggcgatgatggattcggtgtgcccggtggagtggcggttgatatgcgcgatggcctcgtcaagcgagtcgaccaccttgatgccgattttgagtgccagatattcggtgtcccaatcctcgtcggtggcatgcacgagttgcgcatttgcgattccggcatgttcgatgatgccatacgcgcgttcgtcggcatgcatttcgactcccgctgcggcgagcgctgccgcggctttcggcaggaagctttcggcgatgtctttgtggacgaggagtttttcggtggcgttgcatacgccgacgcgttgggttttggcgttgatgaggatggggatggctttgtcggggttgccggtgcggtcgacgtagatgtgcacgttgccggctccggtttcgatgacggggactttggagttgcgtaccacggcttggatgagtcctgctcccccgcgtgggatgagcacgtcgatgtggccgcgtgcttccatcatggcggtggcgccgtcgcgtccgtattggtctacggtggcgatcatgttgtggtcgtatccgtgtttggtgagtacgtcggcgatgacggcgagtgttgccgcgttggtgtgttcggccgcgtgtccgccgcgcagcaggacggcgttgccggatttgatgcatagggaggcaacgtcgacggtgacgttggggcgtgcttcgtagatcatgccgagcacgccgatggggacgcgtacctgctgcagtcgtaggccgttttccagatggtatccgcgtacgatttcgccgatggggtctggtagggatgccacgtggcgtacgccttgcgcggcggcggtgatgcgctgctggtcgaatttgagtcggtcgagtttgccggcgtccatgccgtcggtttcggctttgttcatgtcgagcgtgttggctgcggcgatgtcgtccgcatgctggtcgagtgcgtcggcgatggcgttgagcagttggtttttggcttcggtgtttgcctgggcaagttgcgattgcgcggtgcgggctgcgtcgcccatggcgcatactgcttcgaacacgtcggcgttcatggcggtgccttggttctgtggattcgtcatagtctcttagaatagcgcgaaatcacgcctcgctgggcaatgacggccattttcgggtcgttggttgcgcggcgggacgcgatttcgtcagtcgaggctggtgatcagtggatttggtcgagtcccgggtaaagcgggaagtcttcggcaagcttgtcgacgcgcgccttgagcgcgtcgacgtcctgtcctgcggcgagcgcggtgccgatgatgtcggcgacttcctcgtattccttgggtccgaagccgcgggtggcgagtgcgctggtgccgatgcgcaggccggaggccacggatgcggggcgtgggtcgaacgggacggtgttgcggttgatggtgatgccgcattgtgcgagcaggtcttcgccttgtttgccgtccatttcgctgttgcgtaggtcgaccatgaccaggtgcacgtcggtgccgccggtcaggacgctgatgccgttgtttttgacgtcgtcggccatgaggcgttcggcaaggatcttggcgccgtcgagggtgcgttgcatgcggtctttgaattccggggtggcggcgactttgaaggcgacggccttgccggcgatgacgtgcatgagcgggccgccttgctggccggggaatacggcggagttgagtttcttggcgtattcctgcttggcgaggatgaagccggagcgtgggccgccgagggttttgtgcgcggtggaggatacgacgtcggcgtatgggacggggcttggatgcagtccggcggctacgaggccggcgaagtgggccatgtccacccagaatttggcgccgacctcgtcggcgatctccttcatggctttgaagtcttcgatgcgcgggtaggcgctccatccgccgatgatcatggcgggatgggtttcgagcgcacgctggcggatgatttccgggtcgatgcggaaggtttcgggattcacgccgtaggcttcggcgtggtagaagcggccggagaagttgattttcatgccatgggtgaggtggccgccgtggtcgagggcgaggccgaggaccgtgtcgccgggtttgacgagcgcctggtagacggctgcgttggcctgtgcgccggagtgcggctgtacgttggcgtattcggcgccgaataggcttttggcgcgttcgcgggcgatggtttcgattttgtccacctgctcgcagccgccgtagtagcggcgtcccggatagccttcggcgtatttgttggtcagtacggagccttgtgcctgaagcactgcacgcggcacgaagttttcggaggcgatcatttcgagtccgttttgctgcctggatagttcggcgtcgaggatttcggcgatttccggatccgcttcggcgatgggcgcgttgaacatgtcgttcggtgtttgcgcaagaggtgatgcagtcatgaagccctccttgacttcggaatgatcatccgctgtaccgcgggttacagagcagtgtacgtgtgaaaacgatcggaggaaaaccgggtttcgaaacatgtgggaaatatggcaccgcctgcgcgcgaagacatggacggcacgatcgcggtgccacgtggaaaagcaggaccttccgtcggcaatcgtatggggtcggcgtcccattccacggacgcgaggcgacgttcttcccacctgtgccggtacactgagaagcacgtttgacgtaatctgtccgttctattgctaaggaaatcaagtgaccacgttccacagcacacgcagcaccaccgattcgcttacctccaagcaggccatccgcaagggcatcgccgatgatggcggcctgttcgtgaccgactccttgggtgagacccatgtggatatcgcttccttggccggcaagtcctaccagcagatcgcgttcgatgtgctgtccgtgctgctgccggactacaccgaggccgagctcaaggagtgcatcgacgaggcgtacggcccgcagtggtccgacgagaagatcactccggtcaagccgctcggcgatgactatgtgatggaactgttcaacggtccgacttccgcgttcaaagatgtggcgctgcagattctgccgcgtttcatggcgcgcaccactccggcggatggcgacgcggatgagaagatcatgatcgtcaccgccacgtccggcgacaccggcaaggccgcgttggctggtttcgcggacgccgcgggcaccggcatcaccgtgttctatccggaaggcaaggtcagccaggtgcaggagctgcagatgaccacgcagtccggctccaatgtgaacgtgtgcgcggtcaagggcaatttcgatgacgcgcagtccgccgtcaagcgcatcttcggcgacaaggagcttgccggacgtctcgccgatgattcgcatgtggtgctttcctccgcgaattccatcaatgtgggccgtctggtgccgcaggtcgtctattacttctccgcgtacgcgcagctgctggaacgccaggtcatcaatgtgggcgacgaggtcgagttcgttgtgccgacgggtaatttcggcgacatcctcgccggctattacgcgaaactgctgggcctgccggtcaagcatcttgtggtggcgtccgacaagaacaacgtgctgttcgacttcctgacttccggcacgtacaaccgtcagcgtccgttcttccagaccatttccccgtcgatggatatcctcatctcatcgaacctggagcgcatgctgtattacatgtccgacaaggacacacgcctgatctccatgctgatgaacgatctgagccagtggggcgcctacgaggttcccgagccgatgatgaagaagattcgttccatcttcggcaccggttgggccgatgagaaccaggtgcgcgagatgatcgcggactgctggaacaagaaccattacgtgatcgacccgcacaccgcatgcggctactacgtcatgcagcagatgccgcgcgatccgctcacgccgcgcgtgctgctgtccaccgccagcccgtacaagttcccgcgcgtagtcaacgaatctctgggtcttgacgcgtccggcaccgatttcgaatgcatggacgtgcttgccaaggccaccggcaccaccgctccggccgcgctgcgcggtcttgagaccgccaacgtgcgtttcgataacgtcgtcgaaatcgacggcatggaaggattcgtcgagcaggccgcgaaggcgctgtaaggtttcgacaggcaaaacggcaacgatacatagaagaatcggctgtccgcgatatgcgggcggccgtttttcattgacgctggtacagtgcgttcccgaaaggcaggagaatcatgagcgtagcttcagcatcgcagtcgggcgtaacggcaaatcggccggatgaacccgcggaaccgaggaaggaccggctcatcacccgtgacgtggcgctggtgatgctggcgacgttcttcttcatgaccagcaacatggtgatcacgccggtcatcgccggctatggcgagtcgatgggagcgacgggcgcgctgatgggcgtgatcgccggcgcgatgagtttcgtgtctctgttctgccgtcccatcgcgggcaatctgtcggatttggtcagcaagaggttgctggtggctgcgggaacggtgctgtacatcgtggcgggcgtcatgtattgtcttgccgattcgacgggcatgctggtcgtggcgcgcatggtcaacgggcttggcttcgcatgcggcacggtttgtctggcgacgtgggtgtcgctgctgcttccgatccggcatatgggcgcgggcatgggattgtacggcatcgtcaacgcgttggcgattgcggtcggcccggcactcggcatccgtctgcaggcggccgtcggctaccagtggacgttcatcgcatcgctgacgcttaacgtgtgcgcgttcgtgacggttctgctggtgaaaaacggtggcaggccggctcgtaaaaccgttgccgccgagcagtcgttacggcatcgtctgcgtcttcgcaatctggtggagccacgggccattccattggccgcggtgttcatgatgttcgccatcccttatttcgcgaaccagtcgttcctggtggattacatttccacacgacatctgcgtatctcgtccgacttgttcttcgtgttctatgcggccgcgctgctggtactgcggctcacgttgcgcgacctgttcgattcgaagggtttccgtttctggcttgtcgtctgttcgtttgcgatgttggcgtcgcttgcctttctcacgttcatgacgaacgattggtatctgcttggcgcgggcatcgccatggcggccagttatggactgatgagttccgtcacgcaggcgcaggcggtggtgatcgccggccgggagcgcagtggcttggccaacggcacgtactatatgggcatcgacttgggtatggcgttggggccggtgctggctggagttctctatgggcacctgccgatcgcatggttctatcccctgttcatgctggcgctgccggtgtcttggctgatctacctgtccttccaccgtctcatccatccgtcgcacaagtaacggacaggcaccgcagccggtaggcaccaactgttcagaatggcggaataccaaggttttcaattacggccatgctgttatagatcatataataacagcatggccaaatctgtgttactgttatatatagctgttgaacagtttgcgtacactgttcggtcaggatatatatcactcgcagaaagggatacagtgaagctgaacatctcatccgcgtccggcaaaccgatttacgaacagatcgaagatcagatccgagcggcgatcatgtcgggcgaactgcaaaccggcgaggcgctcccctccctcaggaagcttgccaaggaactgcacatcagcgtgctcaccatcgccagagcgtacagcgagctggcggatgaggggcttgtcgagaatgtgcagggcaaaggcacgttcgtgctggcccacggcaacgagcttatgaaggaacgtgcgcgcgaacgcatcatggacgtgttccggcagacggtaaccgccgccaaggccgccgacatcagcctgcttgatctgcttggcatgttcgagaaggcgtatagggaacaatcatgagccgcgtcttcatgaggctcaacaagatatggacctgatcggcgtcatgaaagcgtgaagcggtcgaatcacgcaatggcccggaaacatcaggcgatgatgcaaaccgttacagtatgacgggcgcgtcgtggaagtcgaacatgacgccgtcggccagattgcagatctcaggccagtcggcgtcggaggaatcgtcgtgcatggcccacacatgcatgccgaccgacttggccgagcgcatgccgaccagcagatcctcgaatacggtgcagtcgcttggtttgatgccgagacgcgacgcggccagcagatatacgtccggctcagttttgccgacgtcgccagcatcgtcgacgctgaccacgtcatcgaaatagtcgaaaatgccgacgtgcttcatggccggttcgcgcagcatcggcggcaatgacgtggccacggccagtttcgcgccgctcgccttcaacgattccagatattcgcgcgcatacggtttggcttcaaccaccgtggcgtacatgacacgtgccatatggtcccactcctccatcaacgcttcgggagtgtccgacaggccgaatcgtgcgattgtgtattcggcgatctggcggaattgcatggccgcgaccttctgcatgtagtcgtccggcacctcgatgccgcgtttggcaaggaagtcgacgtccacctgatcccacacgcccatggagtcgagtagcgtgccgtcaaggtcgaagatggcgcctttgccttggttcgccttggttttctgtgtcatatcggctcctttgttttgcaattaccgcttttacgatttgcgattactttttacgattgaatccgccgtcagtcaagcaccgacgatttgagcagttcctcggcatgttccagagatgtttcactttcgctgccggacagcatgcgggcgatttcgtgcacgcgctcatccccgcgcacctggctgatggtggtggcgatggaaccatccttggtttcgcctttggcgaccacatattgttcgtccgcccaggaggcgacctgcggcaggtgcgtgacgaccagaacctgcgcggattgggcgagtttggccaagcgggcacccagttccacagcggccttgcctcccacgccggcgtcgacctcatcgaagatgaacgtcatcggcggcacggttccgccggccacgacatgcttttcggcggcgaccagttcaagcgcgagcatcagacggctcaattcgccgccggatgcgcttttgcccatcggcagttgcggggagccggggaacggggtgaagaggaattcgatgtcgtccgctccggtggcgtccaactgttcgcgttcggccacgcggatctccagtttcgaagtgcccatggccagcgaatcaagttccgcggtgactttggacgcgagttccttcgccgcggctctacgccgtttgctcacagcctgcgcggcttttttcgcagcctcaagcagttgggcgcgttcggcttccagctgttcgaccttttccggcgaggcgtccaaatcctccaaatcgtatacggccttgtccctccacgtgatcacgtcggacaattccggcccccatcggcgggtcagctcgtccagttcgtggatgcgcccgttgatggcatccagatcctccacgctcgcctcattgtccacttcgccggacaggctgaacaccacgtcggacaaatcggtgctgatggagtcgagccggtcggcgagttcggagaacacgccttccacgtgaatggcgcgcaatgcctgcgaggcacggtcgatcaaatcggcggcgctggccgattcaacgtcatccgccacttgcgaagcgtccaacgcacccaatgcgcgggtcacgccttcggcgatttcggcggcgttttcgatgcggtcccgccgtgcgcgcaattcgtccatctcccccggctgcgggtcgacccggttgatgcgttcgattgactcacgcaggtaatccgcctgctggcgcatggacgattcctggctgctgagcctttccaaacgctcgtccattgcgcgcagcgcgttccacgtcttgccgtaggcggccaacgccacttcatcccccgcgtagcggtccaggaattcacgctgccgcgaaacggtcgcgatacgtaactggtcggcctggccgtggatcgtcaccaattcggcggcgacggaagcaagcacggaacgaggcacgctacgtcccgacaacatgctgcgggatcgtccggaagccggcaccttgcgcgacaggaacagttcgccgtcctctggctcgaagccagcctcccgtgcggcggccaccgcggccggcgacgaagcgacttcgaacacgccctgcgcccacgcctcctgagcgccgacggaaacacggccgccgtcggagggaccgccggaaatcagtcggatcgcactgagcagcatcgatttgccggcacctgtttcgccggtgatcgccgtcataccgcctgccggggcgatcagcgcggaacggatcggaccgagattgtggatctcaagctcttccagcatgccctgtcacttcccgctttccggtttgccggttctagggaacgattgcccatgatgcgtgccaccggtcttgcgcgcctgctcgcgccatccgacgacaggcaggtcgaatttggtgacgagacggttcgtgaacggcacgccggacagtcgcgccaatcgcaaagtgcatttcgattcgcgcacttcgatgcgtgtgcctttcggcagggcgcgctggcggcggccgtcgcagcagatccaaccgtcggacgtggaatcgtcaagaatgtcgatggcgaacgtggagccggagccgatgatgagcggacgtgcgaacaatgcgtgcgcggccaacggcaccaattgcaatgccttcacattcggccacatgatcggcccgcccgcggaaaacgcgtaggcggtggaaccggtcggcgtggatacgatcacgccatcgcaaccgaaggagctcatctccacgtcgtcgacacggatggacagttccaccattttgccacggtcggcgcgttccagcgtgatgtcgttcaacgcccagtcctcgatgggttccgtcgcgcccggcagccatacgtcgacgtgggcgatcatacgttcgtcgatggaatagtcatggtcggcgatccggcggatggcctcgctcatctggaagctttcaaattcggcaagaaagccgacgtggcccaggttcacaccgagaatgggcacttcggtggcatgcaccagttcggctgcgcgcaggatggtaccgtctcctccgagcaccaccacgatttccgtgttcttcggcacggcgggcgtcctgctgccgaactcgggcgcttcgatattgtcgatgatcgtcacttcgaaattggcgcgtctcaactgctcgacggcttcttcgaccaccgtgccgctttcacgcagacgcgtatgcgtcaccaccaccgcatgtcgggtaccgatcatcgcaagccctttcgtataacgggcgccccatgcgaggtgccactacccgccagtgtagtcgaacaaatgaacgaatgacggcagcgggtgtccagaacacgccgcagacgtccgaagagtcccatggagccaccgcggaaccgtcgaacggtacgtccatggcccattcgtcacactaccgcctacaatatctcaaggaaacgaagaccgtttatacagacaaggagcgaggaacagcatgtccaacctcgtcttcgacgagtcctcctccaatcgcgaggcctcacatggctatgcctggtggttctccggggacacgttcgagaaggccatggcggaggagcgcaagccgcgcaagcgcagcctaatgcacagactcaccacacatcccggacgtctgaccatcctgtacttcatgatgttgggcgcattgtccacgctgctcctgctcacgcccaccgccacgccgaaaggcgagaagacgacgttcaccaccgcgttcttcaccgcgatctccgcgatttcgacgtgtggcatctccatcgtcaattcgacgacgcattggtccgctttcggccaggccgtgctcatcttctccgtgcagatgggcggcttgggcgtcatgacgttcgcttcactcatcgccttggccgtgaaccaccatctcaaggccacgcaaaagctgctgacggccaacgagctgggcaccacgaaactcggcgagatcaagggcgtgctcaccgtggtcatcgccaccgcgttcaccatcgaaggcatcacgttcgtggcgctgttccccggcctgtacaaagtcaatcatggcaatgtgcggcacacgctgtgggaatcgttgttcttcgcggtcatggcatacaacaacgccggcttcacccctgacggcgccggcctgcatgtcaacaattgggctgtcggtctgcctatcctcgtcagcgcgttctgcggcacgctcggctttcccgtcctgcttaacctcatgcgctcatggcgcaaccatcgtccgccgaagcgttggagcctgcataccaagctcacgctgaccaccacgttctgcatcgtgctcgcctcgttcacctggttcctcctcatggaatggaacaacaaactgctgttcgccaccgaaggtgtggaaccgcggttgtggcatgcgatggtggcggccgtcatgccccgcagttccggcttcgacctgtcatggatgccgggcgtgagcgacgcgacgaaggtgttcctatccatcgtcatgttcatcggcggcggcagcacttcgaccgcaggaggcatccgcgtcaccacattcgccgtgattctgttgacctgccgtgccgcgttcaccggacgccatgacgtcaacgcgttccatcgtcgtatccattcgcaagccgtcatgaccgctgtggccgtcaccacgtcatgtctgatgcttgtcaccgtggtgtccatggcgttgatggccatcaccggctgctcgctgagcaacgcgctgttcgacacctgctcggcgttcggtctgggaggctattcggtcggcgtggccagcgcttctagtccagcggtcctgtacattctcgccgcgaccatgttcatcggcaggctcggtccgctcaccatcgcctacgcgatctccaggccgcgcaatgtggagccggtccgctaccccaccgagcagatcgtggtcggctgagcggattcgtcgatacggtttctatacccgcaacttcctatacttgaatccggaacagaacatcgaaaggtacgcgaacaatcatggctaacaacaccagaagcgttcttgtggtaggactcggccgtttcggcagttccgtagccaccacattggatgcgatgggccaggatgtgctcgccgtcgacaaggacggcgaactggtgaaccgctggtcgtcgcagattcccaccgtgcaggccgatatgaccgatgtgatggcgttggagcagatcaacgcctccgatttcgatacggcggtcgttgccatcggcgacagcgtcgaagcgtccgtcatcaccgccggcaatctgcttgatgccggcatctccgacatttgggcgaagtcggtgtccaaggagcatgcgcgcattctgcagcgtatcggggcacgccacatcatcaacgcggagaccgatgccggcaagcgcgtggggcacttggtgtccggcaactatctggactacatcgagcttgaaggcgcgtacagcgtggtgaagatccacactcccccgcatgtcgtcggttactccatcgaggatgcgcgcgtgcatgaacggttcggcatcaccgtggtcggtgtcaaatcgccgggcaaggaattcgaatacggttcgaaagagctgattatgcaccgtaacgacgagctcatcatcatgggcaagcaggatcagatcgacaagtttttgaggggctaggcccgcggaacatgcaaaaggccggcggtccatatgggatttttcatatgggctgccggcctttcatttttacgctatcgattggcggagaacggtttacgccactgcatacagcagatactcgatgttgccgtgcgtgccttcgatcggtgagaccgccgtggcgcgtacatccagtccgttggctttcgcgcaggcggtgacggtgtcgagcgcctgtttgcgtaaggtttcgctttccacgatgccgtttttgccgaggttgcctttgccgacttcgaactgcggtttgaccagtagcacgacgtgtgcgccgggcgcggcgatgcgcgcgatgacgggaatcacgtatgtcaacgagatgaatgacacgtcggatacgatcatgcttggccggtacggcagatcatccgcttcgacgtcgcggatgttgacgccgctcatttcgatgatgcgctcgttgcctgcgatgcgcgggtcaagctggccgtgtcccacgtcgagcgcgatcacatgcgcggcaccgcgtcgcagaagcacgtcgcagaaaccgccggtggacgcgccgatgtcgaggcaatcgagtccttccgcggaacgcaggcccgtctgggagaacatgtcgaacgcgccgaccagcttgtaggctccacgggagacgtaatcgtctcccagatcggcatcaagcgtgtcggcggccgtgactttgagcgacgctttggatgcgacggtgccgttcacccggaccttgccggattcgatcagccgttgtgctttggagcgactatccgtgacgccacgctccaccagcgcgatgtcgagtcggacgacggcaccggaatcgtcattcatgttgcgcatacgcacgtgcggcaatcaggcgattcggaattccggcacgatcatgccgtcgacgctgtgtccgcgatccgccgcatcccacatggcggcgcaggccgcacgaagaccgtcgacgctggtgatgtcggtgacgtaaagacgatcgccgtcgacgcgcgcctgcacgtcgcggcagctccaagcgccagcctcatgcacgacttcgggggccgactcgttaagtccggtcaggtccttggcgatgtaggtcggacgcagatgctccggagcgaacatcagctcatgcggattggtgacgccggtcagcacggccagggaatcatagccgccacggttgccggcttcgatatcggtatcgaggcggtcgccgatggcgaggcatgcttccttggccactggttcggcaccatcatgcgcggcaagcagtcgggcttcgtcgtacatggcggattccggcttgcctgcggacgaaaccggttccacaccagtggcgttgatgacggccatgatcatggaaccgcaaccgggggcgatgcccagctcacgcggaatggtcaggtcgcggttggtcacgaaatacgtggcgccctgttctacggcgtaggcgatttgcgccatctggttccaagacatgtccgggtaccagccttggatggccgcgaccggcttgtcttcggcggaatcaaccacttcaagaccctgcttggcgacttcctcacgcagatgctgtgcgccgagcacgaacactttcgcaccttgcggcaccgcacgggccaccatgcgggcagccaccacggacgaggtaatgacctgccatggttcgacgtcaaggtcgaagcctttaagctggtcggccaccacggattgcagtcgggaggaattgttggtggtgtattccaccgtcatgccgaggccttcggccttacggatgctctctgcagcatgttccaccggattcttgccacggtagaccacgccgtcaagatcaagcagcgccagctggtaggcttcgctcagcggacgggttgtggatttcagcattgttttgcctcacctcactcgttgtcggaatcggctgcggattcgacctcatcctcagtctggtcgtcttcggagtcgcccgcgttttcgccgtcaccggcaggctcgtcgtcggactcggcgccttccttggccgcttcggcatcaagctgggtctcatcgttggtctcgccgttctcgtcgacggcctcggaatcgtcctcatcctcgtcttccggcgcatactgggcgtcatcttcggaaatgccgagcttgtccataagctcgtcgttcaattcctgcatgtcgtattcaatgaccagatcgtcggaggtctcgtcctcttcggcatcggcgtactgcagctcaagcttgtcaagcagctggtcgagggccacggcctcatcggagcgtccggcctgctcaaggaagtactgttcggcctgcaccgcacgcatgcggtattcgccggccaggcccttggaacggcccagcgtatgcacgatctcaatggccttatcccacagctcgaggtcacccagcgcgcccgcgtacacgaggaacatctcggccttggattcgccgcgcagatacttcgcgtcatcgctcatggcggtttcgatggccttcttcggctcgcccatgccacgctcgcagtcggcgatgaacggcagatagtcaaggaaaccgttcatgcggaacgcggtgcggaactcacgcagggcaagtttgtaatcgccctgacggtaggccacgaacgcaagggtctcacgcgcgaaatcaatacgggaagcctgatgcgccacccacttggcgtgttcgagcgccagctccggatccctttcctcaagcgtgtaggcggcgaggatgtgcaggccgatgttctccgcatgttccttggacaggccacgcagacgctcacggtcatcggtggacagcatgctccactcgatgcccttcggcatcttcggctcgcccgggcgacgatgcgtgtacgggttttgcgacgggaagctcatcgtgccgtcggaattgcgacgcggcttcgacaggtattcaccacgcttcgcctcgcggtactccatcttctcttcacgggtgaattcgcggcgctcctcgccttccggacgctggtcgcggtccttgtggaagtcacgacgctggttgtcacggcggaaatccctgcgatcgccgtcacgacgatcatcacgacggaaattacgacgctcgccatcacggcgctccccgcggcggtcatcgcggcggaagtctctgcgatcgccgtccttgtggaagttgcggccgccacgacgctcaccatcgtcacggcggaagtcacgacggtcaccgtcatgacggaaattgcgacgctcgccatcgcgacggtcatcatggcggaaaccggaacgctcaccatcacgctggtagcgcggattgtcgccgcgattgccgcgatagccgccgcggcggtcgtcacgacgctcgccatcgcggttgaacttgcgcggaccgttgtggaaacgacgctcctgaccttcgccttcgccatcgcgatggaaatcgcggtcgccacgacggtatccgccgccattgcccttacgatatccgcccttacggtcatcgttgtggaagccgccggacttgtgtccgtaggacttgccgccgttgccgcgcggcttgaatcccttgccaccgcggttacccggcctgcccgagccgtaggacttgtggttgccgtaggacttgccgcgcgatccgcgctgttcttctgccatgctgttccttattggtcttgagatacttgcgattatttacttacgattgcctatgcgtctcacgcctgttcgacgacgccgagcgccttcttgccgcggcggatgagcacgaaacgaccatgcaggaagtcaccttcctgcaacgtctgttcctcatcctccacgcgcgtgttgttgaggtacacgccaccggacttgatggtcttgcgcgcctcggaaatcgacttgaacaggcctgccttcataccagcctcggccacacggtcgccggctgcgaccttggcgaattccccatcgaccttcatgccgtcgatagcggcctcaagcgtggactcgtcgatgtccgccagatcgccgccacgtccgaacaacgcgccggcagcttcgatggcctggcgagtggcttcctcgccatgcacgaagctggtgacctcccatgcgagggtgcgctgcgcctcacgcgcgcccggattggtcttgctttcctcgataagccgttcgatttcggcctttggcaggaaggtgaacgccttgagcaggttctccatctcgctgtcgggacggttgaaccagaactggtagaacttgtaggggctgagcatcgtgccatccaaccagacggcgttgccttcggacttgccgaacttcttgccctgcgcgtcggtgatgatcgggctggtgaacacgttcacgtccacgccgcgcaccttgtggatcagatccagaccggaggtgaggttgccccactggtcggagccgccaatctccagcacgcaatggtattcgtcgaacaggtgcaggaagtcgttgccctgaagcacctgatagctgaactcggtgaaggagatgccttcctcggagttgaggcgacgggccacggtgtccttggcgagcatggtgcccatacggaaattcttgccgacgtcacgcaggaagtcgatgacgttcatcgaagcggtccaatcgtagttggacacgaaacgcaccggattgctgccttcggtctcgaggatgccgccgatctgcttcttcagacgatcggcccagccggccacgacgtccttcgggttgagcgtgcgttcgcccgactggcgcggatctccgatcaggccggtggcgccgccgaccaacgcgatcggatggtgtcctgcggcctgcaggtggcgcatgttgatgagctgaacgaggttgccgatgtgcagggaggcggcggtcggatcgaagccgcaataataggtgatgggctctccgttcaacgcttcggcgagtcgatccctgtcagtggactgggaaatcaacccgcgccattccagttcatcgaggacggaatcgaaaccggcctccttgaaatcgatgacgtgagccataactgtgctttctccctatcgaattgtggacattaccgcgttttacgcaccctacagtttcgcagaagacacagacagccgcgtgtgccgttttccatgtttttatcaaagcgatcacggaacatgccggttaaaatcgaaaatggaatctcatcgacgagaagaagggaggtctgcatggatcgcaaaggcatgaaggccaatgcaaggaaagcctataagagacactattggatgatagtcgtcatctgcctgttcgcttcggtgttcggtgtcgcctacagttcgtcgacatggtcggtgaacgccagttccccgtccgcaaccgtgcaggaggatggcacagcgcaatccgacaacgtgtcgaaagtgttggagaacctgcttgtcggcgatgaaagccaggcacgcaggcaagtggagcacaatcaggagcagatcgtgcaaaacgacaccaatgccatgatggggcgtaaacgcggcgtgttcgcgtctctgctcaactcgttctcatcgggttcggtcattctgtcgatggccgatgcggccaattccatcgtgcataatgacggcgtcgccgtggccgtaccgatcgtcgtatccctggccgtttaccttttcgtatggctgttcgtccagcagacataccgggtggtcatgatgcgcatgctgcttgaggggcggacctacgacaaacttcccgtgagccgtttcctctacccgatcaccacgcgcaaatggttgtcgatggcgaaggtgatgctgctcgagaacgtgttcctgttcctgtggacgttcaccatcatcggcgcgctcatcaaaccgtattcctaccgtatggtgccctacatcgtcgccgaaaatccgaatatcggggcacgggaggccatcagcctgtccaggcgcatgatgaagggtcacaagtgggagtgtttcgtggccgacctgtcgttccttggctggtggctgctcaatctgttcacgctcggcttgagcggcatcttctattccaacggctataacgcggcgtttttcgtagaatattacgtgcatgtgcgcggattgtccaaggattcgggattggagggaagcgagctgctcagcgacgaatacctgcacagcaaggcctccgctgagacattgcatgccgcgtatggtgatgttgccgaaacggtggagcagttgtccagcaatcttgttccggtggacaagccgaacggtttcgtcgggttcctgtccgaatggttgggcgtgcgtatcctgcatgcgcggtcggtgaccaagtatgaggagtatcgcgagcaactgcaccagatcgataccggcagggagattctggacggcgctatctatcctggtcgtctggctccggcgccgatggcgttccggttccgcgaatcccgcaccgtcagctccgatcgcagctattcgttggtcaatctggtcatgatgttcttcatcttctgtttcgtgggatgggtatgggaggtgagcctcgccttcatttccgaaggaacgttcgtgaatcgtggcacgctgcatgggccatggctgccgatctatggcaccggcggagtgattatccttattctgctgaagaagttgaggaagaagcccttgttcgagttcctggccgccatggtcttgtgtggcgggttggagtacttctcgtcctggtatctggagaagacccacggaggacaacgctggtgggattacaccggttattttctcaatctcaatggtcgtatctgtgccgagggtctgctgacgtttggtttgggcggtttggcgatcgtgtatctgctggctcctgcattggacaacttgctgagtcgtatcgatacaagaaagctcaccgttgtggccgtcgtgcttctggcgttctactgtgtggaccaggcgtattcggcgcagcatccgaacattggtaccggcatcaccgattacaaggggtcggccacatcgcaagtatcgtagcccctatccgatgtgatgcataaagggattttgcccgtcagcgtgcgcaacgcaggttggcggggcaaatcgtttttggacacatgctatacgacacgtgtggccggtggaaacttactttcggcgcagcatctcacgcacggtttccatgatcttgctgtatttggtggagtccgtggaacgcatgcgtgggaaggagcggatcatacgacgttgctgccaattcaacgcggaagagacaagctgacgcatattggcaacacgttcctgcgacgattccgacaaatcatgcatcttctcgcggaattcctctttgccccactgccaggagtctccggccttctccgcacgctcctgcaccgcttcgctgaatttggcgagacgctcggacaggccgacgatgcccaccacggtgacgatggtgtcgatgataacgacgatggcggcgaccgcgcatatcacgtgcacggcaagcagcggaatcatggcggtgagccgttcgacctgcggctggaccacatcgatgatcaatactccgccgaatccgaatacgattgcgccgagcagacagatgcggccttggatgttgaatcggtaatggctgtaatcccaccatctggcgtggaacagcttttccatgccccaagaggtgatgtattcgagtatgctcgcgccgaatgaggagataaggaaaatctcgatgggattcgtgaagtcatgcaacagcacgatcgcaagcaccgcgccgcatccgtaaattgggcacaacggcccgttaaggaaaccacggttgacccatcgacgttccgaaacggacacgagaaccgactcgtacacccatccgatgaaagcgtataacaggaaccaaaggaacaaatattcgagtgtgagcgccacagccatcagctcctgtccgtcggttgttcggatgcgggtttgtcgaaacgatcgaaagagagcgtttccttcgtggcgctgattttgtcggccgcggtgacaaggtatccttcgatgtacttcggcggatagggagtcaatgggaacatgtgatgttcgatgctgtcccgttcgatctggttgagtttgaaatcccgtatggcgttgcgcatggccgtttcaccatgtgtgaatccgtgtagccgatgggtgccgttgtcccagtcatgccaatcgtaaaggaagtaatcatggagcaaagcggcgcgaatcaacgaacgtagatcaaccctattccacaggtgcagtctgtctgccagccagacggacagacaagccacacgaatggaatgggcgaatgtggtgaccacgccatgctggtagcagaccctttcgatggccatgtggtcatgttccagaatctcccggccgtgcgcgtagaccagccgtcgtatctgcgtgcgcgtcaacagcaccgctttttgctccttgcttaatagggattacttgagcagggattcgggcgacttgtatgcggaaccgtcggacacggagttggcgaaggcgcgtagctgctcgatggtggtcttggcggaaacgatctgttcgcgcacgcgcagcggggaggtgcctcccttgccgttgcgggcggagacggagccttcggtggacagcacttcacgcacctgcggggccttgtccgccggcaggaagtccttgaacacgttgatgaagtcctcgtcggtcaaatcccacagctcctggccgtggtcttcggcaatcttgacgcatgcgccggaaagctcgtgcgcgtgacggaacggcacaccgttcttgacgagccattcggcgatgtcggtggcgagggcgaaaccggtcggggcttcggcttcgaggcgttccttgtcgaagaccatggtggcgaccatgccagtgaatgccggcagcagcacttcaagcgtgtccacttggtcgaatacggcttccttgtcttcctgcaggtcgcgcgcgtaggctgtcggcaggcctttcaaggtggcgagcaggccagtcaggtcgccgatgagtcgtccggacttgccgcgagtgagttcggcgatgtccggattcttcttctgcggcatgatggacgagccggtggagtaggcgtcatcaagacgcacgaacgcgaattcctgggtgttccagatgatgatctcttcggacaggcggctcagatcgacaccggtcatggcggcgatgaaggcgaattcggcgaccagatcacggctggcggtgccgtcgatggagttggcggtcaccttggagaagcccagctcacgggccacagccaccggttcgaggccaagggtgctgccggcgagggcaccggagccgtacgggctggcgtcgatgcgcttatcccaatcggcgagacgttccacgtcacgcagcagcggccacacgtgggccatgagctggtgggcaagcagaactggctgggcgtgctgcatatgcgtacgtcccggcatgacggtgcgaccggctttttcggactgctcgatcagtgttgcggcgagaccgagcagcattttggcgatgatgcggctgtggcggcgcagccacatgcggatgagcgcggcgatctgatcgttgcgggaacggccggcgcggagcttgccgccgagttcgtcacctgcgatttgaagcaggccgcgttcgagtgcagtggcctcgtcctcgtcatcctcgatcggagcgaatgctccggaatccacgcggcgctgcagctcgtcaagggcgtcttccatgcgctgcagctcatcggcggtcagcagtccggcgcggcccagtgcacgggcatgggcgcgcgaaccggcgatatcgtcatcggcgagtcgccagtcgaattgggtggacttgctcagccgtgcgagttccggcgacggaccagacttgaaacggccgccccacagggcaagatgctcaccattggtagtgctctcggtcattgtttttccaaatctccttgcagatatgactgagggagagcttaccagtcaggatggtcccgacggtacgctctcccccattatcaagacgattcacaacgtgaatccggatgatgcttactcgacgctgttctccggaacctcgatgccgttgccgaacttgacgtcgcgggctgcggccacgcggctcggcagaccatagatgtcgatgaagccgttggaggacttctggtcgaagctgtcgccggaatcgtaggtggccaggttgtagtcgtacagcgagctgtcggagcgacggccagtcacgacggcgcggccaccgtgcagaaccatgcgaatctcgccggagacgtacttctgggtgtcttcgatgaaggcgttcagggactgggttgccggggagaaccactgcgcgtcgtagaccagttcggcccagcgcttgtcgatgtcgcgcttgatgcggtgctgctcgcgttcgaggcagcagttctcgagttcctggtgggcggtgatcagcgccactgcgcccggagcctcgtacagctcgcgggacttgatgcctaccagacgatcctcaatcaaatcgatacggccgatgccctgcgcgcctgcacgacggttcatctcttcgatggcctgcagcggagtgacgtcatgaccgtcgatcttgaccgggacgccctgcttgaattcgatgacgacctcatcctcgaccggtgggaacgccggatcgtcggtgtaggagtagcagtccttggtcggaccgttccacggatcctcgaggaaaccggtctcgatggcgcggccccacacgttctggtcgatggagaacgggctcttctcggtctgcacgatcggcagcttgtgttccttggcgaaggcgatctcgacgtcgcgggtcagagacaggtcacgaatcgggctgatggccttcagcgtcgggtcgatggaggcgatggagacctcgaaacgaacctgatcgttgcccttgccggtgcagccgtgggaaatggtgtcagcgccgaactggtgggcggcacggacgagatgcttggaaatcagcggacgggagatggcggagaccagcgggtacacgccttcgtacatggcgttggccttcagggccttcatgcagtattcgttggcgaattcatcacgggcatcgaccacgtaggcttcgaccgcaccgcatgccagcgcgcgctgcttgatggtttcgaggctttcgccgccctggccgacgtcgagggacacggccacaacatccttgccggtgcgttccttcagatacgaaatggcgacggaggtgtcaagaccaccggagtacgccaggacgagacgattctgatcgctcatggtttccctttctaacatccaacgttattcatcagtatatgcacagctctgtatatttatgcatatttggtgcgtcgtgtccactatatggctattcacgctttggaagcgacatcaagcagccattgcgcacgccgtttggcgacatcatcctcggagcagataaccatgaccgtgtcatctccggcgatggtgccaagcacgccttcgatgggctgcttatcgatgacgctggccacatattgcgcggcgccggatggcgtgtgcacgaccacgagattacgtgccgcggccacggatgtgaccagtccggacagtacccggctaatctgctgctcggttttggcgtccgggttagaagccggatgttcatcaatgttctgtttgccgacggcgtaggccacggttccgtcggcaagacgggtcttcgtggcgtgaatctcatcgagatcacggctcagcgtggcctgcgtcacctcgatgccctggtcggcgagaatctgcgacagttgcgattgcgaggtgacgatgcgcgtcagcagcgcctgctcaatggcgctcagtcgagcggttcgtgtggcaggacgctgcaacgcgggagtgtggtcagtcatcagaccagcaggctttcatcgccacgggccttgccggccaaccaggtcagcaacgccttctgggcgtgcagacggttgcctgcttcatcccaaaccacggactgaggaccatcgataacctcggcggtgacctccttgccgcgatatgcaggcaggcagtgctggaagatggcgtcgtccttggccttggccatgagttcggcgttcacctggtaatcccagaacggcttggaacggacagcgtattccgcttcctcgcccatggagacccacgtgtcggtgaagacgcaatcggctccggcaacagcctcattcggatcagtagtgacgaggatggagccgccggtctcagaggcaatcgcttcggcatcggcaacgatctgcggatccggcaggtatccgtacggtcctgccacacgcacgttcatgcccgccacagcgccgccgagcaggtaggagttggacatgttgttggccgcatcgccgagataggcgatggtctggttcttgaggttgtctacaccgccgcgatgttccgcgatggtctggaagtcagcaagaatctggcacggatggaattcgtcggtcagtgcgttcaccaccggatgggtggagtacttggccatttccgcaacacggtcctgaccaaaggtgcgccacaccacgccgtaggccatacggtcaagcacgcgagccgtgtcggccaccggttcgccacggcccagctgggagccggacttgtcaatgaccagcggatagccaccgagttcggccacgccaatggagaagctggagcgggtacgggtactgggcttgtcgaaaatcacggcgatgccctgcgggccagcgaacggctggtgatagaaacggttcttgtggaacttgatggccagttccagcacctgcttctgttcttcgtggttcagatcgtcatcgcgcagcatatggcgcagttcaggggttgccattggtatagaggctcctttcaaattcttcgggttcgtccgagatcagtcgttaggcaggtcggacggaatcttggcgaggatggacaccgcttgatcgacgtcctgagcagtgatgaccagcggcggggcgagacgcaacgcattcggagccactgcattgacgatgagaccgtgttccaaagcccagttcatggccgcatgcgagcaggggtgggcaagttcgatggcgtcgagcaggccacggccacgcacggagacgaatagcggattaccgcaggaggcgataccgtcgcgcagctgcttgccgcgttcttcggcgttgtccacgaggctgtcctcttcgatgactcccagcgttgccaatgccgccgaagcgcccaatggattgcctgcgaaagtggagccgtgggaacccggggtgaacagcgcggacagttcggcgccgaaggaaatcatgccgcccatcgggaaaccaccgccaacgcccttggcgaaagtgacgatgtccggggtcacaccgccggaaagatcctcacgctggaaggcgaaccatgctccggtgcgtccgatgccggtctgcacttcgtcgatgatgaggagcgccttatgttcgtcgcacagtttgcgggcggccttcacatagtccgctccgagcggcatcacaccggcctcgccctggataagctccatgatgacggccgcgaccggccctttgccgtacttgccctgaccggtttcggcgaaagcgtcgtgcaaggcttcgacgttgccggcctccacaaattcgatgttcggtaccagcggctcgaatttctcacggatggcgggcttccacgttgcggacagcgcgcccatggtacggccgtggaaaccgtgggtcatggagatgatgcgtgccggtttgccgccgatctcaggcgacgcgcccggcagggtgcgcccgtagagcttggcgagcttcagcgccgcctcgttaccttccgcgccggaattgccgaagtagacgcgggaaccttccggagcgcccgcgagcttgacgagtttggcggcgagcttgatctgcggttcggtggcgaagtagttgctcacatgcgcggccttggcggcctgctcgctgacggccttcacccacttcggatgggcgtatccgagtgcgttgacggcgatgcctgcaaggaaatcgagatattcattgccgtcgacatcccagatgtgggcgccctcaccgtggtccatcacgcgcaggggcgtgccaaacacgttcatatgcacctgggagtactctcccagccacttggcatcttcagtgccgagtgtttccagttgttcagttgccataggaactcctcatttcaataccgtcctcgggcacgaccatggtgccgatgccgtcggtggtgaagatctcgttcaggatggaatgcggtttgcgaccgtcgatgatatgggcccgcggaacacctccgtcgatggcgcgcacgcaggcttccatcttcggacgcatgccgctttccaggtcggggagcatatcgcgcagattctccacgccgatgcggccaatcagggagtcacggtccggccaatcggcatacagaccatcgacgtcggtcaacacgaccagcttgctggctccaagggccgcggcaagggcggccgcggcggagtcggcgttcacgttgagcacttcggtggcatcgtcttcattcggcgccacggaggagaccaccggaatacgtccggcgttgattagatcctccacggcggacgcgtcgacgctcaccacgtcgccgaccaagccgatatcggtgggtttgccgtcaatgaccggtttgcgctgcatggccgagaacagggcgccgtcctcgccggacagtccgaccgcgaatggaccgtgcgcgttgatcaggccaacgagttcacgggacaccttgcctgtcagcaccatgcggaccacatccatggcttccggagtggtgacacgcaatccgcccttgaattcggacttgatacccagggccttaagcatttgggagatctgcggaccgccaccgtgcaccacgaccgggtgcagtcccacctgacgcaggaacaccatgtcttcggcgaagcaggctttcagatgatcgtcgatcatcgcattgccgccatatttgatgacgatgcgttgtccggcgaattcctccagccacggcagcgcttcgataagcacctccgccttctggtcggcgcgcaggtcggtgtgcacgtcgaagtggaatccaggtcctttgagttctttggccattcctattcgatcagctttcgtagtcagcgttgatgtgtacgtattcgtgggtcagatcgtcggtccagacggtcgcttccgcttctccggcgttcaggtcgatgtcgatgtgcacctcgcgtggggtcatgtccacttcggagcggtcgcgtccggctccgccgttttcgcagatgcgtacgccgttgacgtccaccgtgaccttttcggaatcgtatggtgcgacgtcggacggcacggtgccgagggagctgacgatacggccccagttcggatcgttgccggagatggcgcatttgagcagattggacgctgcgaccgcgcggccgcatgccagagcggcttcttcggtggtcgcgccggtaactttgacacggatgtcatggcttgcgccttcgccgtcgccgatgatctggcgggcgagcgaggcggtggccttggccacgagctcgttgaactcgtccggttccggttcgatgccggacgcgccggaagccagcagcagcacggtgtcgttggtggacatgcagccgtccacgtcgatgcggttgaacgacatttcgactccggcgttcaaggcggcttgaagctgtccggcggtcacgacggcatcggtggtgatgacgcacagcatggtggccagctgcggggcgatcatgccggaacccttgaccatgccaccgatacggaagccgttggaaccttccagctcgacggttttcggcttggtgtcggtggtcatgatggcgtgcgacgcatcggctccggcttcggcggtatcggcaagggtttcaaatgccttgtccgcgccggacagcacgttgtcgagcggcagcaattcgccgatgagaccagtggaacatacggccacgtcttcggctttggcgccgatgaggccggcgaccttttcagcggtggccttggactgctcgtatcctggcttgccggtgcatgcgttggcgccgccggagttcagaatcacggccttcgcatggccgtcggatacgatgttcctcgaccactgcacaggagccgcgcagaaacggttcgaggtgaacacgccggcagcggcgtcaagcggtccattgttgaccacgagagccagatccttcttgccttcgaccgcggaaatgccagctgccacgccagctgcggaaaaaccttgtgcgaacgttacgctcacggtgccactccaatcttcgtcaatcctgcatcctcaggaagtcccaatgccacattcagcgattgcacggcctgtccggcggttcctcggttgaggttgtcgatggccgcgaatgccagcaggcggccggcatgatggtcgacgaccacttgaatgtgggccgcgttagaaccgatgatgttggcggtggccggcattacgccttcaggcagcaccaccatgaaatcctggccttcgtatgcgtccagccagacctggcggatctcggcatccgtcatgccaagcgctttgtcggtgagtttggcggaaacggtggcgagaatgccacgcgccatcggcgcgagaatcggcgtgaaggcgagggtgtaatcgtccgcctccgcagcactcttgccggccgcgtgcgcgaagttctgcaggatctccggaatgtggcggtgcgtaccgcctaccgaatacggcagtgcggagccgaacgcctcagccgcaagcagattggtgcgcttgaggttcttgccggcgccggaataaccgaccaccaaatcagccacgatgtctttcggttcgacaagaccctgcgcaatgcccggttgcaaagccagcgtggtcgcagtgacgttgcagcccggtcccgcaatgcgcttggtgccgggaagcgcttcacgctgacggctgtaggagccgtctgtctcgatgccggtgatgagttccggcatgccgtaggtccaatgctggtagaagtcaccgccgtagaacgcgtcccatgcgctcttctcctcaaggcggtgatcggcacccagatccaccaccactgcgttcggatcaagctgggaggccaatgctccggaagcgccgtgcggcaatgccaggatgattacgtcatggccgttgagcacttccggcgtggtgtcctcgaccacgaggtccgccaactgcggaatgtgcggcatatgcttgccaagcttgtcccccaccgaagaatgtccggcgacgcaggtcacttcgaaattcgggtgtgccgcgagtatgcgcagcgcctcaccacccgcgtatccagtcgcgccggccacggctaccgtgtatttggccatgtcacgtctcttttccttgactcgttgaaacacattcagcatacactttatgcactacattgcataattatgcagttcaatcgtgtcggatagtggtcaccgcccgtaacgggaccgttcagacgaacataaaaagattggtttcaggcggaaatcgagctggaatcaccactttggccactgccaccgaacatgtactgcatcatctggttatacaaatcggctgtggaaatgccgtgaaccgtcatccaaatcaccgcaatggtgtacagcacgttgataatcagcgctgccacgccaagcgcgtagcctttcatatgcagttttttggtacgccacatggcgatggcgcccatcaccgcagggatgaccggtaccggcaggaatagtgcgaacacgaacgagatgatcgcatagctatcccaatggccgtacagggggttctggctgggatcattcgggttgatgggatatatgccgggctgttggtatggattcggcccatactggtttggcccgtattgatttggtccatactgatagccattgggctggcctgattgctgccgtcccgatgcatcatatggattcgccggatacccgttctgcatatacggattcgtctgcggctgctgcgccgtttgttgtgcatcgtccgccggcttgggctgttcgggagccccatacatgtatggattgtagttcgccggatactggttggacatcgcgccatattcaggctggttgtactgtccgaattccggctgtgccgactggtccgacgacgaagacgacgaaaccggagcagccccggccgcctcctgcccttcgtcggggttgatcggctggttctgctccggttcgttcatgtcgtcctctttatctttttggttacttcgatggacttgacgtgtcaggcacgcagttgcgcgcccagcttcgcggccgcatccacgatgcgcttgcgaacggcttcgctgtcctcggaggtcagcgtcttgtcctcagcgcggaacgtgacggcgtatgcgagggacttcaatccctcacccagctggtcgccggtgtacacgtcgaacaggtcgatgctctccaagctgttgccggcggcttcgacgatggtcttctcgagttcggcggcggtgacgtccgtcgacacggtgaaggccagatcctgcttgaccggcgggaaggtggaaatcggcttggcctgcaccggcttgccgctcaaggtggcgaacagcgcggtcaggttcagttcgaacgcggcggaatgggccgggaagcccaacgcctcgttgacatgcgggtgaagctcgccgaccatgccgacgaacgtgtcacctgccatcacacgtgccgcacggcccggatgccactgcgcgggtacgtcctcagccttcggctggtccaacgtgagctttgcgccgatgcggtcggaaatacgctgcacggcttcaactgcgtcagaccagtccacggcacggcgatcgcccatccagccggagtcgacggcgttgccggtcagaatgccggcgacgtgcatcggctggtccggcaggcctgcgtcaagcgcggccaactgctcgtcggtcggcttgacggcacccggcaatgccggaatcgccggagcgttcggatcccacaggtagacgtgtccgatttcgtacagcgacacgttttccacgccacggcgcaggttacgctgcacggtctgcgcgagggtcgggatgatgtcgcgacgcaggaacgggcgatcgccggccagtgggttggcaatttcgacgctgaccttcttggtggcgtcggcgtcaagtgcgaagttcttgtagtcttcgtcgcccacgaacggatagctcagggtctccaccatgccgtattcggcgagttcgtcggccacctggcgcttgcgcagctgctcggcggtcagtccgaccttgccttcgaccggtgccggcggcacggtgaccggaatctcatcgtagccgaccagacgggccacttcctccaccagatcgcacggttcgttgaggtccggacgccagctcggcggagtcacggagaactcaccgttgccaccgccggccacagtgcagccgatatcggtgagaatgtcgctgatggtgttcacgtcagtgtccagtcccgccacgcgggccacttcggacgccttgaacagaatcggacgacgattgcagacggtgttgtaatcagtcgggtgctcgctcggctcgccgttgccgtacttgaccagaagctcggcggccatctgggcggcagccggctgcagctgatcatccacgccacgctcgaaacgacgggacgcttcggacggaatcttgtgacgacgtgcggaacgcgcgatcgacacctggtcgaaatgagcggattccagcaggatgttcttagtttcagcagtgacctcgccatacaggccacccatcacgccggctatgccaagcacacgggagccacgctcgccgttcggcgagtcggtgatcagcaggtcctcgacgctcagatcgtggtccttgccgtccaatgtggtgagcttctcaccttcgttggcgcggcgcacgacgatcggtccttcgatcttgtccagatcgtaggcgtgcatcggctggccgagatcaagcatcacgtaattggtgacgtccaccgccaaagagatggagcgcatgcccgcgcggattaggcggcggcgcatccagttcggcgtgtggctcgccgggtcgaaaccacgcacggcgcgcgcgtagtagcgatcgcagccgaccacaccgtgaatcggattcttgtcgtcgacgatcacttcgatgtcgctcttgacaccttccggcagaccctgagtgacgggcgccttcttgccgagggcggttgccggatcagtgtagacggcgccagtggaatggtggtattcgcgggccacgccacggtaggagaacgcgtagccgcgatccggggtgatgttgatttccagcagcggctggtccaggtgcagcagatgcatggcgtcatcgcccggctggagcttttcgtattcctccggggtgaagccgtacttgcgtagcaggatgatgccgtcgtggttatcacccagaccaagctcgcgctcggaggcgcacatgccgttggagatgtggccgtaggtcttgcgcggttcgatcttgaaatcgcctggcagcacggcgcccggcagggtcacgacaaccttctcgccggctgccatgttcggagctccgcagatgatgccgcgtggcaccttgttgccgttttcatcggtctcgttgtattcgtcgccgacgtccacgtggcaccagttgatgatcttgccgttcttctgcggttccggagtggcgtcgaccacatagccgacgacaatcgggccggtgacctgggaggtgtggatctcttcctcttcgaggccgaccttcaccagatccttggcaagctgttcgtacgtaaggccttccggaacctcgacatggtccttgagccaatcaatgtcaaccattggcatgggtcaatcactcccccatcacaaactgttcgctgaatcgcacgtcgccttccaccaggtcgtgcatgtcgttgatgtcgtggcgcagcagcagggtacgctccacgccgacgccgaaggcgaagccggtgtagacctcaggatcgaggcccgcagacttcagcacgttcgggttgaccatgccgcagccgccccattcaagccaaccggcgccgcccttcttatcggggaaccacaggtcgagctcggcgctcggctcggtgaacgggaagtagctcggacgcagacgggttttggcttccgggccgaacatggccacggcaagcttgtcgagcacgcccttcaaatcggccatggtcagatgcttgtccacggcgagggcctccacctgatggaacaccggggtgtgggtggcgtcaagttcgtcggtacggaacacacggcccgggcaggcgatgtacagcggcacgccacgggtgatgagtccacggacctgatcggacgaggtctgggtgcgcagcaccatgttggagccgacaaagcccgcggcgtccttggcctgattgcccttgacgtagaaggtgtcctgcatctggcgggccggatggtccggaccgaagttcagcgcgtcgaagtcataccattcggtttccacttccggaccgtcggaaatctgccagcccatggagataaagaagtcctcgacatcctccatcagcttcggcagcggatggcgggcgccaagcggcttgcggttgaccggcaaggtcatatccacggtttcggcagcaagctcgcgggcctcttcttcggccttgacttgcttttccttggtgccgaacgcacgaccgaagtcggcgcgaagcttgcccatgagcttaccggcgtctttcttctggtccttcggcaacgcgccgatggccttgctggcctgcgtcatcgcggattccgctccggcgtactgcgtcttgatggctttcaattcctccattgtggaggcgttttcgattttcgcgatgccctcggcaaccgcatcggttaccgcttgggcgtcgaataccgcaccctctgccacgagatacctttcttatcaaccgtttgttttacgcataaaacgcgcaattccaacgtttttacgacttcacattctttcaacatgactcgacatagccaagctcagcagcatcaccgccgcactggtgccgagattgagcgattccgccttgccgtagatgggaatcgacacgattctgtcgacgcgttccaacacatcctgggtcagcccgcgcgcctcgttgccgaacagcaccgtcttggcttgcgcaagtgattgcggtacggcaagcacgtccgtaagcggttccggcggccgtgcatcggtaccatacacgtcggcggcgtacacggcgagtccacgttccgcacaccaatcgaaatactcgtccgtacccatggagacgaccggcagatggaacagcgagccagcagtggaacgaatcaccttcgggttgaagatgtccacgcagtcgtccaccagcaccacgcccgcgcaaccggccgcatccgcggaacgaatcacggtgccggcgttgcccggatcgcgcacctgccagaacgcggcgaccatcgtgcgttcgtcgaaatcgccatcaatgacggcggaatcgaggaaagcgcgcatgtcggcgacggcgagcactccctgcgcgtcggagctcatgtgctgcatgacggcatgcgtcaccttatgcacgtaagcaccggcctgcatggccttgccggccatctgcgccacggtaggcgtgatgaaagccgcgtccggctcggcagagacgacctccacatacagatcctcgacgatgtcgggatgccaggagagcagttcacgtaccgactgcggtccttccaccatgaacctgccggaccgcttgcggcctttcctgtcggcaagttcggagaccctgcggacgcgttcggcccttgggtttgcaatgacttcggatttcataggcatacgcgttagcctaacaccttcgaagcggttggcgacgcggccatgtcatgtttcgaggcgtccagaaaacatccagccacatcccagcgcgaacaaagcgtctttctgttgtatgccaagatacaacttttaccatcagcataaacgccgatcgcgagcggcgcggaaccatcaatcgctcatatctatcgaaacacataaggaaacagccatgttcgtcgtcaaaaacgcatggaaaagcgtcacccgcaacaagggacgcaatatgctcatcatcgtcatcgtgaccatcatcgccgctgccgccacaatcggcctatccatccggcaggcggccgccaccgcaagaagcagcggattagataacaccaccgtcaccgcgcagatcagccttgatcgcggcaaactcatttccgaatcgcgcgagcagtccaagtcggattccgattcgtccgatgcttccgccaaacctgacttcgacgccatgcgttccgctttggccgacaagcagttttcgcttgccgactatcagaagtacgcgaaggcttcatccgcggtgaaatccacatattatatggagaccacggggttggcggcgaccgacgatttccagccggtcaccgattcgtccggttcggattcctccagctcgtccggctcgtccaatatgaaggattcgtctgataccgccggtacggataacggcaaccgtcaggatgaacagcccggcgtccccgacggacaaatgggcgacgtcgcgggcagcaaagacggcgcgggcatggtcagcggcgatttctccctaatcggcttctccagcgacgaggccatcgccaacgcctccaatggcagcttcaccatggtgaagggcaaggtgttcggctatgacgcgagcagtgatggcgatgccatcatctccaaatcgctcgccgaccgttcctgacaatccaatcgcacgttttttctggaaaggacctcccatgacaacgaattccgcggataccgccaatacggcaatcgcaaaagaagccgtcgagaccaacggcgcacaatcgcagcagaccggcccgcctacgctgcagctggataacgtcagttatgcctacaccaaaggcggcaaacgcgtgctgaaaaacatcagccacgatttccaagccggcaaagtgcatgccatcaccggaccgtccggagcaggcaaaaccacgctgctatcactgatctcgggactggcgaatcccacggaagggatggtgctggtcgacggcaccgacctgtcggaacgagaccgataccgttttcgcagccatgacagcggcgtgatcttccaaagcttcaacctgctgccgaaccttacggtggcggagaacatcatcctgtcgatggacgcgtccggcaaatcgttcgacaagccgaagaaagcaatcgtcgaagaattgctcaaacaggtgcatctgccgaaggaatacgcgaacgagcggattctgcacctgtccggcggcgaacagcagcgtgtggcgatcgcccgcgcgctaagctacggcccttccatcatcgtcgctgacgagccgaccggcaatctcgacctggccacccaggacgacatcatgggtatttcccgaacgttggcgcatgatgggcatcgttgcgtcatcatcgtcacgcacagtccggaagtggcgaagacgtccgacgaggtgttcgagctggctcccatcaggcgtcgcagataagcgtcggcagcttctcgaaaagaaatacggcatgcgtccccatgcaacggacacgcatgccgtattttttcctgtttcggttggacggtggcgttatgattgggcgcgtcgaagtacaggggtgccgaatacggctgagacgggcgaccgcccggacccttgacctgatcaaggtaatgcttgcgtaggaacagtaccggcaaaacgcgtcgcgtcccgtagagacgatctccgttgtatttcggcttgtgcacatacccaatggaagtcgagaagggacaccatggccaacgaaaagccatcgacacagacgcagccgcacggcgatgccgcaaccagaaagaaaaccgaaacgagcgtggcggaagccggttcgtcagccgaaaagaaggtcacgccgaagaacgccctgctgggattgcagcatgtgctcgtatcaaacgtgtggcttgatccggtgttcgtggcgggcgccatcggtctgccgttggcattgtcgtcgaacatggtgaacgccattttcatcgtctccggcctggtcacgcttatccaggccacgaaactggtgcgcctgcccatcgttcagggtccttccgcggcgttcgacgcgctgatgatcgccgccggcaccgccggatcacttgccgcggccggcacgtccatcttcatcagctcgctgattttcctggtgctgtgcctgacgcgtgtgatcgagaagctgcggttcctgttcgccccgatcgtatcgggcgtgatcatcttcctcgtcggcgtctccctgtcgggattcacattgagcgagttccttggcggcgcgccgggagacaagggctccgccgatccgaagacgctggccgtctccatcatcacctgcgtgctggtggtggtgctttcccagttcggcaagggcatggtgaaggcgctgtcgtatctgatcgcactggtcgtgggcaccgcgctgtctctggcgttcggcatggccgacttctccgcggtggcctccaagccgtggctcggcctgcccaagttcatgccgtatggcggtttcgatttcaacgcggcgattttcgtaccgttcttcatcgcctatctggtggccatcatggaagccctcggcgtgtatcaggcggccacggagatccaaggcacgaagctccaggaccgccaggtgcgttacggtcttgccggagaggccgccggttcggcgatctcctcgctgatcggcggtttcaccaccaccgcgtatccgcagaacgtggcgctgctcaaagtcaccgacgaaggcaagacccgcacccgcgtgccggtgatcattgccggcgtggtgttcgtggtgcttggtttcattccgaaggcgggcgcagtgctgtcgctcatcccatctcccgtgatcggcgccatcttcctgccggccgccgcaagcctcatcagcaccggcttcaacacgctgcgcaaggtggaaagcgacgaccgcacccaagtggtgatcggcctttccctgctgcttggcatcgccctgccgaacgcgttgagtggtcttgaaggaggagcgcacgtgttcttctcgaattcgattctggtcggcgcgttcagcgtcgtgattctcaaggccctcatcatcgacctgccgaactttatcgcacaacacgcagacgagcggacgaaacaagcggaataatcgaaagcatccgaataatccgacaaccatacgacggaaaggacatggcatgagcatggggcaatcgcaggaatccacgaacatcgacgagacgaaggaaaccatcaaacgggaggtgctcgacttcatcgcacaatacggctgcggcaaggcgcccgatgaggcgttcgacacgctggcgaagcatatcttcgcctttcaattcgagcacaacctcccataccgcgcctactgcatgtccaaacgcgtgacgccgcagacgctcgccaactggatgcagattccccccatgccggtggacggcttcaaaatgctgacgctcacctccgtgcccgaacaggattgcgaagcggtgttcaccaccagcggtaccacgcatcccggtcaacgcgggcgcaacttccaccccgacctgcaagtgtgggacgagtcgatgatcgtgccgttcaggcatttcatcatgcccgaccgcgagcgcatccgcatcgcagtcctctcccccgcatgggacatgaacgagcattcgtcgctgtcccgatatctgacccgcgccgtggagcagtgcggcgccgaaggcagcggcttcttcttccatgaggatggccttgatttcacaggtgtcgagcgcttcctcgacgaggccgcgaccgacggcgaaccggtgatgcttatgggcgcctcctccgcctacctgtatctgctggattatctggacaagcagggcaagacctacgctctggccgccgattcccgcgtgttcgatacgggcggtttcaaaagcacgcgcaccgacatgacggtcgacgacctgtatgcggcgttcgaacgagtgttcggcgtgaagcgctcgcattgcgtgaacatgtatggcatgacggagttgagttcgcagatctacgatcagaacatcctgtcctattacacggatggttcgtcgaattatctcaaagccacgccgtcgtgggtgcgttcggtgttcctcgatccggcttcgcttacgccggtcgccgatggcgagcagggtgtgatcgcgcattacgatctggcgaattggaattcgtgcctggctattctgacggaggatctgggtgtgcgcaccgaacatggctatgtgctgaacggtcgtgcgaaaggcgccgaggcgcgtggctgttcgatcaccgtcgacgaggtgatggcggccaacgcatgagcgacgtcgacattttccacgcgccgcgggatttcgagttccatgatttcgacacacgcaacgtcacggcgtccgatggcggcacggcgacgttgtgtttcccccgtctcgacgccgatgccgtgcatgcgctggcggcgtcggtgcggcggcatcgcgccgagaaactggcgcggtattccacggacgggatcgtcgacgtgatcgcgcgcgccgtagaattgtggacggatccggaatatccggaacgtcggcttgcggagcggctcattcccgcggtcaccggctatgacgcgtccatggtgcgtatcgaattgaagcggtacatgcgcatgttccgtcggcgtgagctgctgcgtttcgtggatgacgagttgaattgcccgcagatgcttgacgagtatcgcccgaaccgttcgggcggatacacgcggctgtacggtccggaattgtcgttccacgtgttttccagcaatgtgccgggcattcccgtgtggagcatgacgatgggtctgctgacgaaaagcgcgattctcggcaaatcgtcgttcgacgagccgctgatgccggtgctgttcgcccgttccctggcaagcgtcgaccccgatatggcggacgctttggcgattgtgccttggcgtggcggcaccgtggatttggaggatgccgcgattggcgaggcggatgcggtggtcgcgtacggttcgtcgcacaccaccgaggcgattcgcccgcgcgtacgtgccggaaagcctttcctcagctacggcgcgaaaatcggcttctcgctgatcggccgcgaggcgcttcgcgccgacctgtatgccggcaccgtgcatcgtatggcgatcgacgtggccacatacgaccagcaaagctgtctggcgccgcaaaccatgttcgtggaacgtggcggcgcgatgtctccggcgcaggtcgccgaactgcttgccagcgaattggacgggcagcagcgcaaatatccccgttccacaccgtccgaagaggagtccatggcgattcagcggttgcgttccaccgcgcagatgaaagcgctgatgctgggcgccggcccgatggccgccgcggccggcaacgcggatgatgcgccgtccgacgacccgttcgtggtgcagtcgcgttcgggcaccgactggacggtgctgtactatccgtccatcggcatggccgactcgctgtccacaccactgaaccgcaccgtcaacatcgtggcggtggaccatgtcgaggacgcgctgcccacgctgcgcccttacgcgcaatggttgcagacctgcggtgtggcgctcgctccggaccggctgttcgacgtggcgcaacgcgtcggcgagaccggcatcgaccgcatctgcccggtaggcgagatgaatcgcgcgaaatccggctggcatcacgacggcggcttcaatctgcttgatctggtgcatgccgtcgatatcgaacgtaacaccgatatgtactgtgatggtttcgatatggatgtcgaataatcacattcaagcaatcccacgaaatacgtatacccaaaaacgaaaggaatttccatgcagcagtccgattctctgccgttgaagggacgtgtcgcattggtgactggcgcgagccgcggcatcggcgcggcgatcgcgttacgtctggttcgcgccggcgcatgcgtggctattaactacgtcagcgatgacgagcgtgcgaagcggtgtgcgcaacgcattatggacgattgtgaggcggccggtcgtgtgatcacctgcaaggccgatgtcaccgacgccggacaggtgcacgacatggtatccacggtggtcgcaacgttcggcggattggacattctcgtcaataacgcattcgcccgttattcgttcgacccacgcaatcgcaagaccttcggtaccatcggatggtccgattacgcggcacagctagaaggatgcctcaaaggcgcatacaacacctgcgaagcagcgctgccgcagatgaggcgtcagaccggaggacgcgttatcaacatctctagtaacctcgtcgactccccgattgtgccgtatcatgactacaccgctgcgaaaggtgcgttggtaggtttcaccagatcattggcgcaggaggctggggcatggggcgtgaccgtgaacgccatcgcggccgggctcaccgttggcaccgaatcgagccgtgccaccaccgaggatgtacgcgagcgtatcatcgcatccaccccgttgggcagactcgccaccgccgatgatatcgccggagccgtggctatgctggccagcgatgacgcatcattcatcactggccagacactgcacgtcgacgggggcttggtgatgcgttaaagcgtggttttgactttggtttgtggcgccagcatattcgtcggcaaagaaggatggttatgaatatcaccgtgtatctcggtgcgcatgagggaaacgatcccatatacaagaaagccgttgaggaattgggcatatggattgcggacaatggcaacaggctggtgtatggcggctccgatgaaggattgatggccgtgatcgccgacaccgtactcgcccatgacggcgacgtgaccggtatcgaggcgcagatgtttgtggacagaggcgttgcacaccataacctaacccaactggttgtcgtgccgaatatcgtggaacgccggacccgcatgattgagcttggcgacgtgttcatcgctttccctggcggcacgggaacgttggaggaaatcagtgaggtggtgtcgaaaatttgtcttgaccaactgacccaaccctgcatcttctataatctcaacggcttttatgatgatatgaaggcattcctacagcacatgatcgatgcgggcttctccaccgcagaacgtcagcatggtatctatttcgcgtctaatctgaccgaaatcgaacgcgtcattgcagcgcataacgcataggaatcggcaaacgtcagaccaccggcagaacagcgtgcagaatcgtcatgaacgtcagcccgataacggccgtgacggtcaacgagaagcctgcgagtttggcgttaccggtcagcgaatcagtgaattttgtggagaaaatcgttaccggtgcgaatgcggccagtaccatgatttctcggacacgttcatccaacggcaacaggaaccatgcggacaatgcgatgatgatgctgaacaggaatcgccatgcgataactttgcctagttccgaacgatccttatgactgtcagggatctccatcatcaggccgatcatggccattgctgcgaaagcgttggcgttggcgaacggagtgatgagcgtgacgatccaatgcggcacactccatccggcgaacatgatcaccagcatgagcatatagcagtcgaacgaaatggacgagtagaaatcgtgcgcgatattcttgatcttcaggctcaatggcaggtttttggtggggcttcccaagtgcagcagcgagcgggtaatggtcagggatgcggcagtggcgatgatggcgttgcctatatcgagcataatgaccggcagacctgcgctcggtcccatgaaggtctgcaccaccggcagacaaaacgcgccgatattcaatcccgacgcgttgagcatttgataggcacggtagcgtggctcgtcgccacgtgagccgaaatacacgacgaacagcggaataaggcaggcgaacaagccgaacacgaccagccacaacaggttcatcggatgcttattcgtagcgaaactcatgatgatggcgcatggcagggtgaggttgaacaccagcccctgcaccactttgtaggatttgtcagagaagatatggatgcgcttaagtagatagacgctgatgatgacgagcagcaatgacccagcttggaacaacatacggccgagtataggagcatcgccgacgcatcatggaaccacccgacacaatgtgaccgtacgacgcacaaagatacttgcatgtccatgccgcacgcctcgaactaaacgactagcttaaagctttaccggagaatcccgaataaacgccgcgagataacgtatgactcccacacgaaccgtgacggttcgtatgggagtcatacgttcaaagccaccgcataagtgacctataagtggcctaagctattctgtcgaaataaaaacgtagtcggcagtaggactcaagggcgatgcggccgaccaccgtgccgcggcggcacggtggtcggaaccggatgacgtacgctagttactctcggagtccggaaacacgtcccgcgttcctgaactccgagacgaatgtctcctccgtgataatttcggtgaccagtgcggaaatcagtttgtacaacgtgttctccgcaggatccgcgtcatcgtcgatggccagattgattccctccttgtccaggagggcgagggataccgacatcgcggtgcgcttgttgccatccgcgaacgagtggtcctttgcaagatggaagacgaaatgcgccacctgtccgaacagatcgggaagtagccccgacctccaacgcacttcgttggaaaaccgccgtttttggctattttccaacgaaatcggctcgtttcgaggatgaaaccggaagccgttttcctgctatatccggctatctccggcagacgtaagtacaccaataagtacacctggcggatggccgcatagcgaaacggcatggacgaaacggaacacatgccgagatacacgctgacgttggtcgactcgaccggcgccatggaaccgctgatactcatggacgacgacctgaagtcaatcgccgcgaagctggaagggagggtgtcggccaagacgcgcgggcgccggccacgcggcaccggcggcatatcggccacgccgaagggctacagggcgtactcgacggtgaccgacccgctgacgggcaaggaccaccgtgtgtccggcttcggacgcacacgctcgcaggccgaggcgcgactcaaggagaagctggccgagttcgaccgcacccaccgcgtcggctacgtcaggccgcccaccgtggccgaatggatggaccactggctgacggacgtgtgcaagccgcgcctcaagccccgcacctggggcacgtacgcgtccgtcatcgcgaacaacatcgtcccctccatcggcgccgtcaggctcgacgagctcaagcccgcgcacttccgccgcatggaacgctacgtcatggacgagcagggcaaaagctccggcaccgcgggcagcgcgtggcgcaccctgcacaaggctctggaggacgccgtattggagggcgtcatcgaacgcaaccccgccgtcaagggcaccgcgccccgcgtggcgttgaaggaacgcgccgccctgacgcccgaacaggccgccgacctcatcgccgcggagaccgacgacacctggcggctcatgtggatgctggccttcatgaccggcatgcgccagggcgaacggctgggcctgaccgaagacgaactcaggcgcgacggcgaccggctcatcatcctggtcgaatggcaggcccagcacttgacgaaacgcgaggtcgagggactgcccaagggcgtcgaatgcacgccgctcggcaacggcatgtaccgcacgcgccccaagaccgagaagggccgccgcgccataccattgcccgaggccctcgccgaccagctgctcgcctacatcgaacgccacggcgtgaacggcgacgggctcgtgttccacgacgaccggggactgcccctgaccggctgcgtggaacgcaggcgctggtaccgggccctggaccgcgtcggcctgggccacgagtacgtgccccactccgcccgccacaccaccgcgaccatcctgaaccggctcggactggacgacgtgacccgcaccgccatcatgggccacagcagggtcagcacgacgaacgagatctacacgcacgtcgagctcgaccggctcgtcgccgccaccgacggcgtggagagggccatcgagggctaggcgcgaaaagacccgcggcctattcggcaaggccgtgggccatgggcgcggaatggcatggggactttcatgatcttccgtcgcgcgccgaccaaccggggatgacgccggatgcgggtctcagacgagccgcagctccttgcctccgggcagggaggcggtgacgtgcaatgttccgccgatgccttcgagatagcgtttcagcgtgtccaccttgatatggtccacgtcgcccgactcgatgacgcttatcctcttctggctgacccccagggcctgcgccaatcgcttctgggtgacgtgttcggccttgcgggcctccttgagctcgtagagccggatctcctccaacatgcgccgtttctcggcctcgacctcgtcgcgggtgatgccgctgtcggccatgaaccgctccggtgtgtagctcatcggtccgtctcctttccgtaccgctcctccagccatacgagatagcgccgttcggcttcaggtatggccttccgataccatttgtcccatttccgctgcttgtctccgcccaccaacatgatcgccttccgcttcggatcgaacacgaacagtatgcgtatctcgcttctaccggaagatccgggcctgagctccttcatcgaggggatgaggctcgacccttttatcttgccgactatcggacgtttgaggtcaggcccctgctcctccaacaatgacacggcggcgagtatctgcacccgcgatttatggtcgagcgtgttcagccaatcggctatgggttccaattcaactttccacacacccgcaaatataccatataaggtatgtccccgcaaatcggcgaaacagcaagggcataccgcaaaaaacacgcgagaacacatcgccaaaggcgacgccccacgcccgaggccacatggcatccggcaccggccccgcggacgacaaggcatgacggcatcacgggcgaacgcatgggagaaaagaccgaaacaacgctagagtggacggcatgggagacttcgcaatgttcggccgcgcgatggcggaccgccatggcgtcggcatcatcgtcagcatcgactaccacggcgcctcctacggcatacagacgccgcgactgctctgcaagcacctgaccgccgccgaggtccaccccgtacccgcgggactgacactggcccaccggctcggcccggacgccacgcccgcgcgccggttcgccgcgacggccgtggacgacggcgcgttccaacgcctgttcgaggcgtacaaacccgactccgacgcgccggaccatctcctccaccggcagacgcggtacgcgttcgcccaagccgccgaaacgctcaactggcggggcatggccgacgccatggccacgcttccccgcgtcacgtccctgtcgccgtccgccacgctctacgactgggccatggatgtgatgtcggccgcatgcgacggcacggcgatgccggaacggccgcacggcttggacgccgaacgcgcacgcgccgagaggcggtcgaaggccatcatgccgaccacattcgcggcgctctgcgaacgcgagcggttggcggcgttcgcggacgtgtgccgccagtggcgggttctaggccaagtcgtcgaggctccggcggatggacgccaccaccgggtcggacaatgcggtgccgacgcccggcacgcttcgcaacgatccgatcctggcgagccgcatgcgcgcgtcggccgtctccacggcggacaacggcctgtggaatccgcgctcccattgtccggcgaacatgtccggatcggcgccgtcgtacaggacgccgccgtcgcggtcgatcacggtgagcctgtcgaccagcagcgacgcggcgacggcgcggaccgtggcgggcaggttcgccaccgcgttgtcatgcgcctccgcgggcgtccaacgcgccggcaatccgaccgaacggtcccggtagtagcgttccagcatcgccagccgcgacaggaccggcggcacggccagcgcggccccatacgcgagacgtccagcgtccagcatgaattgaacgggaacgtggaacggagccaaacgccctcctgcgtgcgaagccagtcgacgggaccggcctcgcggtagaagcccgggttggaagagatatacggtctggttggttttctttcgatgccgtcgtccatgccggcctccatgcgttccagaagactttcccgtcgatggcgcccggtcccgcgacgcatagccacatggcatgacagattcgaggaaaccatccacggccggccccaaggagaaaccctacgtgcccatcgagcaccgcccgctattgggcgtgtccgaagcggccgccctgaccggactggggacgagaagatcgtccgccaggccatacgccaaggcgagctcatcgcctgctacgcccattcgtcgaccaaacgcatccgccggcgtgacctcgacgactggatctcatccctgcccgaacggccccaatagacgggcccgacggatacgacacggcccccgcatggctccttcgagtcgtgcgggggtcgtgtcttttccggacgtaagtacaccttaagtacacctagtacctatactgaaccctgaaacgtagtcggcagtagggctcaggggttccgactatcagatgtggaagtacagctcgtactccagcggggtcggggccagacgagcctggtcgatctcgccgcgcttgatgctgatccaggtgtcaatcaggtcgtcggtgaagacgtcgcctgcggtgaggaagtcgtgatcttcctcaagggcgtccatggcctcagccagggagctcggaacctgcttgatgccagcgtgctcttccggcggcagctcgtacaggtccttgtcgaccggtgccggaggttcgatgtggttcaggatgccgtccaggcctgccatcagctgtgcggagaaggcgaggaacgggttgcaggacggatccggagcgcggaactcgatacgcttcgcagccggggaggtgccggccagcggaatacggatggcggcggagcggttacgagcggagtacaccaggttgaccggagcctcgaagcccgggaccagacggtggtaggagttcagagacgggttggtgaaggcgagcacagaggaagagtgcttgatcaggccgccgatgtaccagcgggcgaggtcggacagaccgccgtagttcttctcatcgtagaacagcggcttgccgtccttccacagggactggtggcagtgcatgccggtaccgttgtcgcctgcgatcggcttcggcatgaaggtggcggccttgccagcgagggcagcggtctcgtggacgacgtacttgtacttcatcaggtcatcgcctgcgtgctgcagggagttgaagcggtagttgatctcctgctggccagcgcctgccacctcgtggtgggaacgctcgagaatcaggccgaccttctgcaggttggcgaccatgtcgtcgcgcaggtcctgggtgtggtcaatcggcggaaccgggaagtagcccttcttgacgcggttcttgaaggcgatgttcggggtgccgtcatcttcggtgtcaatgccggagttccacggagcctcgatggagtccacctcgtagaaggagcgctgcatgctgttctcgaaacgtaccttgtcgaagatgaagaactcggcttccggagcgaaggaagcggtatcggcgatgccggtggacttcaggtaagcctcggccttgccggcaacctgacgcgggtcgcgggagtacggctcgtcggtcagcgggtcgacgatggagaatgccacgtcgagggtcttgtgcttgcggaacggatcgatgaatgcggtggaaacgtccggcaccagcttcatatcggactcgttgatggcctggaagccttccacggaggagccatcgaacggcatgccgtcggtgaaggcgtccttcaggaattcgcttgccggcacggtgaagtgctgctgaacaccgatcagatcggtgaagcgaacggagacatactcaatgccttccttgttgataagggcctcagcatcagccttggtttcaagtgcagtcacgggaccgctcctttcgaataagttacttacaggctattagtctatggtcgcgagtttcgctcactcgccatttgggttacgagaatgtttcgtaatgacatattcgaggtgtgatttcgcggaaaatcacgattcgattgttacgaacagccacgtccgccccttcagaagcgttcatttaatggacaggcagcatgaaaaaggtcccgatcgtatgaatacgttcggaaccttccgtgacatcatgcgggtgctatgaccgtcagcggccgcgcatggcgcgacggctgacgcgctgcggatgcatcgggtcgacgcccttcggcacgctcatgccgttcttcagctgcagagtgcgcagacgctcgttgagcaccgtgagctcggtcttggtgagcacgaaacgagtcctcggatggatggcggccatcagcttgttcttgtgatgggtcggctggtagctcttgaacttgagcagcgtcttgcgcacgtccttgaggcgggtctggtttgcgccggtgccgacgtacatacggtagaccgggatttcggagccggcggtcacgcccttgatgcgctgctcctgacgatccatggctcgcttgacgcgattgtaatcgccttcgcccagcagatagatgccgttgtaaccggtaccgcgccagatggcgtccttggtcttcgggtcaatccacaccggttcctgggggaagttgaagccggccttgctgatgttgccgagcacgcttactgcggcaccgggacgaccttcgatcttggcgtagccgaccttgtcggcacgcttggtgagcatcatggtggcgaacagcacgcccagcatgacggcaagaatcatgaacaggatccagctgaacacatgccacttgaatatgacgcccagtacgacgaacacgacaatcggtgccacgaacacgccaccgcacagccacggaagcgccttatcctcagcttgggtgtatttgaagatctggatgatctggctgatggtgccttgcttcttctgcttctttttctctgctttatctgccatcgacttcctcgcttgacggttcggttacacacactgggacgatagtttatcaggaaccatgccatttatggtgcgactgcgctattctactccgcctatctcgtatgcagcgggcgtccgtccgctttcagcaacgcctcaccgagcgtctcgctgaacgtgggatgcgggtggatgagccgtgccgcatcggcaagcgggacacggttgccgaccaactgttcggcttccgctatcaaatcactggcgattgggctgacgatgtgcacgcccaacaccacctgcatatcaggattgttcgcaaacgcaccgctgacgacggtcatcgatccgccttccccgctcatcagcatgcgcgcgttggacagcatcgggtatgccgtctccttcggctcgaccacgtcttcgcgcgcttttgcctggtcgagcgtcaatccgacgcttgctgcttcggggaaagagaacaccacctgtggcacggtgtcgtcaagcacgggttttggatcggctccggcgattttctcagcgatggtgatgccttgttcaaaggcgcggtgggccagcgcatgacctggagtgatgtctcccagcgcccacacgccatcaaggttcgtccgtccgtatccgtcgacggtcacgtatcctcgttcgtcgagcttcaggccgctggagcggaaccagtcggcgtcggtattgggcacacgtccgatggcggcaagcaccacttcgccgtaagcggtgcggtcctcatcggaatcgccctgccgatagtgcacagtggcccctaggttcgcgccagtgtcgacacggtccaccgcggtgcgtgcgatcacgttcactcccctgcgtttcagctcacgtgtcagcgtcatcgaagcacggcgttcccatgtggacagcacgcggtccttacgaatcagcagtgtcacttcgcaaccggcggcattccacagcgacgcgaattccaatgccaccgcacccgcaccgataatcaccgcgctggagggcaaggtattcagctccaacgcctgggtggaatcgatcagcgcgccggcgaacggatttccaggcaacgcaagcggacgcgatccggttgccaacacgacgtcgtcggcatcaatcgcaagttccgtttcaaccggttcgaacacgccggcttccacggaccgcgatacctgcgtctccccctcagccggcgtgacacgtactgtatgcgcgttctgcaatgccgcgcaaccgcggaatacggtgacgccgcgatgcgccagcaggcccgtcagccctttcgtcatcgtttccacggtggagacgcggaaatcacgtaatctgccgaaatcgatgctctgcagcgtggcgttgatgcccatgcgttcggcgttatggatggtttcgacgctatgcacggcagtcaacaatgccttcgatgggatgcatccgcggttgaggcatgtgccaccgagcgtaccgtcacgttcgatcaacgccaccgatttgccgagttccgcggcacgcagtgccgtagagtaaccgccggggccggctccgatgatagcgatgtcgaaatgctgttgaaccatattgaatcccaattcgttcctcattgattcgtttgcacgcacgtgaagtgagcttttgttcgatgcgagcaatcgttttccatggtaatggaaaagccgtcagttgttcgctgacggcttgaaaaatcaccggcggttctcgataccgatcactccggccagtgtccacgcttcgggtaacgaggcttcggaagcctccaacggcgaatctggagggcacggctccacgcataggaaccggaacgcatgcccttggccacggactgctcaccgaatttctcgatgagcttcttcttgagcttgtgccacatgaccgccacgtcgataatcacggcgaacaagtagacatacatgatcagcatgagcggcaacgccaatgcaggccacttgtaggtgacgaccatggatccgatcaggattatgaacgcgaccgggatgaagaactcgcccagattgaagcgggcatcgacgtagtcacggatgtagatgcgccacggcagacgttccgacttcggcatgtggttgatgtcgcctctctgcatggcatcgtactcggcgttctcacgctcacgcatacgagccttggcggctttacggcttgcctcgcgatccttggggaccagcggacggagattctgcgcctgggcgtccttgcgcttcggggttggacggcccttgccggaggtcggctgtgcagccttgctctcgacgttctcctgcgccggttcttccttcttggtaaacaaactcatgcctatagagcgtaaggtgacgtatcgacgctcgatgccgcccgcggtgccgtctgcgttgcggttcaagctgcgattcaagctgcggtcggacggtctgcaaagaacagatacaatggacattcgtcacacgatattcaatccgcgtaatacacacgcatatatagggagcatcaaggattatgacagctttaggagccgaagagatccgcacgcgcgtcgagtcggatttcaaccgcatcgtcgacgtgttgaaccagaagatcgccttgcagtcgatttccgcgaaaggcatcaccgccgatcatatgaagcgttccgcgcaattcgtggcggacctgctgcgcgaggtcggcgtcgatacgaaggtggtgcagtcgcacaaccctgacggcacgccgggcgcttgggaggtcatcggttccaaaaacgtcagcgaggatgcgccgacggtgctgctgtacgcgcaccatgacgtgcagccggtgccggatccgagcgtatggaacaccgacccgttcgtcggcactgaaatcgacacgcgtctgtacggccgcggagccgcggacgacggcggtggaatcgccattcattccggtgcgctgaaagcgcttgaagacgatctgaaggtgaacatcaaggtgttcatcgaaggtgaggaggagatgggttctccgagcttcattccgttcatcgaagagcaccgggacgagttcgcttccgatgtgatcattgtggccgattcgggcaactggtccgctgagattccgtcgctgaccacgtcgctgcgtggcaacaccgatattgatgtgcatgtcaaggcgttggaacatccggtgcattccggccagtatggcggcccgattcttgacgcgaacacgctggctgcgatgttgatttcctccatgtacgacgccaatggcgatttggccgtgccgggcgttgcgtccgaggaaccggttggcggcctgcagcgtgatatggacgaggcgactgtgcgtgccgacgcgggcatcgtcgaatcgtatcgtcttgccggcaccggttcgctcgccgcgcgtctgtggacgaagcccagcgtcaccgtcatcgggttcgacgcgcatccggtggaaggatccttcaacgtcatctctcctgaaaccacgttccgtctgagcttgcgcaccgcgccgaaccagcgcccggaagaggcccaggaggcgttggccaagttcatggtggagcatgcgccgttcggtgccgaagtgtgggtcgacaagctcgacaacggcatgggctgggccatggatccgaacgctgaggccaccaaggacgccatggacgccatggaggaagcgttcggtgtggctccggtcaacaagggcgagggtggctccatcccgttcattccggaattgcagcgcatcttcccgaaggcgcaggtgctggtcaccggtccggaggatccgaaggccaacgcgcatagcccgaacgagtccatcagtctgccggcgttgaagaacaacgtcatcaccgaagcgttgctgctggataagctcgccaagtaagaagccgtgtaaggcttgccgaaataggataaagctctctgtcatacgattccgattggaacgtatgacagagagctttttcatttagctgccgattggggaatcatcatccattagttggacacgttgctgaacgcccaatgccagtagccggtgtagtatgcggtggccaacgcgattgccggcaccgcgatgcagatggcgtagaacagccagtcgaccgcatgcagtttcgattcacgcgcttggcttcgtggcgcgtcggatccgaatccgcgcgcttccatggcggtggcgagtttcgttccacgtcggatggatacgacgagcaggctgaatgcttgcgagaagacgcgtttgatggtgctgccgtcgccgaggccacgcgagcggcgtgactggccgagtgcacgccaatcgtcctgcagcagcgtgaacatgcgcatgccggcaaggccgccgtatacgaaacgttgcggcaggcgcagaatctgcacgagtccgtcggccagatcggtcgggtcgagtcccaaagccagaatcacacccggcacggcgattgcggcgacacgtaggaatgtggccaacgccagatagagcgatccttgggagatgacgatgatgccgcccagattggccagcaccgtgccggatgtcttgccgtacaacgccacggaaacgaagctgcctgtggccgctatccataccggccatgtcttgcgcaagaccgtccagggagccactccgccgatccataacaatagcatttccaaaccaaacgccacggatgccgaaacgacatcgagggtgaagaacatcggaatgcacaggatcaacgcaccgatgaaacggcttaccgggttgattttcgccacgaaccatgacggtgacgccggcttcgtttcgttacgacgttccttgtgtggcaccacggtaatggtttcgagcttttcattgccgtcgcgcccactgtttttgttggtttcgagcatgtcactccccctctctgaccaaaatacggcgtgcgcccagcgcttcgatgagcggctcatcgtgcgtaatcatgatgaccgcgcaaccttggtcgcgcgcaccggcgatcaattggaccatgctggtccacgtggtgaaatcctgtccgaatgtcggctcgtccatgaccagcacttttggcgcggcagccagcatggacgccacggacagtcttcttttctcaccgcccgatagggtgaatggattcgctttggcgaagcgggaaagattcaggcgttccaacagcctgtcggcgatggaatacgcctcctcgtcggttttgcccatggatttggggccgatggctacctcgtctcgcacggtggatgcggcgaactggtgttccggctcttggaacaccatgccgatacgtcccagcaagtcgcggcttttccatgtgatcacattgttttcgcgatggggaggtaccagatcgtccgccatgcatacacgtcctgctatcggtttgagcagtcctgcgagagtgagtccgaatgtggatttgcccacgccgtttctgccggtcaacgcggtcacctcaccggaatggaattcgaggtcgatatgctcgccgagcgggaaatcatagccgaagctcagatcccgcgtgtaaagcacgacgtcctgcggttgccggatttgttccggtttgggcgcgtggctttcgatggtgcggcccggcacccacgcaccgccgtcggcaagcacctgacccatgtggccgaacacttcgtctggagtgccgtcggcgattacgccgccgacgttcgaatcgacttcgggcttgcccagcacgatgacgcggtcgaccaggtcgagccacacgtcgatatgatgttccaccacaaccagcgtctcatgggtttgttcgaggacgtggcggacagcgtcgtgcacttccttgacaccgtccgggtcaaggttggcggtcggttcgtcaagcagcagcaggccagggtgcatggccagcacgcccgccaaggcgaggcgctgacgttgcccgccggaaagtcctcgtgtggagcggtcgaacgccatgtagtcgagcccgacgatgtcaagggcggctcgtgcccggttccagatttcatctttcggcaggttcaggttctcacagccgaatgcggtgtcgtctccggcacgttcgagaatcgtctgcgagtccgggtcctgaagcaccagcccgcaacgtccgcgcgcttgtctggcgtcgacgccgtcgatgagcagctcgccttcctgctcgccttcgtcatctccaccgagcacgccggccaaaccggacatcagggttgatttgcctgcgccggaagcgccaagcaacagtacccgctcccccggtttgatgtcgaagtcgacgtgtcgtagcgcgaaatccttacgtgaggcgtgtctccatccccaatcatgtgcggtcacgccggccgctgttgtgttctgaacgtcagtggtcattcgtcgttctttcttctgattgtcatgctgttgtttcgtatgccgttgtcatgcgatgcgccatcacaagaaaatcccgcaccaccttgatgtgatgcgggatttgcttgcatcggacaatcagaccagttcctgcgtacgaccggattcgaagcggtcgagcacgccggtcttggcgatggccacctgcaggaggtacatcaccgcgccggcgagcaccgcgccggaaatggcggaggcgatcaggtagatgctgacgcgtagcgcgctccaagccggattggtaagccagtagtacaggccgcagccgacgcctgcaagtgcgccggagatcgtggtggacagcaggtcccacttcttataggcgaagagggcaagaccgatttcggcgccgaggccctgcacgatgccgacgatcagcgagccgccgacaccccactggttgcccatggtgagttcgagcgcggccgcgagggtttccgcgaacagtgcggctccaggcttgcgcacgatgatggcggccagagggcctgcgaacagccagaaagcgttaagcaggccttcgaagcctggagtcaccgcctcgaagagggccagcggcgcggtgcagacgatgtcccagccccagaaaatcacgccggatgcgacggcgatgatggctgcgacgacgatatcgaccacgcgccacttgttgttgtgtttgcgaactgcggaagactggttttcttcagtcatgggatatgtgcctttctcttttcgtcaaggcacgggaaatagagagacgtccgtgcgccggcattacccggtatacgttcatacggttgaagcggttgcttcctctcagccattcggcccccgtgtctgcgcctgatattacacaggacccacgatttacgtcagttttgtctcataacggattccgtattccgtggctgagtcgcattccgatgtgttgttttggaggaacgctccaaccgtatggtgattttattgaggcagtctcatcagcgattcggcaagattcttgaatgtttctccgataccgtccgaccgcaacgcgccctctttggttaggactgcgggccggcctgcttcgccggtttcgcgcagttcaggctccaatgggagttgtgcgagcagtggcacttcatagccgaggctgtgggtcagctgttcggatacgcgtgcgccgccaccttcgccgaagatacgtagcttctcgcctttgtgctcgtagtagctcatgttctccacgacgccgcgaactttcatcggcacctgcaatgccaccaggccggatcgtaccgcgatgtcggaggcggatggctgcggtgtggtgaccaccaccagttcggcgttcggcagtgcctgtgccacggaaatcgccatgtcgccggtgccgggcgccaggtcgagcagcaatacgtccggctcgccccaccatacgtcggataggaattgttccaaggagcgttgcagtcttggaccacgccataggatggctctgtccgcgccggcgaacatgccgatggagatcagtttcacaccccatgcggtgacgggcatgagcatgccgttgaggttcgtgggctgtgattgcacgccgaatagcctgggcagcgagaaaccgtagatgtcggcgtcgatggcggcggtatcgtagccgagcgccgcgaatgtggctgccagattggcggtgacagacgatttgcccacgccgcctttgccggaggcgatggcgaagatgcgggttctgatgccgggtttgttgaacgggttctgtttacgttccgctttgaggccggccaccagctgggtgagtttgtcttggctcatggagccgacttcgatgctgggaatcaacgtggcatcgggataggaggcgaccgcgccgttgatctggttggtgatggtctgcgacagcggacagccttccacggtcagttcgacccgcacccgtacgtcgtacgtgttggtttcgcctgccactggcgtggcgtcaatggctgcgatcatgcccaagtcggtgacggacctgcccagttcggggtcaatcactttgcttagccgttcgtagatgcgcgcttcgatggtgcgctcgtcgctcatgcttcctccttatgccgcgtaccacggtagcggttcgcggcacggctcgccagatggtgtggcgattattcaactgttcctgtgtcgagcagctgtttgaattggtcttcgttgagcatggggatgcccagttcctcggcttttgcggcttttgagccggcattctcgcctacgacgacccaatcggttttcttgctgacagatcctgcggctttgcctccgcgcagaacgatggcctctttggcggaatcgcgggagaatccttccaacgagccggtgaccacgaccgttttgcctgccaatgtctgtggtagtccgctggcttgggcttgtccgactcctacgccggcggccttccatgcgtcaagcacggcaccgcgccaattgcccggctcacgggccgcggtgaaccatgtgactacggattccgcaatttccgaaccaataccgtcgatttgggacaattcgtccacgctggcatgttcgatggcatccaacgtaccgaacgcgctggcgatggtgcgtgcggtgggcggtccgagcctgcggatggacagggccaccagaacgcgccacaggtcggcatggcgggctttgtccatttcgtcgagcatcttgcgggtgttttccgccggacgaatgtacaccggctgcacgctggacgtgcctccacgggataccttgatttcctcgcggatcaccacggcgtcatccggcaccacgtattgcggatattccgcggtctcgtcgatgtcggcttccttgcgtttgcgggcggcggtaggcgcggtccagaatgcgggcacctgatgccataatccggatccgcccacacgtttgcgcactttcttgatcttgccgtttgacccgacggtctcgtggatttcgatgattggagcctcgcgccagacgcgcacatccttgaggtctgcggacgtcaacgagaacagcccggcctcgctggacagcacaggtgtctgcatgggcggcagttccagtcccgccaccggctcgtacggttcaggctcctcaccgggtttcaccacgatttcggtgatgttcggcgcatacgtgtcgatggaatcgggcctgtcctcttcgggattcgtcagcgcaatggctgattggtcgcccagatgttcgatatcgaacgccttgcgggacgccagattgatgatccgctcggtcagctgcgccgggcaggattccacgttcgggcagcgtatatctttgtctccctctttggcgggagcgagttccgcgccgcagctcgggcaacgcgtgggcatcacgaaccggcggagctcgccctcgcgtcccttgcgtcgctccagcaccggaccgacgagctcgggaatcacgtctcccgccttgcgcaccaccacggtgtcgccgatgagcacgcctttgcgttccacttcaaaggggttgtgcagcgtggtacgggatactgtggaaccggccacgtacacgggtttcaacaccgccaccggagtcacacgtccggtgcgccccacctgcacagtgatgtcaagcagctcggtattgacttcttccggtggatatttgtaggcgatggcccagcgcggcgcacgcgatgtggcgccaagggaacgctgcaatcccaaatcgtcgaccttcacgacgatgccgtcaagcgcgtgttcgatgtcgcctcggtgttcgccgtaatagtcgatcatgtcgaggatttccttgaacgacgtgacctcacggttgtgcggagagacgggcacaccccatttcttatacaattcgtaggcttcggattggtcgttgaccacatcatggccgttgccggcgtgccccgcaccccaacgcagcgatccgatgccgtgcgcgtagaagctcaggcgacgggttgcggtgatacgcggatccttctgtctcaggctacctgcggccgcgttgcggggattggcgaatggcgcgcgaccggcgtcctcgttctcggcgttcagcttgttgaaatcgtcccatcgcatgaacacttcgccgcggatctccacgaattcgggaatgtcttcctccggtccggcaaggttctgcggaatggtggagatggtgcgcacgttgagagtgatgtcctcgccggtcacgccatcgcctctggtcagaccctgttcaagcacgccgttgcggtagatgaggttcagcgcaagaccgtcgattttcacctcgcaggtcatgggcagtggcttcgattcgggccaatccaatcccctgagcacgccgtcgtaccattcgcgcagctcctcgatggagaacacgtcatcgaggctcatcatgcgcgatggatgacgtacggaagcgaagtcgttggagaacgtgccgcccacgcgatgggtcggtgactgcggtgagtcaagtgatgggaactgcgcctcaagcgattgcaggcagcgcaatcttgcgtcatatgccgcgtcggatgagacgggggcatcgtcgatatagtatgcgatctggtctgattccacccatgcggccacgcgcgcccacagcctggccgcggcttcggcgctcatcgaagccacatcaaccttgtcgaggcgcatggcgtcggcatcggtcggctgcaacgcggcaatccaacgttcgctgcccggagtcagcgaagccagcccctcatcggccacgacggccgcggaactaccgtcgctctccggcgcgtcgaaatcccatgccaactgttcggaatcatcacgattcgtcattgtcaccgctttcccatcatttccgccatgccgcgcggatgtccacgccagcaccgattatcgcacaaatgttcgaccgttttgttagttgttcagagagcgcaggaactgcacctgcaccacgtcggcaccgtcatggtcttcgtaatccatgcgcatcgcggccaccgacagggtgcgtgcgggcacgaacatgcctttgtccacgcagacgcgggccgcttggtgcatcaggggcgcgaccggcgtgttcggccataccggcagtccggcgtcggcgagcacgtggatggcttcctgcacgttggtcggcaccggaatgcactgcgattgcgctcttccgatcagttcctgcagttcgctttcgagcatggcgatacgtccgggggcaatctcctcgctcatgatgtatgaggcggcggcaaggtcgaagtggtcgcacatccattccgcataggcgaggcgatagtaggcgaatgaggcgtcttcccggtcaagcgcgacgttcagcgcgttgaggcatgccgcacgtgccggatcccagtcctcggcacgccccagctgcacggcgagcttgaggtgcgacagcgggtatgcgggggcgtaacgcaccatggcgttcagatgcggcagcgcggcatcgacgcctttgacttgggcgagcaggtcggcaagctccatatgcatgtagaacaggttgtcgggaatgagcaccgttctttcgccttcggtggcgaacatgcggttgtagatgacgcgttccgcatatgaattgaagtaccgcggcacgcccggattttcagcgaagatccggtccatgcgttcgagtgtggactgggcggattcgatggcccgctcgacgtctccggagaacagcatgtctcgtgccttcagacgttcgtcatcgagggattgtgccagttcgaatgagaagtcgggcgtgtcttcgccgtcgatcagcgcgctggtgacctgcggtgccaattcggtcaattccggatcggatatggaattgatgatgtccatggcctgtttggctttggccaccgattcgagtccgtcgctttgcgcaagacgatggaactcccccacggcgcgctgcaacaggtcgacacgctggatagacaggcccatcatgttctcacagccgaacaactgcgccgtgccgtcatcaaaacgaatgtcggacagttcgggttcttcttggcttcccgccggtgagaatcggctgtcacgaaggtcgaaggccgcatcgatgggtttgagcgcgcctttgccgtccacgtccatttcggcgtcgaacatgcggtatgtggcggttggatgggccaatccgtcagtgtcgagccgcttcaggaactcgtcgcgggcgaaggtgacggtcaccaagttgcgtacggtcgggtttttgcgcagctgcgccatcggatcgtcgtcatcatcatcgaggtaggtgtcgtactccgttttgtcgctggcgtcgtcccgcatggaggcgtcgtcatcatcggcgcggccgtccggtaccgcgaacgccatttcgtcgaagtcgatgtctttcatcaggtcttcgaactggccgtccaccgtatcgtctccagtgccaacgctatccgagccagccgaatcgtcggaatcgattgattcggatgagatatcggtggttctcggagtgacgggccgagccggatcgccatggtagtcgccgtcctttggagcggctttggatccggatggcctcatgtctccggtacggatgcgttcgaaggcgcttaacgcctcgctcatcaactcgctgatggcggaatcctgttcggctacggcctcttccagaccaatcgaatcgatgtgcatcgacacgcgtttgacattcggatcggctccgaagctcagcgcggccatcatgagtccgacgcgcagattgtaatcgacgctcatacgcgtgcgttcgacgtcggtcaggtcgatccacgcgcggcgcgatacgtcgtatcgggtgaacggcatcatggacactccagcagaagtgaagccgattgcgacttcgccgtcgctgaggtcgcaccggaagtcaacgtcgaaacggtatggcagacgcaggctgcgcagcagacgggacatggtctgccggtacacccattcggaacctccgtcggcgccgaaatcgccttccaacacgttgtccttggttgattcggcgacttcacgccggaagtcggccgcgatatccgccagtcggctggcggcctggatgccgtcttcccggttcgggtcgaggatcgcgccgaaccggtcgtccggtttcaacgcgatcagcgccggattctccagcagggcgaagtcgatctgcgcggcttcggcacgcgtcaccgtgtcctccgtggggagagcgccgatgcgtgcgttacgttccagccatgagctgacggcggcgaagcggttgaggttgccctcgatgttgagggcgcacagcactgccgagaacggcagggaggaatcccatgcgaagaagtagcatccggaatagctggatgtgtacaggcgcagcggttccgctccgtgcacagcttcgagcccttgatcagtatcgagcacgtgggcttcgcgcatcagatcggcgaagtagtcttccaggccggaggcgcgcatgccatgcgaccgggcgctcatggtgtctctgatggaccgtcggatggcgcctatgggcgcttcgcggttgagcctgcggaaaatgttgccggaaccgaagccgacgagcaggccgttcatctgtggaagcatgtaggcggcgaagaaggcgatggtgatggcgtcccggtattcgaggtcgaaccgcatattcgctggcaggatggcgcgcatttgctcaagcgtgtatcggttgccggttttgagccatgaggcgagccacatcatgcgaccgcccggcatgcgtcccacgacgccgccttgcgtggcgcgcaccgttttcggattgcggctggccgcatggccgagtcttagaccgtccgccaacgtaagggtttcctctttgacgaagacgaaccgcggttcgagttcctgcgtgtccatgtccggatcggtgccggcgaagacacgcgctttgccgtccgcgagcgcgatttgggcgaagtggtcgctgtcggtgaacaatccgatggagaaggcatggccgtgggtctgcggcagttgggcccatccgaggcggaatcctccgggcacgccttcgaatccgtcgatgacgtgtcgtttgatgagcggattaagccggatggcgttgcgggtcagttcgtcgacgatgtcgtcgggcttgtcaagcgccttgccgaaggggttggcgtggatatggcgcggcgtggcctggttgacgagtcgccgcacattttgcctgacgcgttcgagcatggtccggttatgttccggttggctggccgggtctgatggtgtgcggtgagacatgtgtgccattctttcaatccaacgcgacatgaagctattagaataatgacgtgactttttcgaagcagcgttttcaggcacgtcgtcgtatgtgcgcagccattgtagtcgctttcgcggtgatggtggtggtcgagtgcgtgttgtgtaatatgccgttttggcgttccttggccgcatcaggtgattccgccgccgcgtacaacgtgatgggccctgggctcgaacgtactgacgaggggttgttgaaggtcaccgatccgacgcaggcatatatgcaggtcgatgcggatggctcgtcggaatatgttcgtatggatccggtgtcttcgaaggcgttggataaggcagccagacaatcggagcaggtgttgcgcacggttcgtgtccgtcctgatgtcaatcgcagggccggtacggtcagttcggtgtcggtgtcttcgccacgttcgctgtatgtgcatgcggcggctgcaggtggttcggtgtgcgtgcggattgtcgagccgaagggttcgctgattccgtttgatgcggtgcgtgcgaatgtgcgtgtaccgttcgcgttgaatccgttgcgtatcggcgtgatggtggccgtgttggcgatggtactggtgtggaggcctggttcgcggttgtggcggatgccgttggatacgacgagtgtgaggcagcgtgcgtggctgggggcgctgctggcggtgcctgttgtggtcacttgtgccgttgtggtgtggcagctggtggaggcggctccgttgagcttccatacgaaaggcacgtacacgtatgatttcgaccagtacgattacgtggcaagggcgctgcttgatggtcacgcgtggttggatttggatgtgccggatgcgttgcgtgacgcggcggatccgtatgatgtggccacccggcagcggttgcttgccgatggcgtaagcccagtgtattgggattacgcgctctatcaggggcactggtattcgtatttcggtgtggttcccgcgttgttgttgttcctgccgtatcgggcggtcacatcgttgttcgtcgatggcgggctgatgatgccctgcggcgcggccgtgccgctgctgatgcttggttttctggtattcggatgtctgctggtgattcgtgtgatatcccgaattcgtccgaatgcgccgttggctgcggtcagtatgctgtgcgtgttcatgctgttggcttccaatggtttgtatctgtggtatcggacgaatttctattcggtgccgatcgccgcctccctgtttctgagcgtgttgggattgtggctgtggttgggcgccgccaagcaggtgccggtgtcaggcgatcggattcgtgaggttgatggcacgcagtcgttgtcgttgccccatctggctgcaggctcgatgtgcattgcggccaatctggggtgccgtccgcagttcattctcgtggcgttgctggctttcgtaatattctggccgcagattcagtcgattttccgtcacgcccccaatgattcctcccttccccatatgtcggtctggcgtctgatgcgcgcgccgttggccgcattgcttcccgcgttgattgtgatcgttcctctgctggcgtacaacgtggtccggttcggatcaccgctcgacttcggcacctcatatcagatgacggtcacggatatgaccagttatcggcagccattgtcgaatcttgcgctgaccgtcgcatattacctgttcctgccgttgcggttcacggatgcgtttccgttcctcgccgtcaatccggcgcctcttcccacttggggatttaccgaggcaatgcctggcggcttattcacgatagctccgttgacgttggccgcgctggcctgcccgttcctctaccggcgtatgcgcaaggccgggcgcacgaacacatggctgttgttgacatccagcctggcattgggattgctgcttgtggtgattgactcccgcatggctggtttgggatggcggtacatcgccgatttcggatggctgtttgccttggccgcgttgccttcgttgctgatcgtacttgattgcggcaagccgcgtctgcgttgggtatgtcgtgccggattcctcgcactgctgctgttcacgctggttgtcgcgctgatgtcgttgttcctgcccgggcgtgacgatgagatgttgcgtaacaatcccgccctctatctcgacgtgcagtcctggttcatgttgggttgacgtccgacataagctacatccagtaaaaaatcaggtttctttcctgattcatatagcagtttttccggtttgctctgagtttcatcggcaatcataacgattgtcatcattgttgctttgaattatgttccgggggtcgccaaccatgaaaccgctttcgccgccacgcaaccatcctcgggccgcacgttggatgccaaaggcgacatcgtgctgctcaccaccgaactgggccgcgacgacaacgccgtgcaggaccaggtcgtcaaactcgatgccgaaaccagcagtgtgatgcgactgttggatttcggcagcctgttcgccgattacaaggcgtccgccacgcatgcgggcacggacgattcggatgaactgccggtgaacctgcgcgcggttgcgcctgcggttcgttacaatcgacggtatgggtttcttcgatttgctgttcgccggtaaacgttccacaccggcttcgtccgtcacgttccatctcgaccaggccgcccacatgtacgaggacggcaatatcggtttggaagccaccacgcttgatatcacacctgacagcaagcgtgtggcggtgataggtttgaacggtgccggcaagaccacgctgctcaaattgttggatggcgcgttggccgccacgtccggaacggtccgcatcgaagcggacggtaccgcatacgaccccgccgtgaaacgcgatctgaagcatgtcgaggatctggtcggccgcgtgcggcgcgaagagattccgaacgcctactacaaggcggcttcgattcgtgaggcgatcgacctgccgttgaagaagcacaaggtgccggaaagcgaacgtcaggcgatcatcggcaatctgttcgcgcatttcgacttggcttccgtggcccgcgagccggcctccgctttggatagcgagaagcggcatctgctggcgatcgcggccgcgttgagcttctcccccgctgcgatcgtcgccgacgagccgaccaagggcttggacgaggtggcatcggcacgcgtggcgaaggccctgttcagctatgacaagcaggtggtgttcgccacgcatgacacggatctgatcgtccgtccggaatatgcgatcgaccgcgtgctcgttgtcgacgaccatcgtgtggtgttcgacggcgtgcctcgtgaggcggtcgatttttacacggatttggttcgttcgaagtatgaggcggcgaagggcgacagggcgtagaagagatttcggactcggcagtccgttcagccgatcagttcgttgacggtgtcgatcaccacgtacacgttatgccggaaatcgtccggttcgggcagtagtgagatggccagatagccgttggaggtcatgtcgaagaagtagccgggctgtccggatacgccgtggcgttcgatcatgtgcagcaccagctcgttctcgtcgagcacgctgggcacgcgcagcagtacgttccatccgccttcggcacgcaatacgctgacgagaccttgctcgtccgcgtcgagcatggcatgcagtgctttgagattgccgcgcacacgttcctgcacgcgcgcggtctgcaatggcgccgcttcaagcagtgcgggaatttgttttgcgacgatctcgctcatgggcagatagtcgtcggcgatcacgtcgagacgacgcttggcttccgccacgtcttctgccggtccggacacttggatccagccgactttggcatgcggtgcggcgagcattttcgaaaaaccgtccaacgcgaatgtgagcgcgccacgctcccccgcgagtcgtgcattgccttcgaatggttccaaatcgtaatcgtagaacacttcgtcggcgatgatggccacgtcgtggtcccggcacaggcggacgatcgcctcgcgttccgacggtttgacgtacgaaccggtcggattgttggggttgatgagcaccagcgcgcggatgcgattgccgtccgggccttccagcgcggttttcagttcggccacgtcgatgtaccaggagccgtcgaatcgttgttggtattcgatcatgtcgacgcattcgaggcgtgcgatcgattcgatgagcggatagccgggtttcggtgcgagcacggcgtcaccggcatcacacagcagtttgataagccacgagtaggcttcggaagttgaactgaggatgtacaggtcgtccggcgagcaatggccgatttcctgcatgtcaaggaacgcggccagcgcctcacgcgcgtagcgttggccgcgcgggtcggcggagtagatgtccggaacaagatccggagccagcgcgtgccgtgtcggattggagtcgttgagcttgccgagcggtctgccggctgttttggcggtggcttccgccttggcgatgggattgggctcactgatgtcgactcttgaggaaaaacgcatgctctccaccctactccatggactgccgtcttccatctgcggcacatggaacaacgaaaaaggccgtccgacgaatcggacggccttgtgacaacctaatcggtcaacacatcacttctgcttggtgctcgcgtagtatgcggcgccgatgatgccggcctcgttgtgcagcttggctgcgacgatcggggtcttgatgtcgatgtacggcaggaacttctcggagacgcgggacacgccaccgccgacgacgaacagctgcgggtcgaagtagaactccatgagggagtagtacttggtcaggcgcttcgcccacttcttgtagcccatgtcgagcttctcgcggatggaggatgcggcgtacttctccgcgtcgcccttgcccttgagcagttccagatggccgagctcggtgttcggaatgagctcgccgttgaaaatcagcgcggtgccgatgccggtgcccagcgtggtggcgatgacgaggccatcctggcccttcgcggcgccgaactgctgctcggcaagaccggcggcgtcagcgtcgttcaccacggtgaccggacgaccgcaagcttcggagaacacttcggtgacgtccacgccgacccaggactggtccaggttggccatgtagccaagcttttcgcccacatgaatcggagccgggaaggcgatgccgaccggagcggactccggaacctcgaaatgctcgagctgctggcgaacgatttcgccgacggccttcggagtggacacctccggggtgaggatcttcagacgcggttcggcgaactcgcccttctcgaggttaaccggggcggccttaattccggagccaccaatgtcaacgccgaatgcctgtgcagtctcaatcatcttcaacctctctatcaaggtatgttatgggtgtattcgaaccggtacgtgttatggtaactcgcaacatgcccaaaatcgcgcgcgacatgcacaaatggtgagaacgattgcacaaattgtaatacttaaccgagtaaatatttcatcgcctgttttgcaaacgattcgtcccacgtcggtagaggctccgacgtgggacgaatcgtcaatcgcgtgatcgccgcgcgttgggaaacgcgtgggccacggtgttacttcagcggcggcatcggctgccattccggatcatgcagcagcttgcgcgaatcccaccatcccttggcgatctgaacgatgcctgtcttgaaatgctcgcggtccaccatcgtcagtcgaatcacttccttgaccgcggtcagcgccgtacccaggccgaacaacagcggacggtaatcgccgtacgtcatgaagtatcgggccatgtagccgcggttgcgcatgatgtggtagcggttcatgtcggaagtggagttgagctggcgcacgccggcgatgtcccaattgccgatctcgcgcgtacggcgcagcaccacgtcgggcacgacgatcggattggtgaccttgctggcacgatagccgtacatcgtgtcgtcccaatagatgaagaaacgcgggtcgggcagaccgatcttctcgacgatgttgcggcggaacaggccgccttcgaagcacaacgtgtccatcacgcgatagccagccgggccgaacgcagccggtgcgatcgggttcggaatgccgagcgggacgatgaaatcgtactgccagtagaacggaccgccatcatagtcgtagcggcttccctgaatcacgtcgtgccgatcggtccacttggccaagcgctcgatgccttccggcatgacggcgacgtcgtcgtccatgacccagaaccattcggcacccagctcgtacgccttcttcacgcctgcggagaaaccgcccgcgcctccgaggttgtcggtctgcggcgcgtagaccacgcggttctcgttgccggacaggtcggccacggtggtgccccactgcgcggtgagcttggcgctgaattcttcgaccatgccatgggtcttgtcactgtgctcgttgtccacgacgatgatgcgccacggggcgacggtaagcttctcgatggattcgaacagggtggcgagcagctgctggcgcttgtaggtcaccacgacgatagccagcttttcgatgggcttcttcgcaacttgcttttcagtcatacgttccattcttgcaccggccctcaaccacacatcggccatgttcgatatggagccgagcacgggcataatccgcgacaaatatggacagaaccttgcacggcacgaacttgtttgccataatgaaccgcgtatgcaggggaatccgtatgacggattgagatgggcgtggacgtccgaaccctttgaacctgatggttgacaccagcgtagggaggcatggccatatggctgatgtgatttccgtaaccaattccgattccgcgttcgacgcttcgaagggcgtcacgcgaaccaatcttcccccattcgcgcagcggctgcgcaaagccgccgacctcgtatgggaggaaggctacaagcagccgttcatccgcgaactgggcgaaggcactctgccgcgcgagaagttcgcgttctatctgctgcaggatttccgttatcttaacgactacgccagagtgcatgctttgggactggccaaaacagacgatcctgagatcatggcgttcatgctcaacgtgcagaacggcgcgttgaatgtggagtcgaccgtgcaccgcacgtatctggccagctacggcatcaccgacgagcagatgaacaacgtgcgccagtcggcgttcgcccgcgcgtacacgtcgaacatcctttccatcgcctatggcaaggacatcctcgacattctcgtggccgtgctcccctgcgcctgggtgtatgcggattacggatatcgtcttgcccatgaattcgcagacacgctcgatgtgaaccagtacaagagctgggtggacatgtacaagaccgacgagttctggcagggttcggcttggctcatcgagcatatcgaaaaactcgccgccgaggtgagcgaggaacgtaagcaggagctggtcgatatttttgtgaccggcgttgagaacgagtacatgttctggtccagcgcgtacgacatgcagtacacgtggaagcccgaatgggatcaggagagctgattctccggcacgctctcttccgattgtttatttccatatgaagcggcccgccttccgattggtttcggagggcgggccgcttcatataacgttcggatcgctattcgcgcacgagacgaatgtgctccacgtcgtcacgctgggaacgacggtagagcacgaaacggttgccgatgacctgcacgagttccgcgccaagctgttcggcgagaccttcgccggcctccttggcggtcagaccggaaccgtcgagcacggagcatttgatgagctcgcgcttctcgatggtctcgtccgcctgtttgacggcgttttcgctcagatcgttcttgccgacctggatgagcggattgagtttggtggccaggccgcgcagctgcttgacctgctttttggtaagtgccatatgtgttccattcctatctacaaatacccgctcaagcctagcgtgaggacggtatttgcccatccgcccgcaacgcaccggtcataacagcacgcccggcacgaccagtgcgacgagatagacgagcaccacgatcgccacggtcacgtccatgccggtgacgcgcatgacacgccaatgcgtgcgcgtcacaccttcctcatagcagcgcgcgtccaaggcgaggctcaggttgtcggcgtggcggatggctgcggcgaagaccggcacgacgaccgccaccatcgctttgatgcgtactacgaacgaacctgtttcgacgctgccaccgcgtgccgactgcgcgtcgatgatcgctttcgtttccatgccaagcgtcggcaggaaacgcagggcgaggctcatcaccaatgccgtctcctgcgtgtgcaggccgaatctggcgaacggtgacagcaatgattcgaacgcgtcggtcatggcggtcggtgtggtggaggcaaggaacatcgctccgatgacgatgaccacggcgaaccgacatgcgtagagtatggcgatgcggatgccgtcatcggtgatgggaatcggcccgaggctcgccaccgtggtgccggtgcgtacgaagaagatgttcagcaggccgcagaaaacgaacaatgccaggaacacacgcacggaagcggccaatcggcctacattgatgcgtccggccgcggcgatcacgccggcgaacaccacggcaagcagcaattgccagaatgagccgatggcgaacgcggagaacatgagcgccaatgcggacagcatgcccacgcgcggatcgaggcgttccaacagggtccgccgctcccccacggtcgcggtgtccgagccggcggcgtccacggatggttccgcatccggttccgcttcgcaggtggctttcactgtggattccgtggattccttagagtccgcacgtttcgccggcttgcccaacatgatggtacggtcggcaagctcgtccacttcatcctgcgaatgcgagatgagcagtatggtcacgccgcgtgatttgagctcgtggatgagcccgtgcacgcgtgcggcggcctcctcgtcaagacctgcggtcggctcgtccagaatcaacgctttcggctcgcatgcgatcacgccggcgatcgccaccagtcgctgctggccgcccgacaggtcgaacggcgaacggtctcgcagatgttcgatatgcagcagccgcatggcctgcatggcgcgttccatcgcctcggacgtatccaatcccaggttggaaggcccgtatgcgacgtcttcggccacggtgtcggcgaacagctgccgttccggatgctgcatgacgtagccgaccgtacggcgcagcctcgtacggtttttgcgattgaggggcttcgttccgccgttcgccttcgcagtggccacggcgatgccgtcgatgacgatcgagcctgtcgtgggtttctccaacgcgcacagcatgcgcgccaatgtggttttgccggcgccattgcgtcccatcaacgccactgtctcgcctttgccgatgctgaacgacaggtggttgaacacgtcacgttcggcgtccacgtaacgatacgatatgtcgcgtgcttcgatgagcgtttcggcggactcatcatcaatgcgtttcggcaggcccaccgattgaaccggcatccgaagccgctcgtcggcggggccatcgcctacgatgtggcctgcttccagctgaatcacacggtcggcatgttccaactcgtccgcatggtgcgtgacgagaatgatggtggtgccgcggtcctgcagttcgtccagcacccgcatgatgtcggcgcgcccttgcgggtcgagcatggcggtcggctcgtcgagcacgagcacgtcggaatccatcgccagcatgccggcgatggcgatgcgttgttgttggccgccgctcatgcgcgtcgggttggaagcgcgatagtcgctcatatccacggcgtccagcgaaccggagatgcgcagtccgatctcatcatgttcaatcgcaagattctccggtccgaacgccacgtcgtcttcggtgacggtggtgacgatttggtcttcgggatgctggaacaccgcgccgatgccgcaacgggcggttcgatactcgtcggcgtgcgcaccggactcgtcgaacaccacattgcctgacaatgcgacatatccctcatcgggagccaccagtccggcgatgacacgtgacagcgtggatttgcccgaaccgttcggccccgtcagacagatgcgttcgccacggcggatgtcaagactcataccgtcaagcgcccatgtcgcgccgccatcataggtgaatcgcacatcacgtagcgttatgatcggcgcattggtcgtaaccataaaatcttccttcaccagcactgtatggaattctcggggaaaacaagacggaggaacccccgacggatgcggacggcccctccatgttcatttcaatgggaacaaacgaagctcaacggttcagcaggttggagatcggcttgtagatcaagaacgtgaccacgccgtggatggtgaacttcaacgcgttgaacggcaggagcgccggcactataagcgccacgacctgcgcggtggtcatgtgcgcgtagaacggcgtgacgatgatgttgccgacgatggcgacggcgagcgccacgacagcgccgacgatgatgccgatcagcgcgcccttgcgcgtcttgttctttttgtagatgagcgatgccggcacggacagggccaatgccacgagcacggccatcagggtgccccatgggttggtgaacaggtgcggcacgaagccgagcacgctgacgatgacggctgcggccgggccgaacgcgaagcccgcgacgaggcagacgatgccggatgggtcgtatttgagccattgcacgcctgggatgatcgggaattcgatgaagctgacggccatggacagcgccacgaacagcgcgtacatggcgatgcgtttggtggaccagcggccggagtcggcgacgcctgtggagtgcgcgttgtccggacgggtcatcggtttgtctgcggcctgatcagctgcggtattggaggtattgctaggagaggatacactcatgttgagctccgtttcttccatccggactgtaaccgttggccccggattctcaccggatcagccgctttcgcgggtcgcgggcttcggtatggggccgttatgaatgccggtcgtgccgttaccgccagtaaggattttcaccttccctgaaacttgcttgtccatatatacgcccgccatgcgatatgcgcaacctgcgttccgttttcgtcttgcgattcggaacgcagtctgcgcacgccgcgacagcgggcatgttatgacagcaggtcgagcagatcgtccttgctgagcgtgccgacgccgccggatgcggtgccgtcggtgaattggcgcgccagctcgtttttcttttcctgcagtttcaggatgcgttcctcgatggtgtctttggccacgatctggtatacgttcacgtcctgggtttggccgatacggtgcgcgcggtcggttgcctggttctgcgcggcggcgttccaccatgggtcggcgtgcaccaccacggacgcgcccacgaggttcaggcccgtgttgccggctttgagcgagatgaggaatacgggcacgtcgttgccgttgaattcgtcgaccagttccacacggcgtttcttcggcgtctcgccggtgatggtgtagtattccacgccttgttcggcgagtctggcgccgatgagttcgaggaacgaggtgaattgcgagaacacgaggacctttttgccttcgtccatgcatgtggccacgagttcgacgatggcgtcgagtttggcggaggcgttcttcgcgtcggcgtagacgagtcttggatcgcagcagatttcgcgcagcaaggtgaattcggcgaggatgcggatcttcttggtgttgaagtcggcgtccgacgccttggtgagcgtggcgcgtagccgctgttcgtgtgcggcgtacagtttgcgctgctctccttccagtttgacggtgagcacgttctcgaatttgtcgggcaggtcggtgagcacgtcttttttcagacggcgtttgatgaacagtcccaccaatgcctgcagtttgtcggccatgacggaatgttccggaccgggagccatgatcggctgctcgtatttttcgcggaatttcgtataggtgccgagcagtccgggcatgaggaagtcgaaaatgctccacagttcgctcaaccggttttcgattggcgtgccggtcagagcgaagcgatggtcggccgtgacctgtttgaccgatttggccacctttgtggcgtggtttttgatgtattgcgcctcgtcgagcgccatcagcgcgaaatggcaggctgcgtaatcgtccacgtcgcgacgcagcagatcgtaggaggtgatcaccacgtcggtgccgtcgtacgtcgtggcgccattcgtcgtagcaccgtcgttctcctgcgattgcgtggccaccgtcgcgatggccttgcgtcgctgcgctttcgtaccggcgacgacttccaccgtcagatcgcccgcgaatttctcgcattccgcggcccagttgtagacgagcgatgccgggcagacgatgagtgacggaccgctccccttgcgcgcttcgatgagcgagagcagctgcacggatttgccgaggcccatctcgtcggcgaggatgccgccgaagcccttgtcccacagggtggacagccattggaagccctccacctggtatgggcggagcacggttttgagccgttcggacacttcgtagcgtttcggatcgatgattctcacatcgttgacatagtccacgaacgaggcgcttttgccttcgtcgtccacttgggagtccagcaggaacgcttggtatccggggattttgatgatgccggagtcaagctgtttttcactcaggtcgaggtccgtggacacttggtcgagctcatgcaggtcggcttccttcaaatccacgaacgtgccgtttttgagccgatggtagcggcgttttctgcggtaggagtcaagcagcgcgccgacttcgttcatcggcacctcgtcggcgatcggtgagatttcaacgaggttcgagtcgatggacaagccgaccttcaccgatggcgggttgggctgcatcatgccatcgaatgccgccgtggagaagacctggcccaccgatttgaggatctgcacgccgtcggtgagcatgagcaggatagcctgctcgtcctcttctttgacgcgtgccacgtcgatggagctccatgtagggcacagctggcgtaccacctgcacggcgaacgattctcgtgacaggtcgcgtttgacctgcgaggctcttgaacgtgaatcggggttgatcacgccgcgcagttctttggcggtgggcaccagttggaaggtgaagtcgccgtatttcgccaccgcttcgcaggtgatgccgtacaaatcgcggtccagatagaattcgatccggcattcggttcccaccgcttcggtcacttcctgcggaatgtcgaatccgatgcccgcttcggtgagtttcggcacgatggttcgggcgaacatgggccagtcgttttcggcgatgaacacgccgtccggatcgtcggaacacaggtcaggcagcacctgtaatgccgggcgcagtttatcggtgcagcggaagagcccgtcgatgcctatcctgtccgtctccgtggaatcgtcgggacgttcgcggctgaaaatgtagaagccgttgcgtccgttgatgacatcggagatgctttggttcgatgtgatgcgcacgcccgacgcggtgccctcatgcacgtaggacgccttgaacgtgaaggtggggtcgccttcgacaatgtcaaggccgaacggttcgcctccttcgttggccatgtggatgcggcttggcccggatttcttggtgcgttggaaatcctcgataagcaatcgtctcagcccgtcaccgtccgacgtgcgcaggaaaccacgggccttcgactcgtgttccttgtattcgtcctgtgtcacggcgtggaacaggtcgagcaggtcgcatgcctcccaatcggtgaggacgagttcacggtcgacgcgtaccgcttcgccgtaatagtatccgttttgcagttgggccgccgttctggatgcaatcacctgctgcaggaagcggtatagcttcagcgagaaggggtcgagcatgtccggagtgtgggtgaacgcgagttttttgccatatgactcgtatgttcccgtccgcatgtcggccacgaatcttgagatgtttttgagcgcatagtcggcgtcgccgcatccgatgcgcagggacaggcgcagggcgtcatggccgttgatcagcgtgggctcgaggtacacgcttcccggtttgacgtcgaccggcgcgcttgatttgcgtttcggtttggcggctccctgtccggaggcgccacgttgttcctcgatcaatcggcttttcgcgttgatgattcgtttcagcacgtcgagttgggcattctcgccggcgttgttgcttttcgcatcgagggagcgcatgtagtcggcgagggcccggggtgttgcggctgcggcgtggaatccccggaatcgttccggctgttgcaggaacagcagcagcatggcggctacgtgcttgcacatgccggtataccggcggctggtggaggaagccgagtcgtcatcatcgttgacgtggccgtacgtgctgccggagccgaaatcgtcgtagtcgtcgacgtaatcgtagtcgtcgtcatcgtcgaagctgcggtatttcggactgttgtggtagtcgaaggtccggtaggaaccgtagccgcgctgcgaaccgctgaatgccgggcaggagcagtagcgtgccagaaacagctcgtcggcgaaatcaagcgtggcttgcacttcgtaacggctggagggtgaggtggtgccccgtatggtggcatacagggtgatgcggttggatgcggtgtcgttcaggcaatgcaggtcctccattttggaacgccattggttggcgatgccgcgggcgcgctgcagtaccggctggctgcattcgctgcgcagctcgtcggaaagccatgccagagtgtccgccacctgaacccccatcgttcgtacgtttgttctcatgcaaccataccagcgcgatggaacagcaaaagccgcggcccgatccggaccgcggcatgttatcgcccgtgttgcgtcagcggcagcgtttggtcagcggctgccatgggtcgagttccaccggctcggtttcgagcagcgctcgggtggcgtcgtcgaggtattccttgcggatgatgatttcggtcacatagcggtcgaaccacttgtcggaggccacgtagtagccgtcttcgccgttgtctttgccccagctgttctccactttccagcggttcggcttgccttgctcgtcaaggttcacgccggtgagggtcatggcatggttgcttggactgtcgccgtattcgaggccgtgcgccttgtcgaagtcgaaatcggtgccgaacagctggtccacgcgcacgctgtcgcagtcgaaatagccggccgcacgcagcgagaactgggtgcagtcgcaggcgaaccagatcgggtgtccggcgctaatctggtcgaccgcggcctttttgaacacgtcgagcggcacgttgacgaattccatatcccccgcttcggccacattggcggtgtagcggatgcggtaacgcttgttgaacggacgggacgccatcggcacgttgcacaacgtcaccagatcgtcgacgtccaccggcacgtacttcttgtagaattccatcggcgtgatgccggtttcgcggatctgtctgcgctcgtccttgccggttttcggcttgtcggcctcgtcttcgccgcttttcttatcgtccttcttgtcatcgtcgctcacgcgggccaggaagtcgaacttctccggcggctcgcccaacgagatggcgcacatgcggtacacggtggacatgtcgtcgtccttgaccgcgcgcagttcatcgaccgtggcgccggctgcgtaacgttcgcgcaggtcggcggcgaactggcgcagcctgctgttgaggtattgtttgaacgcgtcggagtccttggaattggcggattccgggtaggcgctcttcggcacgagaccatacttgtctacaagggcggcgaacatctgccaccaaccgccgtcatcggccggcccgtagttgatctcctggaacaggcggctgtcggtcggctcgtcgagcgtggcgaacacgttttcgagatacgtgttggatttttccatcgcatcccagaagaacaggtaggtttcggagaattcgaaatcgtcgagtccccactggtgcatgagctcgtaacgcagggtgttgagggatgcgaacatccagcagcggccggatcggcgctggttggtgatggacccctgtttcagttcgatggagaagtcgcgtggcagcgcgcgctggcctttgtagtcggtggcggcttcgagcacgcccgaggacaccgcggcgttggcggccacaaggttggcccggtcggcgttgaagtctttggcgtattgtgcgagacgttccggtttgattgctgtgatgctgttggtcatacggccgattcttgccatacgtcttgacggatgcgaaatactggtttcggcatgccgaaaaatctgccgtaaataagcgattcgaattcgttccggggatattcttgtactacttgaggggtttttagggtgaggagcgtatcatgcgtcgtcatggttcgatgatggttgttttgtccggattgctggctgcgagtctggccatcggattgccggtcggttcggcgtatgcggacgagccgacggatggcaccggggccggcacgtccgccacggaggtgttggattcgttggaggtcaagggccgcgcgccgaaaaccgggtacaagcgcactcaattcggcaaggcgtgggccgacgtggaccacaacggctgcgacacccgcaatgatatcctcaaccgcgatctgaccggcgtgaggcacaagtggcgtacgcacaattgcgtggtgaagtccggaaaactgcatgatccatacactggcaaggacatcaagttcaagaagggcaagaagacttccaccgcggtgcagatcgaccatgtggtggcgttgagcgatgcgtggcagaagggcgcgcagaagctcagcgaggagcgccgcaccgcattggcgaacgatccgtacaatctgctggccgtgcaggggcgtgccaaccagaagaagtccgatggcgatgcggccacgtggctgccgtccaacaaggggttccgttgcgaatacgtggcgcgtcagatcggcgtgaagcacaaatactcactgtgggtcacgcaggccgaaaaggaagccatggccaaggtgctgtcctcctgtccgacgcaaaccgtgcccgactacacgggggtcaaggattccacggccgagaagaccaccgagtccgagcagaccgaacagacgcaaaccgaacagtcagctgagcaggcccagcagactcaacaaacgacacaggcacctgcgcccgaacccgctccggctccagctcccgcgccccagccagcgccacagcaggatgtctactaccagaactgcaccgcggcacgagccgctggcgccgcgcctatctaccagggccagccgggctaccgttcacaactggatcgcgaccatgacggagtcgcctgcgaataaatccaatgcagcgtctccgcctttccggttgtaagacgtatgacggtgaggcataggaaaagcgccgggttattcatccggcgcttttcctatgcctcagcctctttccgcattttccgcagtacagtcatgagaaccgctatggtctgcgcagccgcgcgatgtcgtcacgtagctggttgacggtgtccgtcagttcccgcacattgtggcgcaactgttccgtttccgattccgcctcgtccgcgcgcttgtcggtttcgtcacggacacgatcgactatccatgaggccagtgtcgcggtgacgatgccgatcagggccacgccggttatcatcagcccgatggcgatgcatcttccctgccatgtcaccggggacaaatcgccatagccgactgtggtgacggtcacgaacgaccaccatatcgcctcgccgaaatcggtgatggaagcgcctggaaccccacgttccacatccaattcggcaagggcgccgatatacatcagcagtgtcacgctgcagcatgtgtacagtgtgatgcgcccacgcaccgccatgccaccggtacggttgagcacgttgagcaccgccaccaatcgcagcagcctcaatggtctgaagatgggcaaggcgatggacaccagcatcagcagattgcctttgaaccaggctttcttgtccttcgccagcagaatcgaaacgacgtagtcgacgatgaacgccatccagatgatgttgatcaccgtttcgcacaatacgatatgcgtcctcgccagcacttcccacgaatacgcgaacagaaacaccaacgccaatgcggtcatgaaccactcggtcatccgctgccatttgtccaatgtcatatctcccgcctttctccccatggctgccatcatacgggtttgcccgtttttgtgacgtattccgggcgcggtacatgtgccttcagaccagatagacctcctcatgtggttcgtttcagagttcatctcggaggccgtccgattcggaccattcagccgacgaccgaaggagcggatacccacttttaatgaacgtcagcccttgagaggcatgcggttgtcgagcgattgtccgttggcgtagcagcgcacgttgcccaatgcgatggcgatgatgcgccgttcggtggactccaagtggttgccgcccgccacatgcggggtgatcaggcatttcggctcgctccataatggcgatgccgccggcagcggctccggttcggtcacgtcgaggccagcgccgcggatcatgccgttggcgagcgcgtcggcgagcgcctgcgtgtctatggcgtcaccgcggcccgcgttgatgacggtggcgtcggttttgagttttgcgatgcgttccgcgttgagcaggtggtgtgtggatggcgtggatggcacgcacatggcgatcacgtcggcgtattgcagcacgtcgtcgagcgattcgaatccgaccatgtggtcgatgcccggcgcttcgacggtggggttgcggcggatgccgatggtcgacatgccgacgctcttgcataggcgtgcgaaatgcgatccgatgtcgccggtgccgatgatgagcgcggttttgccgtcggggctgatgacgcggccggcgtcctgccatgcggcgttcgggttgccgacggcgtagatgtgcaggtttttcatgatggcccacatcatggcgaacatgtgttcggagacgctttgtccgtaggctccggtggcgttggtgagcatggatccgggctgtaggatgccggggtgctggtatttgtcgacgccggcgctccaggtctgcagccattcgagtctggggcattgcgcgcatgtttcgggcgtgatgttgccgatgaccgcggttgcatacgctttgagttcgtccggtatttcggcggtccagttcatggagcctcgttgtgccgggtcgccgacgaattcctgcggcatgccttttgcggcgcgtgtgaactgcgcgcgttcggcctcggtcagcggcaggcagttgacgaccagtttgcggtcattctctattcccatgcgcccaaccctatgtcaaccatcagatatgcggcgcggttcagatgccgagctcgtcggtgtcgaaaatgatggtgaccggaccatcgttggtaaggcttacgcgcatgtgggcgccgaatctgccttctttgacgtcgagtccctgcgcgcgcaacgcgtcgttgaacgcatgccatacctgttcggcatggtcgggcgcgcctgctttcacgaagcttggccggttgcctttgcgtacgtccgcatacagcgtgaactgggatatcgacagcacgctgccgtccacgtcgtggatggaacggttcattttgccgttctcgtcttcgaaaacgcgcaggttggcgattttgtgggcgagccagtcgatttgtttcgctccgtccgtatcttccactccgacaagcagcacatagccgatgcctatatgctgtggttcgaatgtggtgtcgacttctccgcttgtctcgtcgaccacgtcgacggatccttcgctgaccttctgcaatacgatgcgcatattccgtctcgttcttttcagccggcgtagtcgacgatggcctgcgtgacctgtttcagatagtcgagcgatgtctgccaatcgtccggcacttcgatggaatgattggcaccagcatacgtgcgcacatggtcggtgagcagatgcgctttggcgtcatcgtagtatgggtcggcgtcacctgcgcagattagcggcatcgggctgccggcagttcccggcagcggcgcgggaatgaccgacttgtgcttgtcgaatggcggcggattgagtaccggggtgagcagcaccacgcgcaatcctagctttgcggaatgcggatatgagagtgtggagagcgatttggtgacgaccagcaaatgcggctcctcacccgattcggcagcatgttcgagtgccgccttgcgccattcgtcgaccacgcgttccatgcaggcgatcatttccggaaactcgacgctttccgtcagtttcaggtcgagccggtccacgaaccatccgttggccgcaagcgcctgcgctgcccagtacagcagcggtcggtctacggtgtatccaatgcccggcatgatgagtacgtgcttgcctgtttcggtgttcttcacacggttcttgccccatggcgtgaccgcgggcgtcacattcttcgttttcgttgactttgcgctgttttcgttgattttgcccatgccctgccgaatgtctttcgatgtcttcgtatggttcgaccaccgtctcggttttccgaagaccggtttccttcaacgcatcatagggcacataggctacatgggcccatatccttccatattgcgttcattccgttcggagaatacggaagaaccgtcacgaacggtcggtcgccacgcgtctggtggtgtcacgcaacatcagcgtggcctcctgcgattcataggatgcgtctggcgtctgtccacgcagaagggacaacgtcttacgggcggcgttgcgtcccatttccagcggattctgtcgaacggtggtcagattcgccgcctgtgcgatgtcggcatcatcgaaccctatgacggagatatcttcaggaacatgcaattgttgcttgccgagttccttgatgactgcgattgccacttgatcggtttcggcacagatggcggttggcatgtgtggcaatgacagtaatttcgccaccagttgcgcagcaaggtccgctttcgacaatggcgcatcatgctcgtccgcggttatgacgtaggcatactcatcgtcgtaaccgttttgttcagccgcttccaagaacgcttccatacgctggctggtgctgtagaccatgtcgtcgggaatgtaatcaacgacgaaagcgatgcgctggtgtccaagcgatttgagcagacgcaccgccttggacatgccatcgtagttgtcaacaccgatggctgcgtcgcagaacgattcggctggaatgttcacaccgaccgtcggcatatcggtgacacgcagtttctcacgtgcggattcgtcgagttggaacgacgaaatgatgatcgcgtcagcattgcgatttttaggcaattgtgcgaagtaacgctccgtctcctgtctgcctgtgacaaatgtgggcgacacgtcgtagccttccggttccaacacttcgcacacgccctgcaacacgttggcgttgaaccattcgttgagtttgccggaaaacagcaggacaacccgcatggttttcccggacgccaaagacgatgcgcttttagataaggtaaagcccaaccggtccgcagctgcctcaactttggcacgcgttttcggagcgaccttgccaacacctcgcaatgcccgcgaaaccgtcgcctgagatactcccgccagttccgctacttcggcgatggtggctcgtgccatatccactccagtttcccattgtttatccagcgctttcatattagcagaatcgttgatttcacaagcagacacgccataacaaaacaattattgcattcacagaatgaaagcgctatcattttaagcaatacgaagacgagaacgaagtgattctaatcgtcaaaacagagcgttctcaacagaatgaactagtgaaaacgcttccataaaaagccataacaaaatcacaatgcatccaatgaaggaagacaacccaatgagcaacgaagccaacgagcggcacatcgctgacgatccatcactctggtggaagcaggcggtcgtctatcaggtctacccgcgttcgttcaaagacacaaccgggtcgggcctcggagacatcgcaggagtcgcacaacaaatcccatatctaaaaagactcggcgtggacgccatctggctcagcccgttctatccgtctcaactggcagacggcggatacgatgtggacgactaccgcaacgtcgacccgaaactcggcaccatggacgacttcgaccatctcaccaaaaccgcacatgcggcaggcatcaaaatagtcgtcgacatcgtaccgaaccactcgtccaaccagcataaatggttcaaggccgcgcttgccgcaggccccggctcaccggagcgagaccgttatattttccgtgacggcaaaggaccgaacggcgacgagccacccaccaactggattgccagcttcggtggatccgcttggactcgagtgcccgacggacaatggtatctgcacatgtttaccgtcgaacagcccgattggaattggaagaatccggacgtgcgcgccgatttcatcaagaccttgcacttctggctcgaccatggagcggacggcttccgcgtggatgtggcgcacggcctggctaaggatctcgaccgtgacgatctcgatgatttcaaaatcatcggaggcgagatgcattgcgccgacggcacgcatccgctgtatgacaggaacgaagtgcacgacatctatcgcgaatggcgcaaggtgttcaacgagtatgatccgccggcattcgccgtcgccgaagcctgggtacctccggagcatcaataccggtatgcctcgcccgaagaactcggccaagtgttcaacttcgaattcgccaagaaagactggattcgcaacgacatgcacctcgccatcgaagaaggcatcgccgctgcggaacgctccggctccacctccacatgggtaatgagcaaccacgacatcccccgccacgtcagccgctatgggctgccgcaggtgccggctgcagcccaccaccaacttgccaaggattggctgctgcgcaacggtacctcttaccatgaggatcgcgagctcggcacgaagcgtgcgcgtgcggccatcctgatggagctcgcgctaccaggttccgcttatatctaccagggtgaggagctcggcctgccagaggtcgccgacatcccgtgggacgagttggaggatccgaccgcgttcaaccgcgtccgagaccagatcgaaaagggccgcgacggctgccgcgtcccgctgccttggaaggccgggacgccgaccttcggcttctcccccgccaccaagcatgaaggcgccggcgtggacgcgagccaggcgggcgatccgtgcgagaagccgcatcttccgcaaccgcaatggttcgccgactacgccgtagacagggaggacacggactccggctccatgctcaacctataccgcaaggcgctcggactgcgtcacgaatggatgacggccgacacgaccctgacctggctcgactgcgaccggtcctccggcaagccggacggcgccgaggggcacaccggcggcaccatcgccttccgtagggccaacggctgggccagcgtcaccaacttcggtgcggaaccggccgaactgccggcaggcgatatcctgctcgtctccggacccctcaccgacgacggccgtctgccgcaggacaccaccgcgtggatcgcgctcggctgaccggaccccatcaaccgcaattcgcattcaacaaccaaacaaaggagcacatcatgaaccgcaacatcacacgaatcgtcgccatcgcggcgacactcgccatgggaacatcgctggcggcctgcggcggcagcagcgccgattccagcaagggccacgtgtatttcatgaacaacaaggccgaggtcgtggaccagtacaaggaactggccagcatgtacaccaagaagaccggcgtgcaggtggacatccagaccggagccgccggcacatacgatgccaccatgaaatccgaattggccaaggacaacgcaccaaccatgttcaacgtcgccggcttcgaccagttcgccaagtaccagaagtacgtcgaaccgctgcaggacaccgacgtgttcaaactgctcaacgataccggcaaggcttactcgtacaccatcgacggcaattcgtacaccctgccgtacgccgccgaatggtacggcatcatctacaacaagaagatcatcaaggattattgcgccaagagctacgcggtgatcaagtccgccgatgacatcaaggactacaagaccttgaagcaggtggcggaatccatcgagcagcacaaggacgacctcggcgtcgacggcgcgttcgccaccccgggcttggatgcctccgacacgtaccgattcgctgcgcatatgacgcgtctgccgctctactacgagtatcgggacgcgaacaccacgttctcgaagaccatcaagggcacgtatctcaagaactacaaggacatgttcgacctgcagctcaagaccagcccaaccgaggcaagcatggtgagctccaagacctacgatgacgtgacctccgaattcgcgctcggccaggtggcgttctacccgaacggcgtgtgggcgtattcgcagatcaagggcaatgacgtggccgatgaggacctgggcatgctcccctactacatgggcatcaagggcgaggaggattgcggccccgtaggagtgtatgacgcgagctgggcggtgaacaagaacgcctccgaaaaggacaagaaggccacgctcgacttcatcaagtggatgatcaccgacaacgaagccaagaagatcctgtccaaggacatgggattctccgtaccgttcaccacgttcaccgatgactaccagccggacaatcctctgaccgaggccgcccgagcctacagcaatgacggcaagaccgaagtgcgcagcttcaccattccggatcagcagtggcaggacgacatcgcctccgcgctggtcgaatacgcacagggcaccggcaagtgggacaaggtgcagagcgcgttcgtggacggctggtccaccgagtggaacaacaacgaggaatcgctgggttccgtgccggaagcgcagaagttcgacgcaaagagctgacgccatccgactcgtggaaaaacggctggacgccggtagataacaccccaatctaccggcgtccagccgttttttccatgcgacggtcgtccgatccgctgccgtacacttggtcgttatgaaagtttccctgcaacgcgtgtccgaggcgagcgccatcgtattgaacgagttgggcacaccggatccgacattcgacatggcgcagatcgggcccggattggtgctgaccattgaagtggagcccgatgatgatgagggaacgcttgcacggatggcgcatcgtgtgctcacgctacgctgtttcgattgtccgcagggcagactgtcgctgtctgttcaggagatgcgcggcgagattctgtcgattccacagccgctcaccatactgcggcgtcccgcggtcggcaggccgcagctagtatctcatgatgccgatgatgagcatgcgaatctgatatggatccggttcaatgaagcgctgcggtcgggcgatgttcccgtgcgcgaaggtcggttcggcgcccgcatgcgcgtcggttccgtggcggacggtcccttccaattcacgttgcaggaatgaccgcaacgcttgccagcatggattccaaaacgttgatcaccctttcccgaagtataaatgcgatattacgaacgtagaagattccgctatacggaatgtgctcccgtatggcatgatctagtgtatagataacagcatgacattcgcactacaattgcttgtagctgttacctgcatatgattaggagcaaccatgagcgacactgcgacgattagtttccgcacggacccagcgatcaagcgagaggcaaaggaactgtatgccgatatgggcatggatctgtcaacggcaatcaacatctttctgcgccaatcaatccgcgaaaacggcatgcctttcaagatcaccagggacaatccgtccagcattgaggcacgccgccaagcggaaacccatgacggagaatccttcaccagcacggatgcgttgatgaaggatctgctggatgcttaaatcggtctttcgtacaacacagttcaagaaggatttcaaggttctgctcaaaaaacactatagtcccgataagcttaaacaagccattgacgcactcatggctcagaacaagcaactactcagcacaaaataccgcgaccatccgctgactggaaattggaaaggatatcgcgaaatccatatcgagggtgactggcttgtgatttatcgcgtggaaaagcaggaactgcaactcgtgctcacacggaccgggtcgcatgatgatctgttctagcgattacccgattaccgactacttgaacaggtcgaacaggctgaacgtggtcttcttgtagattgtgttgtacagcttgcgcttgggatgcaaccaccccatgcccttcttgccatagccgggaatcaacgctttcttgaccgcgcgggtgacacggcctttcgtacgcgcggacaggctcttcttccagctgggttttctcattccgtatttcatggcggcctcttttcggacggttatgtatcgctcaacattgcatacgcatcggctggataaactcaaagatgaacatagacgaacatcaagtacagtcaagcaattacttactggcagcttctttgagagcggcctgcagttcaggatcaacggcgaataaatacaatccatgcacaccgcgtttgagcagaacattcagttcattacgcagattggattgcgcgtagctgattgagccgttcctcttactcactgcacgtttattacaacttgccttttcgttaaaaacgattttcccttcgcgataggtaaccgacggtccaatgatgacacctacataattaagatcaaacccttgaatagagaacgttgatcctacttcattaagcgtatgcggactttccgcccagacagcatctagggaaagacccttatcccctaccttgatttcgtaattccatggatgacagaaataatcagctcttccatcaggattaaacgcatcgtatcctctctgcattcccggagccgctcccatgcgccatactccctgtgcatcgcgatgcatctcaacattccaaagaccatcgggactggaatcgttgattttgccgcccttatactcccaatcatacgtagcaaccacacgagaaagcccgcatccgtcaacgcctgaagcctttagatatgccttctcctttatggctttaaacagtccaaccggcgaatcgaatactctgatttcaaatggctcgcggacatattcgcctgtttttctatccttctccccaatgtcttgaggaatacgacctattctcttaccatcagcgaaatcatcaatccatcgaatcgtcgcatcatccgcagcaatgcgaaattgcctatgcaagcatatgcgacttagcaaatagtgatcaccccacatattcaatggcacaaatcgctccaactgcccgctatagccagcagcagttttttgcacgtcgctttctgcttgctgcggaaagagcatgtcctgatcctcttcgctccaacgctgcgaagtttgcaaaatctgattcgggtcgaataccgcaataaccactttcgcacgacgcaataaatcgtgcagcatgttcttgcccgagtatccttggtcaccctgcgtcaacagcagatgagcttcatcaacaagcactacatcggctttgcctcggggcttgtccgcaatagctcgattacttgttgttttctcactaaatcgattgatgaattgactcggtttaagagccacctcgccaaaatgtttctgcaaacctaatttgcttgcaatttggttatagacgtgcatttgctggttatggttgacaaggatatatgcttttctgcgatcttccttactgatttttagtgatgaatcggtttccagaatatcttcatcatcttcgtcattgatgcgcccattgatatccatttctgttgctatgcgataaaacaggtgacttagcaaaaccgtctttccagtacccgcaacgccttgcacgaaaatcagtctcgataaaccggaatcggctgaatcaccagagccggcaagagcttcagaaagcgcgtccataatcgattcctccgcagctatctgatcatcactcaattggtgaaaaggcgatgctttaaaaagtgcagaatcgcgaataatctcctcagccggaaatagttccggatcctgtcggttcagttccatccagatgtccgagaaaatctggttgaattcatcctgcgtatagtagtcgccttgcgcattggtgcgacgattgttcaaattcttgactgcatcagagccaagaagataatgcatcagccggttctccacgtccaaagtcagagatttgttgaaatgcggattgccaatgacatactgccacacagaactagcgtcgctctgcaaattttcttgaaattccttccaatcaactctcgttttgggatcttccctcagatgctgcattgttcgactacgaatattattcgtctctcccacatacaccgtatattcgggacgtaaagtatgctgattcctcttctttgaatgaaccacatacaccgttggataatcgaaaatatagtgcaaagtctcacgctcaacagcagataatgtctcgtatcccaattgctcgacaaaggctttctctatttctgctttgtcatcaatgctctgatacggcaaatctataatgattggctttggaagcgcgctcttcgtcatatgctcattatgcacccgagagaggccttcagaaaagattcgacatacacttacgtattatgatttccgattcaagcatcaacgcgatccgtaaattcgtagcagagcgggactggtctcaattccacactcccggcaatcttgccaaatctatcagcattgaggccgcagaacttctggaatgttttcaatggaacgacgagccacaagacagcaatatcgaacatattcatgaggaaatagcagatgtactcatgtattgcatcatgctatctgacaaatttggatttgaccttgacgagataatcctcgataagcttgcgaagaatgctcagagatatccggttgaatttgcctacggcaatagtaataaagccaattgacgctgtatatacgttcgtagataacacctgaatagttgcacgctgcccaatctgcattcactatgagccacgttttcttcgcgagcgcgacaggggttccaacagatagaacctgcatctaggttagtaatccgtcagaatgcgttcgcgcactttcatgcattctcgcgtaccaacatcttgattacatattctgttcatgtacggcacgttcacttgcccagggatgtacagttctgtgtatcagcgcccacccaaggctacgtttacgtcctgaaacgcggtgggtctcttcttctctgtaacaacggtagagcattccttgagacacgctcgaatcgaccaagcgaaccaactatgctatcgtaactaataacagtagcctccaagcctcttaacaatgctcaaatccgggggctcttttttttatcaagtcgcacaaggatacgccatgacgaagcagccaaaaacaatacaggaaatgatgacgcttttagtcgaagaacgcggcttggatatcaccggattctccgatttcagcaccgtcctccttgattgcaactattacagattgtccggctacttccgagcctttcagattgatccttctcatggcaataatcgctttcgaaatggaacgcacattaaggatttcatgattccttatttgatggatgaacagctacgtctactcatccttcgtggaacatcatccttagaacaaacgcttcgggcccatttcgcttactaccttgctcaaaacggaggagcctactcctacacggaactcagctcatataagacaatcaaatattccgatggcaccgaagccagagaagttctaattgagaacattcacaaatggcttgaacgttccagcgaagtatgcattcgccattatcggaataacaacgagcctattcccatatgggcggcggtcgaggcgatgccctttgacactctctcaaaaatgatttcattgcataccaacacaacagctgttgacgaactcaatcagtcgctttctctagggaaaaatcgtcaacgtgctgcgcaaatcattcacagcatggtgtatctacgcaacatttgctcgcaccattgccgtctttggaacagggagattgtccttcctcccccagtccttgatgccacagctgagcgctatggctcatatgcttatgaagaccgctccgtctggaaatctcttattgttctcatggatttaatcgatggaataaaaaagaattccacatattcatccatgcttataaaacaagctgagtcgaatgataactatttctggggattatgtcatcctaaacggtggcattagacacagccacctgaccaatatttgtcagctccccgaatctcattgtcatgagaaagcccagtatcgaagaaaatgataaatatgacacacctcagataatgcggaacatcggattggaggttatggaattgacgaatatcacacgctgcatttcagccagtctgtcctgcagttcagtggtaatgtatcgttttttcaccaagtcgatctcccgaccaaaagtcgatgcaagatcatcacgcaaagcccactcatcaatcattggattggcggtgtcgtcaaactgatagatgaaatcgatatccgaatccgcatgcccctcccctcgagccatggaaccgaacaggtacagttcattgacatgatgccgcagcgcgataggacgagcaatctccgctatctgctgcggcatagcgacccgcgaaatcacatcaagcgctttcatagagctagaacatgtgcaagtttcttttccacctggcgcatgacatcatcttccaaaattccaatgcgttggcccaatgccgaagtgtgcactgcaagaatcttctccgtcatcacccaacttattttaatcaaaccattctgcgcagtaggaggaactttaacccgggtagtcatatcatccgacgtaaaagaaatcatcaggcataccacggtagagtcaaaaccctcgatttcgtcattctgcacaacgacaaccggccgaggctttctcgcgtaaccatcagccagcacagtccagatctcacccctcctcatcagcgatcatcctcatcgacaaatcattagcgaaatcagaagcctcccgttcattctcgaacggttccgcaacctgtcgaactcgtacctggtatgggaacccctgatattcattaaaggacgagacgaacatacgcagcgcatcagccgtggaaagaccgagcttctttgtcgtttcacggaactcttccgcctgatcatcatcaacacgtgtcgcaagctgaactaccattgccactccaatcactattttttatcattttatatcttattgacatgttttgctaatattccatatctggattactaaaactctagattcacagaatttgcaatgtggcagccgaacgccaaaacccgaagcatgagcgttggaattccaacgctcatactcgccataatcgccaaacggtgccacaaacaagccaacaagcgtttttggggagagtcattcgcgtgatgttgcgctctatcattgataaaaacatccagcaaccgcataccgtaaggaatcacatgcgctatttcacttcggacacgcatttcggccaccctctggtcaccgcactgcgcggattcctgaacaatggcaggctccgcaccgaataccgtgatgtctggcaggcgcagggtcgcgccgccgcgcacgcatggatcaacaatacgtacgcgacaatcagacgtcgttcaaagcaatctgcgacatcacacgccatgagaacaccatcatcggcaacatcaacgagaccgtcgggcgtgatgacgagctatggattctcggcgatctctcctaccgttgcaccgtcgagcacacgctcgactgtctacgccgcatcaactgccgccatctgcacctgatcatcggcaaccacgaccgcaacttccgtctccgctccaatgacgcgctatacgaggacgtgttcgagaccatcgatgactaccgcgagatcgacatggagcttcccgttctcgacggctccggcaagccgacggccgcaaccgcacggcagaccataggcatgagccacttccccaggctctcggcattggccgaagaacacggcaactggccggaaaactggaacaagttcgccgatgtggcgccgaccaccgaaggttggctgctctatggtcatacgcatcaaggcattcccgacggcaccgatccgctcagcgtgaatgtggggcttgatgcgtgggatttcgagcccgtcagcgagcagcagctcctcgcctggttcacattccggcacgccgaccaatcaaagtaaattcccccgagcatgcgtcatcgtccggaggcgaagcgggtgaggactcccgacttggccaaggctcggtagaggacccacgaaccgaacccggcgaatacgaccgcgctcagcaactcgcatgccatgccgatgagtccacgcggactgaagaacgaaaacgcctggtaatagaagaacaacaggtagaagttgtatacaatgccgatcgccacggccgacagcaacgtgacgccaagcgtccaacgacggtagcggaacaccgcgaacaccgcttcggcggcaagcgcctgcacaagcgcgatcaccaccaggctcacactgtatttcgtaccaagcaccacttcgacgaacgaggcgaccaacagcacgtaggccgacgcgcccggtttgcgtacgatcagcaagctcagtgtggcggggaaatagaacaatgcgtgcagcagtgccgcggagcctggaagtatcagggtcagtaaaggaaacaagccataggacatgccatcgaacacccagaacatcacgccggacattacgccgacggccgctccgacggcgatgtcgacgacacgccatttcagggatctgcgtgtttcctccgttgtttgcggagcatgcttcagcatcgggatgcgtggtttttgggtaatcgtttcagaggatggctctgccatgatgaatccttgccttggttgacgccgcgcaccgtgagttggagatcgcggcggtcgccgtgggccgttcctcgacctgcgcggcccgggcaggaacgacgcgcgccattatacggcctattgttgccgaaaatgttccatgctccgagttccggccgttttcgctcctcaacgcataggaaattcgccgctcgctggcatgcatgatgccatgtgggaaagccaagaagccgcgcatccagtccaaaatgtgtggcttcttgcttgagcaagcactgtttcagtggggaatgacttcagcaacgtccttcgtacaggaagtaagacatgggctcgtcatccgccaacaggcttgtcgtgccgaccgtcaacccgctggacgagctgtctgtcggattcggccgcgaggaaccatcgttccggtcatcacgttcggctttgcggattagtccgcgatggtcgtagaagccgacatcgcatgtgctgtcggtgaacaggaagtattcgcgcaggccggcgtcatggaatacgccaagcatatggttgaacagtctgcgccccactcccatgcctcgtgcggccggggaaacgacgaacagcaccacttcggcctcgtactccttgcccgcgtcatgtttcaacgcctcgtcggcctgcagaatggccagctgcgcaagcagaccgtgacgtccctcgtggcttgccagcaacggcaacgtgaggcaatgtcggcgcagcatatggcgtgtccgctgccgaccggtgatatccgaacgcagcgatccgagaatcacgccgagcacctgcccattaagttcggcaacgtatgctttggtggtgcgggccaggcaatcctgcatgtcgattgcggcaagtcgatgcatgttgcgcagacgggtcgccttgcgtagttcggcgcgatgcttgtctgggcctgacgtctgtccgacctcgtcatgcgtgttgtgtgaatcgttgccatcgtcgtaccatgcgagccgtatcagctcttccaaagcgggaaaatcggtgcgacgcaacggacggatggtaggtgtttcacaagtcatgcaaccatcctatacctcgcccctatcgaagatgcgctcagggcaaatgcgaaagaatcgttcgcattcgggcacggtacggcactctgcgggaatgatttcattacgctgatacacggtatgaagtgatgtaggacgatgacgacacgaggcttgcgatgaagatgatgctgcgacggctggcgattgtggtgtgtgttgcgctggcgttgctgtcggcggcctacgcgttcgccgtgttgaggacgcattcgggcacgggattttggaaggtctggctggttctcgccgttgttttcgcattgctggcgattggcatcgcatgtcactggtgggtggcgcttccccggatcatcaggggcgccatcatcgctgtggtggccatcggcattgtcgcgttttgcacaatagagggttgcatcatcggcaatatgaacgctcagggcgagccggatcttgattatgtgattgtgcttggcgcgcaggtgcgcgagtcaggccccagcaaagcgttgcgctatcggctggacagaaccatcgattatctggaggagaatccggataccatctgcattgtttccggcggtcagggccataacgagccgttcgccgaagcgcagggcatggccgattatctgcagaagcatgggattgcggaaaaccgcatcatccaggagtccaagtcggaatccactatggagaacatcgtcaacagcaagaagctcatgcggcaggagaacgcttcggtcggtatcgtcaccaatgatttccacatgttccgtgccttgcagatcgcacatgccaatggtctgaagcaggcgcagggcatcgcgacaagttccccgaaggacatgctggtcaacaatatggtccgtgagttcttcgccgaaatcaaattcctgttctcataagcgccaatcagcgtttcagtgcccgtcgtcactacgcaagatgcgtgccgcgcggcagccattccttcttcggcagggttgcgaatgtgggccattgttccgcagcggcaccggccgcgtccagccgacgttggaagccgggccatttcgggtcggcttccaacagtcgtccgagcagtatggcggtggcgtgagcgtcgcttaacgcgctatgcgcatcctcgttggcaatgccgaaatactcgcagcagtcggcgagcttgccccgtccgatcagggaacgcgacagtttcatcgtgcacagcatggtgctttgatcgaccggaatggaagctcccatacgcgagtattccgcaagtaggaaccgtgaatcgaacgacacgttgtgtgccacgaacacgcgtccggcgagcaggtcgcgcagctcatgcgcgataccttcgaaatcgggagcatgcagcagttcgcgtgcggtaatgtgatgcacccatgaggcgccgacactgcgatcgacatgaatcagcgtctcatgctcgtcttcgagcgtaccgtccggagccacatgcaccaggccgatttcgatggcccggtcgccttttgcgggacttaaacccgtggtttcgaagtcgactaccgcatatccttgagaattcatcacacctgccagtatataggtccggttaaggtccggttagctatctctgctgctcgtcagacgttcgccgaagcggcatgcgctatggttcggatatcgtctggagtcgttcggcagcatcctccaatgagtcgggctcccgcgtcgatccattgcggtaccagatgggcgaaggccggttcggaaccggtgggattaggcgaccaggttttggttttcggatcgtagatgtcaccgttgttcggatacacgatgatcggcttgtccgtaacctgtcggatggcccgaattgctggaagcacacgatcacgacggccaaaccggacacggacaccaataccagataaaccgtggaagcggccacgacgctggacagcaatgccagcagaccgccgatcatgctcaggcgaagcgcggtcatcggcactccctgctattggttttggcgatgttgtgtgggatcatgtcttcgttcgccaaggaccacagcatgcgtgtggaggcgtacaacccggagttcgcagccgaaagaatcgcggtgagcacaacgaagttcatcgcgtcgccggcgaaaggcagaccaatggagttgaacaccagtacgaaggggctttcgtccacaccggcgtcctgccaaggaatcagcgaagccatgaccacgatggaaccgatgaagaagatgacgagacggaacagggtggtgtggctcgccttcgggatggctttgtcaggatctttggtctcgccggccgttacgccgatcagctcggtgccggagaaggcgaagttcaccgtcagcatggtggtgaacaccggcatccacccgttggggaacaatccgtccttcacgaagttctcgaatagcggcgcatggtcatacccttgaatcggcagcacgccgaacaccgcgcaaccgcctatgaggatgaacagcacgatggccgccactttgatgaaagagaaccagaattcggtttccgcgaagaagcgcacggaaagcgcgttcgaggtgaagatcaccacgatgaacagggcactccaaatccataccggcgtgccggggaaccatttgcgcagataagtccggcagcggtgaattcggaccccaatgcgaccgtccaggtcagccaatacaggatcgcgacggtgaagcctgttccaggaccgatgaatttggtcgcatacacatggaatgagccggtttccggcatggcgacggaaagctcgccgaggctgagcatgaccagatacacaatcaccgcgccgatagcgtaggcgatgaccgtgcccaatgggcccgcctggttgtgatggtgtagccggagctgaggaacagtcccgtacctatcacgcctcccagtgaaatcatgcggaggtggcgtacctccatcttgcgtttcaaatcggtatgcgtggtcttcgcagggttctcccgcgtagcgtccttcatttgattctcccctctatcgtcggcggaacatgtcgccgacgcctgattcataatattggttgcatcattgaggagagtcgaacctccagtatttgagagaaaaacgaagaaggctggaatcatcaaaggattccagccttctttacgcgtttgtcagcgctttagcctatcggcggcagcgattcactcggcgtccttgtcggcggcgagtgaatcggccacagcggcggctgcggaagcggcttcaacgctctcggactcttcgtcttcagcggcttcgccgaggaaggcgctcaggtccagggtctcgccctcggacttgaaggtcacggcgcgcatgccggagagcaggcccttggagcggccgacttcctgcacggcggaaccgatctggccgttgcggatgatggcctggatgaaggcgttcgggtccatgccgtactgctgggcgatggaggcgaggaagttgaagacctcaccctgggagaccttgacgtccatggtctcggcgagcacgtcgagcaccatctggtcgcgcagttccttctccacggtttcttcggcttcggccttctgctccttggtggccttggacggatccgcggtcacgttcttgagctgctgctcgaccatttcggccttgacgcccttcggcaccggaatctcgaggccatcctcgagcttggcgatgaacgcgtcacgagcggcggtggcctgacggctttcggcgtcctgagcggcgaccttcttcaggtcttccttcagctcgtcgagggtgtcgaactcggaggcttcggaagcgaagtcgtcatcgagttccggcagttcctcggccttgacggagttgaccttgaccttgatcagggccttctcgccttcgtgcttgccggcctcgagggtgccttcgaagctggtttcctcaccggcggacaggccttcgagggcctcatccaggccgtcgagcatggtggcggagccgagctcgtagctcacgccctcttgggagtcgacggtttcgccgttgatttcggcgttgaggtcgatgttggcgtagtcacccttggcggccggacggtcgacgctcacgagggtgccgaaacgctggcgcagggcttccagacggttgttgatgtcctcatcggtgacctcggccttggcgacctcgatctccatgccgtcaagagccggcagttcgatgtccgggcgacgctcaacggtggcgacgaacttcagcttggtctcatccttggcggattccggcacgtcctgaacgtcgatctccggctgggccatcgggtggatcttcttggtttcaagagccttggaatacagctccggcacgccgttgttcacagcttcgccggcgacggcaccgaagccgatacgctggtcgatgatcttgccgggcacgtggcccttacggaagccaggcacgttgacctgctttgcgatttccttgcgagcctcgtcgagatacgggttgaactcctccgggtcgacggtgacggtgagcttcaccttggtcggctcaagattcctgacgctgattttcacgcttgcgctcctgaaaaatacggttcttcatatttctgccgttaggcaacctctatataatagcgcgacttacggactctgcaactagggagacctgccagtcgcgtgcgccctgttcgctgaggaatcgcgcgacgtcacgcttacgaggttcgtccgtccagcacaggttacgcaaatactgcggtttgatgacgatttccacaggcgtgcgcgtgtcctccgctatctgggagaccgccttgcgcaccctgttgagcacttgcagacgttccggataccgttccttccacacgcgaatcgatttgggagccgaggctgactgcgattcatgacgccgcgcggcgccgccgtccacgtccggccattcgcttggcggcagggcgagcgcgtcctggatgatgttcttccacatgctcggtttgattttgcgttgaatcggcgcgtaccgttcgaacatcttgtcctgttcggaatcggtatggatgcgcacacgttcgttgatggagcgaatcgaacggaattgcgcagcgttgtgtggtttgcgtttcgccacttcgataatggagctgtcggacaatagcagggtcggcgcgatgtcgtattcgcgcgcgagttcgtcgcgtcgggtccatagcgcgcggacgatggccagcgcctgccggtcacgcatgacttcagtgatgtgcgagacatgcatccagggaatcagatgctccttgcgtggtcccagaccttctttgagcgcgtaatcgaactcttcctgagcccattccatcttgccttggcgtttgagttcggcgcgcatcttcgtttcaagctcgatgagcagttcgacgtccaacgccgcgtaatttcgccagtcgcggggcaacggacgatacgaccagtcagccgcagaatgttctttggcaagggtcagtccaagaaaatgctcggtgacagcggcgagtccgaatcgtttcaatcccagcagacgcgcggcgatttccgtgtcgaacagccgttgcggttccatgccgagttcgtcgaatcccggaagatcctgcagggaatcatgcagaatccataccgcatctccgacggcacggttgaaatcgttccaatccgccccggccgcggcgagcgcctgcggatcgagcaggccgatgccggctccgtcgcgtttgaactgcaccaaccagtcctcatgcccataccggaagccggatgcgcgttccgcgtccgcggcaagggagccatgtgaggaagccagctcactgcaatagtcacggaatgccggcaacgtgtcgatcacgttgggcacgccttcgcgcggttccgccagcagcttcggctcatcagtcaacggggttttcctcctcggattgcgtcatggaccggaggaacgacgcccactgtccgacttgggagccggcgtcaaggcctccatcggcatagtctagtggagtccaagacacccggatctcgcagcccaccctgggcacgtcggggtcatggccgaatgctgtgttttgggtgactgtgacggtgccggatacatgttcggaatcgtttggattgagacgttccatcatcatgtcccagtacatgcccggagtcaggcagtcgtcctccttgtcgggcagtggcagggatgcgaaagccacgcaacgccagtgggagtgccagtcctctcggaatttgagcgagtacaggatcatgatccagccggatgcgtatgtttcatcgcattccaacgcgacgccgatgccgaagttcgccatggaattgggcaccggaatctcacggtatgtcatgcctttcaaacgccgcatacggtccacggaaagcaccgcgttccagacttggtcgggaacgccctgcggtcgcataagcatggtctgtggggcttcgccgcccatatccgcttccttgccatcggcgcgcgccacgttgcgcgcatctcgtggaaaatcaaagatgtctgccatagttcaaggctacgacagagaagggcatttcgtagtatttcgaaccactttgccacgcgtcgaatgtgaagatttttcagcgtatgaataaattggtccatgccatcgattcagtcggtggcatggaccgatatgaggcgttccgcatatccagcgaatatggggaagccattgagaggacgggcgtttagtacacggtgaagccgtgcgactggaactgctcgaccacacgttgtttcattgccgcggacgggcctttctggtcctccaacgggtatgggatgttcagcatgtgccacttcggacggccaagctggtggaagggcaatacgtcgatatgttccaacgcgtcgccgaaggtctcgcagatcttcgccacgttctcgacgttttcttcggaggatgtgaggcccggcacgagcacgaaacgcacccagatcttcttgcctgccttggccagacgctgtccgaagtcgatggtcggctgcaggatgccgccggtcaccttatggtaggtctcctcatcgccggatttgacgtcaagcaggcacaggtcgatgtcatccaccatgtcatcggtgtagctcgccccgaggaatccggacgtgtcgaggcaggtatgcactcccatctgcttggcggcatggaacacgcgtgacacgaaagccggctgcatcatggattcgccgccggagaaagtgatgccgccgccggtggccttgaataaatcggcataccgctcgattttcttgaccatggcttcgtagtagacgggcttgccgtcgcgcatcttccaagtatccggattctggcagtactggcagcgcagagggcatccgctcatgaacacggtcattctggtgccaggaccatccacggaagtgttgatgtcccacgagtgcacgaaaccgatatcgccgcttttcaacgccttgatgcggtcgagacggtccaagccgattggcgattcgaatccggacaggcctcccatcagcgtctgattgacgtagtccttggaatccctcagcatgtgtctggtcgtggaacggaaaatatgttcagacatcaatgtcccctttcatctgccatcccaatcatatgggaaaacgatatgggaaaagcgaaagggacgaagccacgagctccgtcccttcgcattaccgtcgtttcatgcggcggctttcatttggctgattgtgccgttcagtcgacgacagcgccctggtggaacgtacgggagatcacgtcgagctgctgttccttggtgagcttgacgaagttcaccgcgtagccggagacgcgcacggtcaggtgcgggtacttctccggatgctcgacggcatcctcgagctgctccttgcgcagcacgttgatgttggcgtggtacaggccgtggccgttgccggcgtccaggatgccaacgaggttgccgatacgctcttcctcgtcgcggcccagaccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttcttgtggccggacgggaaggcgccggtggccttgccgtattccacattggaggtgatggtcaggatggactgggtcgggacggcgtcgcggtacaccggcagacgcttgacctggcccatgacggtggagacgacccacttggcgatgtcgtcggcacggtcatcatcgttgccgtacagcgggaagtcgccttcggtgcggtagccgacgatcagatcgtcatcggcgccttcgacgtactcgttctcgtggcccggcgtggtcttggcgtccttgttgtagatcgggtagaccttggcgtacttgcatgcggacagggagtcggccgcgatcgacaggccggacatgccgcagccgagggtgcggtacacttccttgtcgtgcagagccatctcgatggactcgtaagcgtacttatcatgcatgtaatggatgatgttcagagccatcacataggtctcggacagccattcgagggccttctcgtagttggccttgaccttctcgtaatccagcgtgccatcggcttccggcttgatcgggtcgatgacgcccttgtcgatgacctgcatgccggtcatctcgtcgcgtccgccgttgatggcgtacagcagggccttggcggagttcacacgggcggcgaagaactgcatctgcttgcccacgcgcatcggggagacgcagcatgcgatggcggcgtcgtcgccccagtgggagcggatttccttatcggactcgtactggatggccgaggtgtcgatggagattcgggcgcagaagcgcttgtaggcttccggcagcttcggatcccagaagatggtgatgttcggctccgggccaggtccgaggtgctcgagggtcagggtgttgagcagacggaacgaggtcttggtgaccatggtacggccgtcgtcgccgaagccggcgtcggaccaagtcgcccagtacggatcgccggagaagatcgcgtcgtaatccttggtgcgcaggaagcgcacgatgcgcagcttcatgaccaggttatcgatgatctcctgtgcgtcggtctcggtgatcttgccggccttcaggtcgcgctcgaagtagacgtcgaagaaggtggagacacggccgaaggacatggcggcgccgtcctggctcttgacggaggcgaggtagcccatgtaggtccactgcacggcttcctgtgcggtctgtgccgggcgggacaggtcgaggccgtactcgttgccgaggttgatcagctgcttcagggccttgatctgctcgtcatgctcctcacggaagcggatccagtgctcgatctccggctcggtgaagtcgttgcggtacgggatggagtccttgtcgcgctgcttgaacttgatcagcgcgttcacgccgtacagggccacacgacggtaatcgccgatgatgcggccacggccgtaggcatccggcaggccggtgaggatcttgttgtggcgagctaccttgatctgcttggtgtagacgccgaagacgccgtcgttgtgggtcttgcggtacttggtgaagatcttcttgatctccggatcgggctccttgccggcttccttgatggcctgctcgaccatacgccagccgccgttcggcatcatggcgcgcttgcacggcacatcggtctgcagaccgacaatcacattgtcgacttccggggaatcgatgtagccggccgggaaggcgtcgatgcccgccggggtgtgggtgtccacgtcgtagacgcgctgcttgcgctccacggacagatagttgtcgtccagatacttccacaggtgcttggtcttgtcggtggcgtcagccaggaaggactcgtcgccctcatatggcgtgtagttcttctggatgaagtcgcggacatcaatgtccttctgccagttgccctcggtgaagccttcccaagccttagcctcaagttcctcctgggagaccgccgttgcatcaactgctgccatttccactccttactgggtgtcggttggcgacgcatcgttacgccgtcgctacttcacgattgtaacggcaatcatctgcgaaaagcctgaaaaccactcccgaaattagtgacataaatcacaatcgggcgtggttttcatatggaattcacttttcggaagatgccgagccgtccgctgaccagcgtttccattcgcggtcctgttcctcccatttgagattgcgttcctgcacgatcttccacgcgtcgagcgcgtcctcacgggttctgtacggccccatgcggtggcttgccggggaaatcatgcccaattccggctgctcggtgacggtgttgaaataccactgcttttccatatcggcttccttcggctctcgatgttctacttgcgatcgccgattattcgcggaatgcgttggtgaccggcagacggcgatcacgtccaaacgccagcgccgtcaccttcggtcccagcggatactggcgacgcttccattcggcgcggtcgaccaatcgcatgaccgtgtcgacggtcgcctcgtcgaagccgtcggccagcaggtcggcgcggccatgagcatgctcgatgtacatcgccaatacttggtcgagcagcgcgtattccggcagtgaatcggaatccttctgccctgggcgcaattcggcggacggcgccttctcgatcgagttgacggggatcatcacaccatccggcagcgcagtgcccgcgctcccctgctcgttgccgacgacatgcagaccgccgatgcccatgccggcggcggcagccttgttgcgccagcgggagatctcccacacgcgggtcttgagcaggtccttgatcggcgcatagccgccgaccgcatcgccgtagatcgtggaatagccgcatgccagttcggacttgttgccggtggccacggccagcagtcctttggagttcgagtaggccatgacgatgacgccgcggatgcgcgcctgcaggttctcggcggcgacgccttccagttccagctggttttggaaggagacgaacagcggctcgatgggctggatgtcataatgcgcgccgatattgcgcgccagatcagctgcatcgtccttggatccgtcggacgaatacatgctcggcatggagatgccgtacacgttctcgccgcccaccgcgtcggccgccatggcagccacgagcgcggaatcgatgccgccggacaggcccaggcacacgcccttgaaatggttcttggccatgtaatccttcagacccagcacgcaggcggtgtacacttcctcgtccggatcgggcttggctgcgatcgtaccgaccttctgatgctccgcggacgtgtccaagtcgaagaagctcagatcctccatgaacatcggcgagcactcaagcagggtgccgttggtgtccacaacgaagctgccgccgtcgaagacgaggtcgtcctggccgcccacttggttcaggtagatcatcggggcgttcacttcggccgcgcggcgcaccgcgaggtcgagacgggtgtcggttttgccttcctcgtatggcgaaccgttcatggtcagcagcaggtcgatgttctccttggcgagttcggccacagggccgccgtcctgccagatgtcctcgcagatggccacgccgatgcgcgcgccgttcacgtcgagcaccatggatttgttgccggggctgaagatgcggaattcgtcgaacacgccgtaattgggcaggaaatgcttgtcgtagccggcccagacaacgccgtcgtgcaggacgacgagtcggttgcgcggtttggaggtttcacggtcggtgcctacagtgccgaccaccacatatagttcgccgagactgtcggatgccagttcggtggcgagccagttggctttgtcccatgcggctttgcggaaggtggcacgcagtgcgaggtcttcgatggggtatccggtcaatgtcatttccgggaacacgacgacttgcgcgccctgccgagcggcgagatgcgcgtatcgcatgaccttgtcggcgttggaatcaaggtctccgacgcaggtgtcgatttgggcgagtgcgaagcgaatgtctgtcatagctgcctaacctaccgttgatttgttggatatgttgtgtttttacgattatgaaaattacgattacggcgttccgcacgtggcgtcacgacagttcgttgagcaccgtcagcgccgcgttggcgtagaattccacgccggcttgcagcgattcgtcaagaccgacgaaatgcgggctgtgccaatccgggcagccttcctcgccgttagatccgatgaaggcgaacacaggcatggtgacgggcatgaaatcgcagaagtcctcccccgccatcgacgggtggatgggttcgagctgggcgtaatcgcgcacgttgtcggcgactatcttggaaagttccgtatcggagacgagcgggttctggaaatcgtcccaatcgatgtcggcggtgatgccataaccggccgcaatggactggacctgttgcttgaagcgtttctccaccagttcaccgtcggacttgtggaagtatcgtacggtgccttggaagctcgccttgtcgggtacgacgttccacacgtggccgccgtgcatctcggtgatggacagtacgagcggatggaacggcgagacgttacggctcacgatggtctgcaatgcgaggaccatggtggcgagcgcctcgatcgggccggtgcccttgtgcggatagccggcgtgtgtgccggtggcgtgcagggttacatggaatttcacgcagccggccatcatcggttcggggccgacggcgatctgtccgggcgcgtagttcgggttgttgtgcgcgccgatggcggctgatacgtcggcgagcagtcccgcgtcgaccatggccttcgcgccgaggccaagttcctcggcgggctggaacagcagtttaatggagcccttgatgcgcttgcgatgcttggcgagccagaacgccgcgccgagcatgtacgacatgtgcaggtcgtggccgcagccgtgcatcacgccgtcgttgacggatgagaacggcagaccggtgtcttcctggatgggcagaccatcgatgtcggcgcgcaatgcgatgcgtggtcccggctggtcgccgcggatcagtccgaccacgccggtttcgagcggattgttgagcacttcgatgtcgtgtgcgcgcagcagcttctcaatgtaggcgctggtctcgtattccttgaagctgcgttcggggtgcgcatgcagatagtgcctgatttcgatgatctccggcgtgatttcgatatgttcgctcatggttgacgattgtaggcacatccggccgtttttcctattttcgtggtcgtgttccgtgccgtgcacgacgttttcgcatatatcctcgtaagctggataccgggtttgacatggtttttcatggaggcagcatggctcaggacatcaagacggcgtttttcgacatcgacggcacgttgacgagtttcgtcacgcatgtggtgccgcagtccaccgtcgacgcgttgcatgcattgcagcgcaatggcgtgaaggtgttcatctgttcgggccgcgcaccctcctacatgggcgtggtgcttgataccattcccgtcacgttcgacggcatcgtgggacttaacggccagtattgcaccacgcgcgacggtctcgactaccggcatccgatcgaccaggccgacgtgaagctgatcaccgactggcttgaaacgcatgccgacgtggtcgccaactatgcggaaagcgactacgggtatttcaatcgcacgaacgccgcattggaacgcacgtggaacagtctcggcaagaccgcgccgaaaatcgacgtgcatgatccgcgcgaacgcatcgcaaaccattccacgttccaaatcagcccgtatgtggacgagacgatggaagccgaaatcgccagcatgtgcggcaacgtgcgcggcgtcagatggcatcccgctttcaccgatctgattcccgccgatggaggcaaggcggttggtatgcaggtgatgctggagcatttcggttggacgaaagacaatgcgatcgcattcggcgacggcggcaacgatgtggacatgctacgattcgcgggaatcggcgtggcaatgggcaacgccaccgacgagccgaaagcggcggccgattacgtcaccgacagcgtcgacgacgccggcatagccaacgcgcttaagcatttcggcgttatatgacggtgtttccgcaagattatttacgattcacaagtctgtttttcgcatattcctgcggtttttgcgccctttataaataattccgataagcgcgcgacgtgttgccgtcacaggttcctctatattggtcaatcgttggcccgcaaccgcagtaagcgtccgggccgtgtagcgaaattgagagagaggaactcaaccatgcgtaacaagaagattctcggcgcactgctcgccgtcaccacgctcgcgaccttcggcctggcaggctgcggcaattccggttccaacggtgccgcctccaaggaggacgacaagaccatcaccgtggccgcctccccgaccccgcacgcggagattctgaacaaggcggtcaaaccgctcgtcgagaaggacggctacaagctggtcgtcaaggagttcaccgactacgtgcagccgaacaccgccaccgaggatggcgaggttgacgccaactacttccagcacaagccgtacctcgacaacttcaacaaggagaagggcacgcatctggtgtccgtggagggcatccatttcgagccgttcggcctgtacccgggcaagaccaaggagctgaaggatcttcaggacggcgccaccgtggccgtaccgaatgatgccaccaacgaggcccgcgcgcttctgctgctgcaggatgccggcctgatcaagctgaaggatccgaaggacatcaacgccacgccgaaggacatcacctccaatccgaagaacctgaagttcaaggagcttgaggccgccgtcgtgccgaccgtcatcaaggatgtcgacatcgcagccctgaacggcaactacgccatccaggccggcttcgacccgaccaaggacacgctagccaccgagaaggccgacggtctggccgcgaagacctaccagaacatcctcgtggtgaaggaaggcaatgagaacaccgccaagaccaaggagctcaagaaggctttgaagtccgacgaggtgcgtgactacatcaacaagaactacaagggcgctgtcgttccggtcttctaagacccgtttcggcagtaggagttcaatgccgcaggtatactaccctgcggcattcttgttatggaacacgattaggaacaggacattatgacgattcagatcgaccatctgcacaaaagctacggcagtggcgccgaagcgcatgaggtgctgcacgacattaacctgaccatcgattcgggtgaggtcttcggcattctcggctcgtccggcgcgggcaaatcgacattggtgcgttgcatcaacctgctggaacgccccacttccggcaaggtgctcatcgacggacgagacatcaccggcgtgaaaggcaaggagctggcggacgtacgcgccggaatcggcatgatcttccagaacttcagcctgtttcaacagcgcaccgtgctacgcaacgtgaccttcccgctggaactcaaccacacgccgaaagccaagcgtgaggaacgtgcgcggtatctgctcgatctggtcggtctggctgatctggccgaccgctaccccagccagctgtccggcggccagcagcagcgcgtggccatcgcacgcgcgttggccaacaatccgtccatcatgctgtgcgatgaggccaccagcgcgctcgactccaccacgacggcgcagatcctcgacctgctgcgtcgcatcaaccgtgaacttaatgtgacgctggtcgtcatcacgcattcgctgtccgtggcacgcaacatctgcgaccgtgtggccatgatagacggaggccgcattgtggaaatgggcgatacggaagcgctgttcgccgatccgcacagtgacattctgaagactttgatcgccgacgcgaaggtgacgaaccatcggcatacgcacgaaacggcggatggcgcgaagaatgggacggccgatgattccgcccagaaagaggtgaagtgagatgggacaggtggtttcgcaattcatcgccgattatggcgaactgctggtcgaaggcgtgcgtgacacgatcatcatgactgctgtggcgacgctgctggcatatgtgatcggcctgccggtcggcgtgctgctcatcacgtccgcgaaaaagggcatccgtccgaatgcaccgctcaacaccgtgctcggctggatcgtgaacatcgtgcgttccgtgccgttcatcattctgctggtggccatcatcccgctgacccgactgattgtcggcacctcgctcggcgtgccgggcgccatcgtgccgctggtcatcaccgcggctccgttcgtggcgcgcgtggtggaacagtcgctcgccgaagtggacggcagtctggtggaggccgcgcaaagcttcggtgccagcaacctgcagatcgtgttcaaggtgctgctgttcgaaagcctgccatcgctggtgcgcggtgcggcactgacgttcatcactctgttcggcttctccgccatggccggtaccgtcggcgcgggcggcctgggcgatatcgccatccgttacggctaccagcgttaccagtacgacgtgatgaccgttgccgtgatcctgtgcgtcattctcgtgcagatcgtgcagaccatcggcgacgtggtgtccgaccatatcgaccatcacgagcgttgagccagcacattcgcgttccttatgaaaagcgggtccaaacgtttgttgtttggacccgcttttcgtacgcggaaagagacgctgctcgtagacgattacttgttgagctcggccttgaccagaccggccagcttgccgccatcgatggttttgccggcaagcgcggcacgagcggctttgacgacgcgacccatgtccttggggccggccgggttcacttctgccacggcgtcggcgacggctttggcgtagtcctcgtcgctggcggccgccggcaggaaggtttccaggaaatcggcctcggcggtttcgggagcggccttgtccgccagtcccttgtcttcgtacagtttggcggtctcacgacgggtcttgacgcccttctggatgaccttgagcacttcctcgtcggtcgcttcgtgaccgttggcgatctccaggttctggatgtccgccaacgtcaggttgatcgggttgagcttggccttgtccttggctttcatcgccgcgatcttggctttcttcagcgtgtccttcatcgacatgttcgttcctcttttcttgaccgttcgaacaccgtcttaatactacgcgtctaccaatccgccgtcctgtatccgtgccgtcggcatccacgccggtctcaagcccatgagacacttggagccatgactacagttatcatgcgcacctccgaaggtgacatcaaaatcaacctgttcgacgacgaaaccccggaaaccgtggccaatttcctcggccttgccaccggcgagaaggaatggatcgatccgatgaccggccagccttcccatgagccgttctacaacggtctaaccttccaccgcatcatcaaggatttcatgattcagggtggctgcccgctgggcaacggcaccggcggcccgggctacgacttcgacgatgagatcgttcctgatctgaagttcgaccacccgtacctgctggccatggcgaacgccggcctgcgtcgtggcatggacggcaagatccacggcaccaacggttcccagttcttcatcaccaccgtgccgaccccgtggctcgacggccaccacaccatcttcggcgaggttgcggatgacgattccaaggcagtggtcgacaagctcgaagccgtgaacaccgatcgcatggaccgtccgaccgagccggtcggcatcgtgtccgtggaagtgctcaagtaagcgtttcccgcacagccgtacaatataggaaagcccctcgattgaggggctttcttcattttatttatagaggcgtttgcttgcaatcaccggcttatgtgattcgtcaacatcacattttgcgcagtcgcggttccgcggaatccttcgcgccggtgatgcggtacacgtcgaacacgccttcgattttacgcacggcggcgagcagagtgttcagatgctgcggatcggccatttcgaagctgaattggctggtggccacgcagtcggtgccggtggaaatcgagccggagataatgttcacgccgtggtcggacagcacgcgtgtcacatcgctcagcagatgcggacggtcaagcgcctcgacctggatcttgaccatgaacacgcccttggtgctggtccactgcacatccaccacacgttcgggctggcgtttctccagttcgagcatgttctggcagtccacgcgatgcacggacacgccttggttgcgggtgatgaagccgatgatcttgtctccaggaaccggcatgcagcatcgggccaatttgacccagatgtcacccacacccttaacggagatgccgagcgagctggtggtcttcttggtacgctccacctgcttgagcggcaacgcctcctgctcgacttcctcatccacctcgtcactgcccgcgtcacggaccagatgcgagatgacgttctgcgtggagatctggccatcaccaatcgccacgaacacggcttccgcgttggcaaggttcaactcgtcggcgacacccaccaatgcttccggagtcagcagcgtggtgattggcaggttgcgcttgcgcatggcgcgcgtcagctcgtcacggccttcctcgacggcttcggtacggcgttccttgctgaaccattgacgaatcttgttgcgtgccttcgggctcttggcgaagctcagccaatcacgcgacggacctgcggattcggacttggatgtcaatatttcaacggtatcgccattctcgagcttggtatcaagcggcaccaatcgtccgttcacgcgcgcacccatggtacggtgaccgacttcggtgtgcaccgcataagcgaaatcaatcggagtggcttcggcgggaagcgagacgatcttgcctttcggcgtgaacacgtagacctctgccgcgcccaaatcctctttgagggagccaaggaattcgtcggaatccggcgtttcgctcgtccagtcggcaagttgctgaatccatttgaggttgtcggcctcgctcagctcctggttttcgccacgcttgcggtcgaacttgtcaggcgagctcaacgcgcgtccggcttggccgttctccttgtacttccaatgcgcagcgatgccgaattccgcgcggcggtgcatgtcccacgtgcggatctgaatctccaccggcttgccgccggggccgaccaccgtggtgtgcaggctctggtacatgttgagcttcggcatggcgatatagtctttgaaacggccgggaacagggttccaccgcgcatgcacggcacccaacgccgcatagcagtcctgaatcgtgtcgacgatgatacgcacgcccaccaaatcataaatgttggcgaaatcgtgcccgcgcacgatcatcttctggtaaatggagaagtagtccttcgggcggcctgtcacataggctttgatgtgctgttcgtcgagatcctcattgatttcggcgagaatctgcttcaggtacacgtcgcgttgtccggcgcgacgggccaccaataccacaatctcgttgtagatcttcggatacagaaccttgaagctgagttcttccaactcggttttgatggcgttcatgccaagacggttggcgagcggcgcatacacatccagcgtttcacgtgcctttttctgcgcgttcgactgcttgacgtaacgccatgtgcgggcgttgtgcacacgatcggcgagcttgaccaccaatacgcgcacgtcgcggctcatcgccaccaccattttgcggatggtctcggcctgggcggaatcgccgtattccattttggaaagcttcgtgacaccgtccaccaggccggtcaccgtgtcgccgaattcggcgcggcattcgtcgagcgtgtagtcggtgtcctccaccgtgtcgtgcagaaggcccgctgccacaaccagcggccccatgccaagatcggcgaggatctgcgccactgcaagcggatggatgatgtacggttcgccggatttacgccgttgcgacgaatgctgggtgacggcgcgccgataggctctcgcgagaatgctcatgtcctcgtcgggatggtggtattcgcacatcttgaggattggttcaagcgggtcaagcggattcgtgctgatctcgcagcccaacattctggccgaacgaacctcatgatccatgtcgctcatttcgctcctcctcgcttggaatgtaccctatagtacccgcgcatcaccatatgacggatgtatccggccgcgtgttgcacggccggatacatcctcggtctttgtgtattgcagtcccgtcaggacgcaacgccggttgatccgaagccacgttccgcgcggtcggatccgggcagggtctgcgcctcgatgaattttgcctcgacgtagcgttggatgaccagctgtgcgatgcggtcgcccggatggaacgtcacggcgcgttccggatcgaggttgatcaacggcaccttgatttcgccacggtacccagcgtcgatggttcccggcgcgttaagcaccgtgacgccctgcttgacggcgagtcccgaacgcggatgcaccagcgccacatagccggcaggcaatgcgattgccgttcccgtgggcaccagcgcccgctggaacggcttcaacgtcacttcttcggtggtgcgcaaatcggcaccggcgtctccggcatgggcgtaatgcagctgagccggctgcccgggatccagcgactttaccagaacctcgacgttttccggctcgttgtatgcctcgtcgaacgccatcaggccgcacactccttgcataccggctgtccgtcgtcggtagtgtaggcaagctggctgcgatgcttcaccaggaagcattcggagcagatgaactcgtcgccctgcatcggaatgacggtcaccgaagcgtcctcattgctcaaatcggcgcccggcagctcgtagtcttcggcaatggcgttctcgtcatcgtccatatcgttggaattgttctgagaacccttgctcaaagcctggagcgactcctcgtcctcgtctttgttgcgcggggaatcataatcctgtgccatcgagattcctttcgtcatctatggtgcttatgcgccatagaatacatgacttttcccccgctaggatacacgaattgaaatactcgtaaaatccgacacgtggggcacaatagaattaatagaaaaatctaagggaaagtggtgtgttgtgcctgagaatgcgctcgaagatgcacggttcgatcatgtgagtgaaaccggtgagctcgtctttgtttcaggtgccggcaaattcgccgtcaaggtcgatgaagcgcttgaaagagccattttggaggcaaagcagattcgcaccgaaacccaagaggagcgtcagcagcaagcgccttccacgctgccgatctcccaaatccaatccttgattcgagccggagccaatccgacccgcgtggcggagcgatattcgttgagcgaagcgcttgttcggcgtttctcggcggcggtggaaaccgaaaagcaatatgcgatcgaacagttcctggcggttcccgcgccgaaggaaagccgtgtgcgcacgctttccgaactgatcgaacgcactttcgccgcagcccacgtacggttggaggatgtgcggtggaaggccaccagacgcggtttggaaccgtggaagattaccgcggagttcgattccgcaggtcatgccgcccgtgcggaatggtcttggaacatgcatgacaacgcggtcaactgtctgaacgcaacggcacgcaagctcatcggcgaacaagacacgccgacggaaggacacgccgagaagcaggtcgaccagaattttctcgcatcattgaatttgccgggcgattccgcacgttccgcacgtatcgaacagacggtgtccgcttggaatgctccggaaccggttgcaccacaagccacgaatatcaagaccaccgttgagactcagccatcggcgaccgttccgctgccgaaccgtccggaaatcgcgacgacgcagcaccccgccccttcaacgacggaacctgcccaaaactcgcaaaacacgcaatccgccggcgagcagcagtccgataagtccaagatggcatcatccgatcctcatagtcagagcaccaccaaatcgaagcgccgtgcaggacgctccgcagtgccgagttgggatgaaattctgttcggtgactgattaacgttccctaacatcccacggcaacatccgttcagacgttcggatcattcgatcaagccacgtcaatcaggcatggaatatcagattccatgtaggtcagcgacccgtgcacgctgggcagatgcatcgccttctccgcctgtgtgcgggaatcgacaatggtggtagagcccgcagcggagacgaccacatcgccgatcatcgacttgacgcgttcatcgactggtccgtagacgccttcctcgattgcctgccggcgggtgcgcacctgggcgcgctcccccagcacgtcacgccaacgagcggcgatgtcctccggattctcgccatcctcgccataaagcatgacacagcgtggttcgccgccgacattcgcgacgccccgcatcagctggggttcggacgctatgtcgatgcaggcttccgggtcggcggttatcatgccatgatccgccacgatgacgatcagcgtgttcttcggcacacttcgacgcagcaaagacaactgggcgtcgatacgctcatatgtgccgatccacttgtcggagtcccagccgtaattgtgtccgatcttgtccacgtcgcgcaggtacacgtatgtcagtccgggcgtgttcgccgctttcgccgcggtcatgatacgtcggcgtggatcgtcattggagatgtagtcgctgccacgtaacgccgcctgagtcaacgcggagaacgcgaatttcggcagtcccgaactggtgacgcgaacgtcctgttccgccaatcgttcgaatatggtcggctgctgttgcagtttcagcggtgcgggcgcgtttttgaaagagatgagctggcagatttcgccattgtcgggattgagctgcgtatatcccgtcatgccggttaatccggggcatgtgccggtgccgaacgtggacattgcggccacggtggtgctgggcatgcatgtggcgattggccgctggttaacgccatccgccatcagcgaccgtagatagggtgaatgtcccaatctcatattgatgttccaatatccgagaccgtccaccaggaccacgactgccgaacgcgcgtccggcaggccaagtgcctcttggagtcgtttcggatcggcatggatggccgttggaatcggatgcccgatggcgctggaaatggcgggaagtaccgaggataggtgaagagcaccgccgcggccgccctcatccggcagttcgtcgccatatcgtgccggactggtcatggctagcagctggtcgatttcgggcacttcaacactcatggttcccattcaagcaccgcggcagtaccagctggtaatattgctaggttgattaccataacctttccgtgaggagaaccaccgcatggtgtcgcaccgcaaaccggcaaaaccagcctttgacccgcgtacggtcaaggagaacatcgtcgaaacgccgttgaacgaggaaatgagcaagtcgttcctcgaatacgcgtattcggtgatttacgcccgagcgctgcctgatgccagggacggtctcaagccggtgcaacgacgcatcatctatcagatgggtcagatgaacctcaatccggaccggccgtatatgaagtcggcgcgtgtggttggcgaagtgatgggcaagctccatccgcatggcgattccgcgatttacgaggcgatggtacgtttggcgcagccgttcgcgatgcggctgccattggtggacggtcacggcaatttcggttctctcgatgacggtcctgctgcttctcgttataccgaggctcgtatggcgccggccgcgttgggcatgaatgccgatatcgccgaaaataccgtcgatttcacgccgaattacgataacaagcttcaggagccgactgtgctgcctgccgcgattccgaacctgctggtcaatggtggttccggcattgccgtcggcatggccacgaatatggccacgcacaatcttggcgaggtggtggccgcagccaagcatcttatgcgccatcccgacgcgacgttagaggagttgatgcgctacgtgccgggtccggattggccgggcggcggcgtgattgtgggccgcaagggcatccgcgaggcgtacgagacgggtcgtggcgcgttgaccacgcgttccgtgacgcatatcgaaaacgtgacggctcgcaaaaaggccatcgtcgtgacggaactgccgttcatggtgggtccggaacgtgtgttggaacgtatttccgaaggtgtgaagaaccgtaagctggacggcatttccggtgccatcgatctgactgaccggcataacggcacgcgcctcgtcatcgaaatcaaaaccgggttcgatccgaacgcggtgctggcgcagctgttcaaacacacgccgttgcaggacaatttcaccatcaacaatgtggcgttggtcaatggccgtccgcacaccatgggattgaaggaaatgcttcaggtgtgggtggaccatcgtcgtgtggtgatccgccgacgcagtgaattccgcaggaagaaggcgcttgagcggctgcacttggtggagggcttgctgctcgccatggtggacatcgatgaagtcattcaggtgattcgctcttctgatgatgccgaggccgcgaaaacaaagcttatcgccgtattcgatctggatgagattcaggcacagtacattcttgacttgcggctgcgccgtctgaccaagatgagtcgtatcgagcttgaggcggaacgcgacgacctgaagcggcgtatcgaagagcttgaacgcattcttgcttccgatgaggcgcttgacggcgtggtcattgacgaaatggatgacgccgtggccaaatacggcactccccggcgcacggtgctgctggatgaggatgaggaaggcaatttgacgcctgttgtggcgcatggcgatgatggcgtctctgcaaacgcgatggctgccgcgcgcgccgccgcgaccgtatcctccgcagcagccgatgtcgccgcagccgcaaaggccgcaaagaaagccggcgatgagaatgccaccgcatcggctctgcagattgatgacgagccgtgcgcggtgatgctgtccgccacgggcctgatcgcacgcacttccgaggatgcggtggaacgttgggagaatcgttcggcttccgacggacgcgccaaggatgatcagatcgtttcgatgttccgcacgtccacacgttcctcatacggcttggttacttcagcgggtcgtctggtgctggcccatgtggtcgaattgccgaaggtttccgcggatgggccgctcagtgtcacgggtggtgtgaaggccgaggaactgctgggcatgacggagaacaccgatccgatccgcggcgaacgggtgattgctgcgattgatatgccgtccacggatgacgacggtcagcttgttcctttggcgttgggcacccgcaacggcgtggtcaagcgttggaaccgtgaatctccgaccacaatggattcgtggagcgtcatcgatttgaaggatgatgacgaagtgcttgccgctgccgaagcccgtgatgaggatcgtctggtgtttgtgtccaccgattcctcgttgttgacgttcgaagcgaagaatgtgcgtccgcagggccgtaccgctggcggcatggcgggcattcgtctggctgaggggtgttcggcggccgcgttcgcggtggtgcctgacggcaaggtgacatggaattacgaagaaggcgagaatggactgttctccgcttccggagccgtggtgttgacggttgccggcgattccgaagcgttgcctggcactgaaaacggtgccgcgaaggtcacgccgttggagatgtatccgacgaagggccgtggtacgggtggcgtgcgttcgcagcgattcctcaaggggcaggatacgttgattctcgcgttcgtgggcgcgtatccgttgcatgcttccacgcaaagcggcgctcctgtggaattgccgaagcctgatatgcgacgcgatggttccggtacggatctgtcggcgccgattgcggtggtcggctgattcgacgaaatcgattggcggggctctggactggttcttcttccggttcagggccttcccgttttgcgcacttgggccgccaggttgaatgagcaggctgggtgaaagtgcctccggcttggttcagccatatagcttcatgccttgtgggctgtccacgaacccggcagcatgcagcaaacgtctgtattcgttgcgttccttcaatgattcaccgttcatttcggcgaagctgacgctgcccttggactgatgctgcaatgcataggcaagttccgtacatgccggctgcaatattcgctcgtcatcggtgaagctgacgattctgtggcttttcggcacggcgaacagcaccggcatgccgtggtcgagcacgatgaccgattccgctctgcacgccggtttcatatggtgttgttcgggccatgtgatcgcggagcctgtcaggttggccgggtcggtcacgtcgagcgccacgcaggattggctgcgcgcctcgtcgtcgccgcgcaaggcgtccactgtgtcacgtccggcgaattgggccgctccgaatcctttgacgaacatgcctctgaccagattgccgtgttcttccatacgtttgagtaccgggtatagtccggagaatccgcctgcgacctgctccttgtcgattagcggagcggcgatcacgccatatcggtcgagcagcgattcgatcaatgcgatgtcgtattcctcgatgccggctgttggtttgccggcggtatcgtccgtttgatccggtatcgccattggactggtccgggacgagtcgaccgcggaccataatccaccgagcgtcgccggtgtcgaggcgtggatccgtacgcgtctgcgtgcggcagtgcgtggcgcgcgcactgaaaccgtgccttgagtcaaggcccgaacgggagcgaatgaactgttcgtcactttgccttgccataccaaggaccacaaggcttcctcgaactggctttcgccccatgcgggaaggatgatttcccctgtttcaggattcacgttgacttccgcatgttcctgccagatggctttggcggctgtggaaagctgccgcgcatggaaggctcccccattcgataatacggcaagtatcgtctccggcacggtcatggttccggcactataggcattgttctgcgattgttcgccgggtttcgtcagcagccgtgaatcagctggatggaatgcgatgccgccggcttccttggcgttggaaccattgattttggagccgacccataccacgtctccggatgcgagcaattcgtccaacatactcggttggtagtcgcgaacgcgtgcggggaagaccgaggattcccaaacggaggcgttgaggtatatgccttcaagctgttcgatcacacgcatcagcccgtcgacgctttcatatcgggcgccacccacaggtccgacaccttgtctgtccaacaggaacgcctgatagacggccggttccaccggcttgatggctttgcgtgccttggcaagcgaaagcgcgcggatacgccgaaacacgtctttgtggagccattgctggggcgtttgccgaggtgaccgttccgatgctgaatcatcggaaccattggcgtccgctccggccgcatcatcgacgaaatggcctttcagcagttcgcctttggcatgtaattcatccaacatgcgtacgccttggacagcgtccaatcccagttcggcgatcatctgatccgcggtgaatgggccatgcgttttgacatatcgcgccacacggccggcaatgtcggtctcgtccaaatcgttccagaacgtccgtccggcaagctccttcccaacctgcgcgatgacgtcggcatccaacagcgaagccatgtccgtggctcccagaagacgttccagcacttccgggtccatggacagcagttgcgtgctgcgttcggcttgcggcacgtcgtattggtacatgaccgcgcccacgtatccgaacagcatgttttccgcgaacggcgacggcgtttccgtgacggtctcgctcaaagagatgacgccggagcgtaatccggacatcacatgtttcagcgcgggcagatcgtacacgtcctgtaggcattcgcgtgcggtttccaacagcaacgggaagttcttccgagttcgggcggcgttgagcagttgcgccgcgcgcagccgctgctgccataaggggacgcgtctgccggggttggcgcgtggcaggaacagcgatcgcgccgcgcattctcggaatcgtgcggcatacagcacgctttcgccgacttgcgtttcgatgatgcgttgcagctcttccgtgtcgaacagcagcagctcgcggatcggcaggttgccgtcgccgtccgggaggcggatgatgatgccgtcgtcggccgcgtatacctgcccatcgaacccgtatcgttgtttgatacgtgtggtgatggccatggcccatggttcgtgcacgcgtctgccgtatggcgagtggacgatcacacgccaatcgccttcttcatcctggcagcgttcgacgaccagctcacggtcgttgggaatcgttcccgtggcggcgcgctgttcggcaagcaggtcggcaagattgccgatggcgttgtcgtccaatccgtcacgacgtagacgtgcgattgttgtcgtgtcgaatcggctggtcttgtctcctgcgatgccgtccgagacttccgcgcgtagtccttgcgccatatcgcgtatgaatcggccttgggaccgtccgaatgccgcgtcccgcccgtcgccttcgccatgccagaacggcagtcgggcggtacgccctggagcaggaaccaccaccacacggtcccgggtgatttcctggatctgccaggtcgatgtgccgagggtgatgacgtctccaacccgggattcgtacaccatttcctcatccagctcccccactttgcgtgggcccggtccggagccttcttcgggaagcaccacggtgtaggttcctcggtcgggtatggtgcctccgctggtcacggccagtcgttgagcgccagggcgcgcggagatgagacccgcctcttcgttgtattgcaatggaggtcggaaggcggagaaatcctcgccgttgtaggcaccggtcatcatgcccatcacagcatcgaacatggttctgtcgagatcttcgaatggcgcggccttgcgcacggtcacgtaccagtcgtctggtttcagatcatccatcgccgcggcggcgacggtttgctgggcaagcacgtccaagggggtgcatggaatggtcagtgtttcgatgtctccggagcgcatgcattcgatgcttgcggccgtgccgatgatttgctctcgtgtaatcgggtagaacagtgcatgcgagactcccccgaccttgtggtcggcgcgccccacccgctgcaatcccgaggacacggacaatggcggtgcgatctggatgaccagatccactgaacccatgtcgatgccgagttcaaggctcgatgtggcgaccacgcaacgcaattggccgcgtttgagctgctcttcgatctgtttgcgccggtctttggaaacggaaccatgatgcgccatggcgatcgcgtcggcgtccgcatgcgaggagaccagcatggtggtggatccgaccacggaatcgtagtgtttggcgaagccttcacggccttccggggagcccagatccggatacggctgggtggaatcactggctgtggactccggctgggatgcgttgtccgacacactcaagtccgttcggccaagcctacggtcggacagcgcatcccgccctgcgtccgctttgacggcggtttcagacccagttttccgggatgtgcacaattgcgcatacaggtcgttgagccgtgcggtgagtttttccgcaaggccacgggagttgacgaacacgagggtggtgtggtgtttcagcacttcgtcaagcacgctgcgttcgatggccggccataccgaacctccggttgaaacccgtgaggtatgttcgtctcccccgaccgaagtcagtcctttacgttccgccaatgcttccatggcaggactcaccccggaaatatgcgtggtatggcggttcggaagtttcacggcgcctgccctccgccctgcgtcgtcggagacgggatcgcgcatggccgaaagcggttccaccactttcagatccatgtcggggtgcgattcgggtctgatgacgcgtaccggccgtatgccgccaaggaaacgtgcggcttcggccggcggttccacagtggcggaaagcccgatgcgttggacagaccggccggcaaggctttccaatcgttccaagctcagcgccaggtgcgcgccacgtttggagcccgcgatggcgtgcacttcatccacgataacggtatcaacggcggaaagtatccgtcgcgccttggaggtgagcagcaggaacagcgattctggcgtggttacgaggatatccggcggatggctgacgattctgcgccgttcctgcggcgtggtgtcgccgcttcgtatgcccacgctgactttcggcgatggcaatcccatcgcctcgcactgtccggcgatgccggccaatggcgcttggaggttcttggccacatccacgcccagagccttcaatggcgaaatatacaggaccttgacgccgcggacgggtttgcgtttcttggcattgcaatcggattcagccgtgccgtccccaccgccggacgtccgcaataagtcatcgccctccttcgtcatcagacggtcgattgcggaaaggaaggcgcacaatgtcttgccgaagccggtgggcgccaccaccaatacgttctcgccggaacggatggccggccatgccaaacgttgcgcctccgtcggagcattgaacgcatgcttgaaccaggccttggtaggctccgagaacaagtccatgcattcgtacatacgttcgattatggcatcgccttcagacatcatccacaaccggcggaaagctcgtcatccaccgtcgtcggctcattcgagcacaccgcccggctgacacattcgagcgtctcacatatggcgtcgtcaggcggccgcacggtcgccgcacttgcggcgcaaagtctcatgcatggcgaccatcagcgccaggaacaccaccagatagaacgggaacaggttgaccgaaacatgttgcgcgatcagcccgaacagcggcggcatgcacatcgatcccacataggcgcaagccatctgcatgccgacgatggcctgcgatttgtcctcgccgaaataagcaggagtggaatggatgacgcacggatagatcggcgcgcagcccaaaccgatgaccattagtcccgcgatggtgccgatattgtgcggcaacggcaggagcatgatgacgatgccggtcagcaccaacgcctggccaagacgaatcatggccggatcgttcagtttcatggtcaggaaaccgctggcgagacgtccgacggtgatgccgatgcaaaacaggcttccccacatggccgccgtggtcttgtcgatgcccttgccaagcgccatatagctgctggcccacaacatggcggtcgattcgagcgcggaatagcagaagaacatcacgaggatctcgcgggcgccacggatggcgagcacaccgcgaataccaagcggcttgcgccggtcagctgtttccccttccgattgctcggactgcgcggattgcacggaagaggtttcactcgtccgctgcggttcgacggtcttacgcgccttccacaacggcaggctcagcaccagcaccgcggtgagcacgacctgcagaatggagatggtccggtagccccacgcccagccatggccggcacccaatgcgcttgccatgatgtacgggccaagcagagtgcccaagccccacatggcgtgcagccagctcatgtgacggctttcgtagtggattgccacatagttgttgagcgccgcatcgacgccgcccgcgcccaagccgtacggaatggcgaagagcagcagcatccagtaattcggcgagatggagaagccgaacaatgcgaacgccgttaacgcaacggacactgccgtgaccttgcctgcaccgaaccgcaaggtcatgcggtctgatagcagcgcggacacgatggtgccggcggaaatcgtcatggaaatgccacccgcccaggaaatcggcgcatgcaggtcgccgctcatcgtcggccatgcggcgccgagcaccgcgtccggcagacccagactgatgaaggcgatgtaaatcacggcgagcagcagattggccacagtcagctccttgtatgttttatgtttgcggcaataaaatcacgaaaatactccgctattttatccaaagttacctaccaaacggtattttgtatcttgcactatcgaccgacgtttttgcattatcgtgcatacacgaaaagcgggtctccgccgtaacgcaagacccgccaatcgcaatcgccatgcaatatcaggtgtcgatcttggaacggtcgaaatcgtcggcgttctccacgatgaacgccttgcgcggcggcacgtcatcacccatgagcaggctgaagatgtggctggcctgttcggcgtcctccatgcggatacggcgcagcatgcgggtgcgcggatccatggtggtatcggccagctggtcggcgtccatctcacccaaacccttgtaacgctggatgtcctcgttgtagccgatgtgctttttatcaagctcggcgagtttgcctgccaactcatcatcggaatacgtgtagatgtactcgcccttatgcgtacccgtcaacgcgatacgatgcagcggcggcacggcggcatacacatgaccgtattcgataagcggccgcatgtaccggtagaacagcgtcagcagcaggatgcggatgtgcgcgccgtcgacatcggcatcggtcatcatgatgatcttgttgtatcgggcctgttcgatgtcgaagcttgcgccggatcctgcgccgaccacctggatgatggctgcgcattccttgttggacagcatctgcgcgagcgatgccttctgcacgttgagtattttgcctcgaatcggcagcaacgcttggaaaccggaattacgggcggccttggctgtgcccaatgcggaatcaccctcgacgatgaacagttcggccacatcgtcattgccgggctggcagtcggacagtttcggcggcatggacgcggattcaagcgcgttcttacggcgtgtgacttccttggtcttgcgcgcctgcacgcgggcatgcatttcgccgacgattttctccagcacgcggccggactgttccttgtaaccgcgtttggagccggtaatcatctcaccgaactgcttatcggtcattctggagacgatcggcttgacttgcgcggtgccgagcacgtccttggtctggccttggaactgcggttcggcgatgcggacggtgacgacggccaccagaccggcgagaatgtcgtcacgttccaccttcatatgggaatccttgagattcaccttgagtttgcgcgcgttgtcctcgatggccttgcgcacctgcttggtgatgccttggaggaagccgtccacgtgcatgccgccgccgggcgtctccaccacgttgacgaagctgcgcatggtggtgtcgtagccgttggtccatcgcatggcgatatcgactgcgcaatcacgcgtcaccttctgcgcatgcagttcaccatcgtctccgaccgcctgcgtttcttcaacatacgtgtcctcgccggcgatgcgccaaatatcggagaccgcttcgcctttggacaggaagtcgacgaaatccttcacgcctccggtatggcagaattcttcgacgcgcgcatgcggatatttcggctgcacgggttgggaaacggtttcctgcgattgcgtggcagcatcgttttcttgcgattcggctgattcatcagcttcggctgaatcctcctgcagtatgtcggcagaggttccgatatcatccgtttcagcggacgtgttctcttccgtcacctgttcgatgacattgtcatcgacttccagcatttcgtcaatggactcgtcgccggtttcgggaatgttctcgtcgatgacggtgattttcagccctggcaccaggaaactggtctgccgtacacggtcgatgagctggtcatagctgaattcagcggtgtcgttgaaaatctccggatccgcccaatagcggatgcgggtacccgtggtcttcggactgactttgccgatgatctcaagttcggtgggacgattcttgcgcgtcttcttgaatggcgaatcgggagacgggtgttccggatcaacgtcggaatacactccggggtggccctgatggaaagccatgtggtgggttttgccgtcacgatccacttccacgtcgagacgggagctcaatgcgttcacaacggatgagccgacaccatgcagaccgccggaagcgccatacgaggaattgccgaatttggcgccggcatgcagcttggtcagcaccacttccacgccggtgagcttggttttcggctccacgtccaccggaatgcctcggccattgtccgccacttcaacggaaccatcgtcatgcaaggtcacgatgatgtggttgcaggctcccgcaagagcctcatcgacggcattgtcgatgatctcccacaggcagtgcatcaggccctggctgtcggtcgtgccgatgtacatgcccggacgtttgcgcaccgcatccaagccttcgagcacggtaagactctcagcaccgtaattatccttagccatgttccctttcaattgtcgccttacaagacatgaagtcgagaaaccctgcgttcatgccggtttctcgacttcatttactcgcgtctgattactatcactggtccaggaagtcgcgcagcgtctgcgaacgggacggatggcgcagcttggacatggtcttcgattcgatttggcggatacgttcgcgcgtcacgccatacacacgtccgatatcatccagcgtcttcggctggccgtcctccaaaccgtagcgcatcttgatgacgccagcttcacgcggagacagcgtttcaagcacctgcttgaactgctcctgcaacagcgagaaggcgacggcatcggacggtgcgatggcgtcggtgtcttcgatcagatcaccgaactcggaatcgccatcctcgcccagcggcgtgtgcagggaaatcggctcacgcccgtacttctgcacttcctgcaccttctcgaccggcatgtcgagctcgcgggctagttcgtccggcgtaggttcgcggccgaggtcctgaagcatctggcgctgcacgcgggacagcttgttgatgacttccaccatatgcacaggcacacgaatggtgcgggcctgatcagccatggcacgggtgatggcctggcgaatccaccatgtggcgtacgtggagaacttgaagcccttcttccagtcgaacttctctacggcacgaatcagaccaagattgccttcctgaatcaaatcgaggaacagcatgccacggcccgtatagcgcttggcaagagagaccacgagtcgaaggttggcttccagcagatggtccttggcgcgcttgccgtcgttcgcggcccacttcagttcacgccggcgcttgaaatccatcttgtcggattccgtgtccagcagatgttgggcgtacagaccggcctcgatgcgttcggacaggtcgacttcctgttcggcgttcagcaggttcactcggcctatctgcttcaggtaatccttgaccggatctgcggtggcgccggctgcgatcacacgacgcttcggattgccggacggcgtcagattgtcgtcgtcatcatcgtcacgcaccacgaaagcgcctttttccttgggctcttccggctttttgcgcttgtcttcgtcatcgtcttccagttcggaatcgtcatcctcgtcgatattgtcctcgtcgaggtcgtcatcctccccttcgtcgtccacgtcatcaaggtcatcgtcgaaatcatcaagatcggcatcctcgacgggatcgtcttcaggagcgtcctgctcgatcaggttctcttcttcttcttccgctttcttgcttttcttggcggcggaggtcttcttcgcggccgtcttgcgcgacgtcttcgtagcggtctttgaggactcgctcttcttggcagcaggcttgcgcgtggaggccttttttccggaggtggtcttttcggtcagatcagtctgttccgtatttaccgtcgtttccttggtggccaaacttatcctcctattgatcccgccggaagcgtataccatatggacccacttctggcaagggcaaatcgtcaactatgtgagttaaccatcttgcgaggacgattattcccgcgtgttgagctcaccatgcgcaagtaccgcttcctttcggcgtgttgctctatgtctcttcggcccatgccggtccgatatgacgatgcgccgcggagcagatgatcgccgcgagcgaacaattctcatccaacgcgagcgcacgcatcgcgcacagcatggcgcgctcatcgcccatccaccacagcacataactgatgatggccaatggctgcacatgataccgttcggggaccataccgatgatgtcgaacatcatgttgacgccgttgtcgcaacgtttcgtgtcgggttttcttgatgcgtcacggaacgatccgttgagggattcctccagatgacgcgtgttgccgggaagtgtcggattggccatgaatcccatgagaaagtcacgtgacgaacgtcgttcatccacgatgatggagaccagcagcgcgtcacgcaccgccatggtctgctgcatggcgatggcaagtgctcccgcaccgtttctggacagtctgcattctggcgatgaatcgtcacctcccgacgattcatcggccagctcatccatccattccgagaatggctcctgcaggaaatcgcgtatgctctccgccatgcccagcgatttgcaatcctccaccaattggtcttcaagccgttccatctcggcttcgcatatcggcatgggctcgtcgatcgtcttcatgtctcgtcctccttggcgtatcggagcggtcgcttgatgcaggccgctttgttggaactatgcatcatccggcaatgcaatgaggcgtttcggcacccctgtggtcggagaacgtgaagctcggcgtgtcacgaaacgtccggcaccgtctcacccgctgcaatcattatgttttcctcttgtcgaatgtgtgtggataaccttgacccatgactagctcttccgatttggaacagattgaaacgcgcacgctctcgctggtaagggatttttcgttcctgcatgcggacgatccggtggcgaattcctgcaaagccgtcgctgatgcggtggcgcagcaggcggtcacgtcaagtgagggcggcaaacgtctgcgggcgttgctgacgttggatgcgttccgtgcgttcgcgccgcaggatgtggcggaacgtgatatggatgcggtgttggatctggcatgcgcgatcgaagtgtttcagaccggcgcgttggtgcatgacgacatcatcgacgattccgatctgcgccgtggcaagccgtccgctcatcgtgcgcttgccacggatacccatagtgatgccatcggccatggtttgggcatcatgttgggtgatatgctggccaccgcgagcgtggatatcgccaataaagcggcttgccggcttggctccgggtcttccgtggtgtcggccttcctgaatatgcaccgtgaagtggaaatcggccaagtactcgatttggccgtggaactcaatacgttagacgatcctgaagagctggcgtcggcctctttgaatgtcttccgttggaagaccgccagttataccactatcgcacctttggaattcggtatgcttgccgccggcctcgcccctgcggacgcgcgcaggctcgcactggcgattggattgcctcttggtttggcgttccagctcgcggatgatcttctggacgtcatcgggtcgagccgcaataccggcaaaccggtgggcggtgatatccgtgaaggcaaacgcacggtgttgctggccgatgcgattgaggctgccggcgatgtcgaacgacgtgaactcatcgacatgtgggaagccgaatcacgtgacgaggcacatgttaggcgtgccatcgcattgttcgagtccactggtgccatcgcacgttccaaggaacggatcgccggtctgtggctcgagtcgaaggccgccatcgagacgcttgaactatcgcaggatcgcaaagacatgcttaccgaggcatgcgcacgtttcgtaccgattgtgcgggaacagggctgatgccgccgcactgtgaaagacccgtgttcatcgcatcttccgcaaaccattccttgtagactacaagtgaacacatctttgtcgcgaaacgttttttgaagaaggaatcgtaccgattagccatgagtgaagcccagcatgcccccgaaggccaggtcatcgaaggccggtaccgagtcgtcagcagaatcgccgatggcggcatggccacggtgtatcaagctgttgacgagcgtctgggacgcaccgtcgccattaagatcatgcacacgcagctggcacagggcccacaacgcgaccagttcgtggaacgtttccatcgcgaggcccgttccgcagcagcaatagccaatccccatatcgtgcaggtgtatgacaccggtgagttcgatggactggattttcttgtcatggagtacgtgcatggcgtgaacctgcggtacgaaatgaaccagcaagtcacgttcagcgttcgtgagacgctacgcatagtcggtgagacgttggacggcttggcttcggcgcatcgcgcaggcgtggtgcaccgcgatatcaaaccggagaatattctgctcaatgaccgaggacatgtgcagatcaccgatttcggcctggccaaggcggtgtcgcaggccacgctgtcctccaccggcatgctgctgggcacggccgcctatctggcgccagaaatgattcagcacaatcaggcaacgccgcagggagacctgtattccgtaggcatcatggcttgggagatgctggccggcaaggtgccgttcaccgcggacaatccggtgacgctggtgttcaagcacgtgcatgaggatgtgccggatatcacgaccgcttgtccgggcatcaatgcaggcgtggccgcattcctcgcccgtcttacggcgcgcgcggtcgaggaccgtccccaggatgcgtccgtggcattcgacgaattgcagcagttgcaatcgaacctcaccatcgacgactggcaataccgtctgtcagccgtttccccggccgcaaacgatgccgccgacaccatgcccggcgatggcacccggcagatgccgctaccgcccgctcccccagcaccgcctgtgcgtcagaacgacgatcgtacacgacagttcaatccggaaaacccgaacaaaaccaccgtcatgccggcgcagcaggcagatccggaggcaaccacccgcttggctttggaaaagaacgacgtccccgccaacaacgttccagcttccccctcgaacggtccggtcagtggtggacagccgaaacgcagtggcaagcgtgcacctgtcatcatcgccgtcgtagcagccatcgtgcttgcctgcgcaggcggtggaggctatgcctggtggtatttccgaggaccgggcagctactggaccatgcctcagccggcagatctcacatgttccgattcggagccctgccgtatttccaacatcaaatggaacgcctatgaggaactgctgaaattctccaacatcgagtacgaagagaccgaggcgttcagtgattccgtcaaggctggcaatgtcatctccaccgacccggagaatgtcggttcgcatgtgagcaaacgtcatcatcagaaggtcaaggtggtagtgtccaagggtattaagcagggcactgttcccacagacattctcgatgccaccagtgcgaacggcaaggatccgatcaacgcgttgaagcgtgccggcttcgacaacatcgaacagactccggccaatgatgacgcatattccatggacgtacctcagggcgcgttgcttgatttaagcgtggatcccggcgcgactctgccccataacgcgaagattaccgtcacgctgtcccaaggaccgaaaccggttaccatgccggacgtcgtgggcaaatcgaaggatgaggcgcagcagacgcttgatgcgctcaagctcaccgtcaactggaccgagcaattcgatgacaagattccgcaaggacaggtgatttccgcttccgcgaagaccggagacgagttgcactggggcgatagcgtcaatgcggtggtgtcgaagggaccggaaaccgtaacgctgccgaattatgtcggacagaaagccgccgctgccaaagccgcattggagaagctgggattcagtgtgaagatcagctcgcaactgacacttgactccagtcaagacaagaaggtcgcttcgcaggatccggtaggaggcaccgaggtgcgactgcgtcaggaggatggcacgccgaataccgtcaccttgaaaatgtattcgtcgctgttcgactgattatcctgattacaaaatagaaatcaggggtgtctgttccgaaaacattcttcggaacagacacccctgattggtttggaatgaacctcgctgaaaacttatgccttcttggcagcggattcggcttgtgcctgcgcttcggcctcctgctgggctttgagctcggccttgaccttctgcgcgtattcgtcgacgtattcctgtccgctcatcttctggatctcacgggtcacgcggtcggtaagcgaacgcaaatcatcgtgggtaatctggtcggcggatttcttctcgacttcaatcggcttgccgtaaatcaccttggacttgcctttgttcggaatgacctgtcctggcttctgcagttcacgcgaaccgatgatggcggccggaataatggggcaaccggtttcgaatgccagacgcgccgcgccggtgtgtcctttgtaaagacgtccatcggggctgcgagtaccttcgatgtgaatgccgaacagatgtccgtcctcgatgatctcacgggcgtggttcagtgcgccaagtgatttggaaccgccggaacggtccacggggaacacgccgactgacgtgaaccaccatttcttgaatttgcctttgatgcctttgccttcgaaatattcggccttgcccatgaaatgaatcatgcgcgggcaggtcaacggcagcaacgcatcgtcgatgacggcaagatggttggctgcgatgatggcgccaccttcgtgcggaatgttctcaagtccttgcgcggtcggtcccaaacggtggatggcgattggtcccaagccttttacgaaaaaccaatagagcattcttcacgatcctcccggcggattggcctccgcccgattagagtataagtatgactgacctcaacaatagcaatgacgatgaagaacgcccaaatgacgcgtcgcatggtggcggctctccaatggacgacttggatgcggcttgggccgagtttgcggattcgcatgctgacgatttgaaggccgtggaacgttcgcgtagtgcgaaacgtttcgagaagcatgcgcaacgtcgggaaaaagaggctttgctgtccatcgatgacttggatcagggcacgttcaccaatgatgcgccggcgaatggtcgtgggccgcgcgatttcactggttcgagctggcttgacacggatcgggtcatggaccgttacggtgacgacttcgtgccgccgaatcctgaaatcggccatgtgaaactgtcaaaactggtgttctggatattgctggtggccggcgtcatcggcattatcgcttccgtgttcgttccggcgttggcttcgattcttggttcgattttcggtttgtgtgcgctggtcggcgccgctggcctcatcgtgcagcataaagggcatcgtgaaacgcgtaccgacgaattcgatgatggagcacgcgtctgacgattctttggcgacaaactgaatacatccatctatgtgaaggccccggcggttattgaactgcgccccgtttgttggacgttgttaattgggatacagggtcagaccgcgagggacatgctccggaactcctccggggtgcgtccctcgagtcgtatctggcgtcgtctggtgttccaatggatgatgtaggcgtccagctcgcgtttgaactgttcgtacgagtcgaacacacggccgcggtagaactcgtccttcaagtggccgaagacctgctcggccgccgcgttgtccaggcagttgcccttgcggctcatggaccggcggatgccgaggcgttcgagctccttcctccaccattggtgctggtactgccatcccatgtccgagtgcaggatcggctccgcgccggcgggcaggcgctccgcgagcatggcgggcagacgcttctgctgaccgaggtccggactgcggctcacgtcccaggccacgatctccttgctggccatgtcgtacacgggagcgaggtacgccttggatccggcgaccttgaactcggtgacgtcggtgccgagcctggagaacggacgggccgcgtcgaagtcgcgttcgggcaggttatgcacgcggtcgcccgtctcgcccctgtacgagctgtagcgtatccacgggttcctggagcggatggcgcatctcagcccatacggcgcatgaccctgagcacggtcttggcggatatgcgcgtgccgaactcgtggaccaggcacatgcgcacctgccggtggccgcacccgttcggggtgcgctcccatatctcccgtaccatcggctccacgtccggcctggacacgtgtgccgggcgcgacaggtggtggtagtacgtggatttcggcagcccggctatcctcaggaggtggtcgagccggtgtccccgccctgcgagcagtcggacgacggcgcttcgctcgcgccgcgtgacttggacgcccgcagggcccggagtttttccaggtacgcgaccttcgccttcaggtacgcgacctgttcggcgagctcctgctcgcgcgtcggttcgggcttcggtttggatttcgcgcctttcggcctgcccttgggtttcggcctgagcgcctccggaccggtagtcgcggcaccagcgctccagggacgcgatgctcgcgatcccgtgcctggccatggcctccgtcttggtcagaccgttctcgacgtggtcgcgcgacgcggcgaccttcgtctcccagtcgtagcgtctgctgccgccgcctcccatgaccgcctcctcgccgttggacctgtacagcccgatccagtttctcgcgatatacaccggtatggcaagccttctggcgagcgtgtccttgccggctccggacttgatgagctccagcgcctcgcgccggaacccgtcgtcgtaacgtctccttcgatcctcacgcatacgaaagaaccgcacctccgatcatcgaatctgaatttcttcagtccaacaatcggggtgcggttcatatttacgccgggccttcacatacacatacgttgtcagcgttttcaggctttcttcgcagcttgggcggtggcgatccacttgtcaagcagcgccgtggccttgccggagtcgacggtctgctccgcgatggcgtaggcggctttgaaccggtcagccaagcttgcgtcgcccggcaccaaatgaccgtcggcgacgattgcggaagcggcgttcagcagcgcggtggtacggaacgacacatccttgcctgcgaagaagtctcgtgccagctgcgcgttgagcgtcggttcgccacccttcagatctgcgatggtgactttggcgaggccgagttcgacggtcggatcgaatttgttttcggtaaccttgccgtccttgaattcccaaatggagaccggaccggtcggtgccatctcgtcaaggccctcatgggaagtgtagaccatgccgatctggccgttcgccgcatatacggcggccatgatcgggctcatcttgcgattagcgcagccgacggccatatgcttcgggcttgccgggttggtcagcggaccaagcacgttgaacacgcatggcacgccgagcgcagcgcgaatcggaccgacaaaacgcatggcggggtggaaggtgcgtgcgaaagcgaaggcgatgccgcattcgttgccgacttcgctcacttgttccggagtcaaatccatgggcaggccgagcgcttcgaagcagtcagcagtgccgcacttggatgaggccgcacgattgccgtgcttgacgacttttacgcctgcggccgcggctacgacggcccccatggatgacaggttcacggtggaggctccgtcgccaccggtgccgacgatgtcggtggtttcaccgtcgatgtgcagcggaatggcatgggccaccatggccttcgccgcaccacgcacttcgtcgggggtcagccccaactgctgctgggtggcgagtaccgcgccaacggccgccggatcggcattgccgttcatgaggtcatcgacgaaccactcggattcctcggcgctcaagtggtcccctccgaccagcttggtgaggatcgacttccatgtgatttcggccatgatgccctccttggcgctgtcgcacgcctttattgttgttctgatgccgccaattgtaacgattggacgttcccccacgtccgcacgtccatatcacgaaacggcccatcgaagattcttcaaaaaagaaaacctcccccgattacggtcgggggaggttatgtcatgagcaagtcagcgactcagcgaatcactgctcgttctggccgtggcacatcttgtacttacgaccggaaccgcacgggcactgggcgttcttgccggttcccgggaaagtacggccatccgcccacggagagtggagttcctcgctcttcggacgcttgttggccgggaccttgccttcggcatggctaatcggctgcatgccgacgatgcccttctcgttcttctgctcgtcagccagttcatcgatggtggtcttttcggcctcgtcatcggtctccggctctgcaggagcggattcgccggtcgcggcggcttcgccgtccagacccattacggcctcggcggcgttcacggcctcatcctcatcggattcggtctcctcgtcctcggtcatggccacgcgttcgatgtccacgtggaacagcagctggatggtttcctccttgatggcttcgatcatggagttgtacatctggtagccttcacgctggtattcgaccagcgggtcgcgctggcccataccgcgcaggccgatgccgtccttgaggtagtccatctcgtagaggtgttcacgccacttgcggtcgagcacggcgagcaccacgcggcgctcgagctggcgcaggccttcgctgccgagcttgtcttcgaaatcggagtactggtccttggcgtcggagacgatgagctccttcagggcctcaacggccttgtcgcccttgagcttgtcgacggcgtccttggccccttcctgctccacggcgatcgggtacacggaggagatggccttgaacagaccgtcccaatcccaatcggccggcttgtcggaaccgttgttggcgcccttgatgtagctcagcacggtgtcgtcgatgaacttgaggatgtcctcgtggatgtcggcgcccttcagcacagcctgacgctccgcataaatgacggtgcgctgcttgttcatcacgtcatcgtacttcagcacgttcttacggatttcgaagttacgcgattcgacggccttctgtgcggtgcgcacgcccttggaaacgctcttggcttcgatcggctcgccttccggcatgcccttggccatgacacgcgccaccagctgggtgttgaacagacgcatcagatcatcttcgagggacaggtagaaacgggattcacccggatctccctgacggccggaacggccgcgcagctggttgtcgatacggcgggattcgtggcgctcggtgccgagcacgtacagaccgccgagcttgacgacttcctcatgctcgtccttgacctggtccttgatttcggccaaagtgcccggccaacgcttctcgtactcgtccggagtgtcatccggagaatagccttcggacttgagcttcgcatcagcgaggaactcgacgttgccgccgagcatgatatcggtaccacggcctgccatgttggtggccacggtgacggcgcccttacggcctgcgacggccacaacggcggcttccttgtcatgctgcttcgcgttcagcacctggtgaggaatcttggccacgtcaagcagagaggacacgacttcggaggattccacggatgcggtacccagcaggaccggctggcccttcttgtggcgcttggccacatcacggacgatggcggcgagcttttccttcttggtacggaagatcagatcgtccttatcctcgcggatcatcggcttgttggtcggaatcggcagcacgcccagcttgtaggtgcccatgaattcggcggcttcggtctctgcggtaccggtcatgcctgccagcttgtcgtacatgcggaagtagttctgcagggtgatggtggcgaaggtctggttttcggccttgacctccacgccttccttggcttcgatggcttggtgcagaccctcgttgtaacggcggcccggcaggatacgtccggtgtgctcgtcgacgatgagcacttcgccgccggtcacgacgtagtcgcggtcacgcaggaacagctccttggccttgatggcgttgttcagatagccgatcaatgcggtgttgttcggttcgtacaggttgtcgatgccgagatagtcctcgaccttggtgatgcccggatcaaggatgccgacgaccttcttcttctcgtcgacctcatagtcctcgtcacggttgagcttcagaaccaggcgcgcgaactggcggtaccagcgggtcacgtcgccctcggccggaccggagatgatcaacggggtacgagcctcatcgataagaatggagtcgacctcatcgacgatggcgtagtggtggccacgctgtacgagatcggatttctcccatgccatgttgtcgcgcaggtaatcaaaaccgaattcgttgttggtgccgtaggtgatgtcggcgttgtactgcttgcgacgctccggcggcttctggttggtgatgatgcagccggtgctcatgccgaggaagcggtagacacggcccatcagctcggcctggtagctggccagatagtcgttgacggtgacgacgtggacgccctgaccgtcgagtgcgttcaggtaggccggcagcgtggccacaagggtcttgccttcaccggtcttcatttcggcgatgttgccccagtgcagagcggcgccgcccatgagctgcacgtcgaagtggcgcaggcccaaggttcgcttggaagcttcacgcacggtggcgaaggcttccggcatgagcttgtcaagggactcgccgttttcgatacgctgcttgaacttggcggtctggcccttgagctcctcgtcgtcaagcgccgcgatctcgtcctccaaggcgttcgtcgctttggccacgttctcaagcttcttgatctgtcggccttcacccatgcgtagggctttgtcaacgatatctaccacaatcactccctttgtgtatggtgactttcctcgattgaggatagtcgctttctcgcgatttccgaaaagctccgtccattttacgtaagttttgacgtatcttgtttttcgcataagaaaagaggcccgcatgtatgacatgcgagcctcttatcgttcagttttcagccattagccattacttcttggccacattctccggagtgtcgatttcgaagacgccgtagctccaaccgtgacggtggtagacgacggacggacgaccggtttccttgttgacgaacaggaagaagtcgtgaccgatcagctccatctcgtacagggcctcgtcaatggtcatcggctcggcgatgtgcagcttgcggcggatgacgattggggtgtcgccgacctggacctcgacggattcgccagggccgagatcagcggaaacggcgtcggccgggctattgttcggcgcttccggctccggctcctcgacgacgaccggctcgaccgggcccagatcgaccgggaccggatcggtgtagccacgacgatggtccttgcggcggtcgcgggtacggcgcagacgaagcgtcagcttgtcgagagccaaatcgagcgcgctgaactcatcggcgctggaggcttcggcacgcaccacggtacgacctgcgatgacggtgatctcaacgcgcttggcggtgtcggcctgacgcggattgccctcgtgggacagcacaatctggacacgctgcgcatccggggcgatagcggtcacacgattcatcttgctttcgacaacgtcacggaacctttgcttgatctgcgtatgacgtccggtaacgacgatttccatgtggacctccctagactcaagcggtgttaaccgctatatacggaccaaccagctgcatcgctgcttggtagtcatcattgtatccataagattggtgatttgctggaaaactccccgagaaaacaaaagtttttttacgctttgctttcgacgattctcttgctatagttgtgcgtttgagacctcttgatggccgcgaccgattttgtcggttgaggaacttccgggctccatagagcacgatggcggataacgtccgcccagggcgacctgagagatagcgcagcagagaatagaccgccttaccggtttcggccggtgggtaagggtgaaacggcggtgtaagagaccaccgggccgctggtgacagttggccgcatggcaagcctcatcgggagcaaggccaagcagaaggcgttcgaggactgctcgtccgaagccttcgggtaggctgctagagcctgacggcaacgccaggtcgagatggatggccatccgtgccgttggcacgacagaacccggggtataagaggtctcactctccactctttatgttttgaggatttctttacaccagcctctttatgaaactgacgtcacgcccttggccaacggtcgccgtcaatcaaacagttcctgtgcgatttggcgcagaatctcaggattatggccttttctgccgcccgcgctccagaagcggcgcctacgtgcatcgcgttccagaccggcggtttttctcgcggttctacggcctaattcccatgcggcttcagtaaacacgccgtaggattccgcctcatcacaaacctgttgggccagcctacggtcgacgcctttccgtgtaagctcagcgaccgcgcccctacatcccataagacgggtcgcacagtagcgcaccgcggattgcgcgtaggcttcatcgtcaatcagttgaacccttgtcagtctttcgatgacgtcgtcaaccacttcagaggtatagcccttaccaatcaggcgctcacgcagtgcgccggaaggtcgaggcgcagcgtccagcaatcgcaatgcggcttccctgcatgcgtcaagatcatttggatcctttgcggcagtagaatcgccgttcccgacacgcccagcgtgtcgcgcgtgtcgtggcgttttcgtcgcatttgcgcttccagcgaacaaactggaacggtcaggtttcgttcgacggttccacctctgaacgttcgtgcgttctggatcctctgaagaaagggcaaggcccccagtatcggccgacgccggctgaaggccctgttccttaaggaaacgttcggcgctgatcatatgtcaggctttggcggcttttgaagttttggacgtcttaccatcatccggcgcgcccgcggcgtcctccgccccatcgtcctcggcgaactggtcggtaggtttgatcagaccgaatgccgccttgaccttgttctcgatttcctctgtgagttccggattgtccttgaggaactgacgcacgttttcgcgtccttgccccagctggtcgccctcataggtgaaccacgagccagactttttgacgacgttggcctgcaacgccatatcaagcacggaaccttccttggagatgccctcgccgtacagcacatcgaattcggcggtcttgaacggcggagccatcttgttcttaacaaccttgaccttagtacggttgccgacagcctcatcaccgttcttaatggtctggatacggcggatgtccatacgtacggacgcgtagaacttcaatgccttgccgccggtggtggtctccggattaccgaagaacacgccaattttctcacgcaactggttgatgaagatggcggtggtaccggcttgcgccagcgcaccggtcatcttacgcaacgcctgactcatcaggcgcgcctgcaggccgacatggctgtctcccatctcgccttcgatttccgctttcggcaccaaggccgcgacggaatcgatgacaatcacgtcaagcgcgccggaacgaatcagcatgtcggcgatttccaatgcctgctcgccattgtccggctgagagacgatcaacgaatcggtgtcgacgcccagcttacgggcatagaccggatcgagcgcatgctcggcatcgatgaatgcggccacaccgccggccttctgggcattggccaccacatgcagcgccaatgtggtcttaccagaggattccggtccgtaaatctccacaatacggcctttaggcaggccgccgatgcctaatgccatatccaaagccaaggatccggtcggaatgacctcgacatcctgttccgggcggtcgccaagtctcatggccgatcccttgccgaagcttttctcgacctgcgcgagcgctgtgtcgagcgcggcctgacggcgcggatcgattccattcgcggacttgttctgtgcggcgttctttgccgcgctcgtctgtgccatgactactccttgttgttgaccgagacgaatgaatggattcaccgtaaaaccgcatcatccatctgcgcaagttcaatcggccattgtggtcgaagaacatgcatttcgacacgccgaagaccgctttcccttgaaattccagcattctgaaacttcgcggcgagccgttgacgacctgcccaatccgtgcttctgtggataactataccccattatccgaacatctgttcgaaatcggtgttttgcgatagccgaactccgcctaacgcaccggcattggtggcgcgttatggtcctttccccaacgtttgcagtcaggaatgttcatctggtcgcacagaacgttccataccacgcggggctcctcccccatttcaagcgcttcgacggctgtcagaccgttcaatcgatcaagcacttggtcgcgtgcgagcgcgcggccatagctacggccgagtacctcttcaagcaactgccaaaattcacgttcctgcacgcgctcaagtgtacacagcaagcgcaaccaaaagaaaacgcccgacggaacaagccgccgggcgttagacgtccaacaggaatcagattgcgacggaatcgagataatcggcgaccatgcgcagcatctgcgccgtggagacgcccaacgattgcgcaatcgagctcagcagctcggagctggcctctttttggccacgctccacttcggagaggtagcccaacgacactccggccttttcgctcacctcacgcaacgttttgtggtcatgggtgcgcagatcgcgcagtacatggccgatggcctcgcgaagcgatacctctctgggttcgtcggtggtttccgtggctgccgacatggatcgtgcggaaacgcgttccgcgtcttcctcccgccatatgcgggtcaatgcggcctggcgctcgtctttggcctttttggccgcgcgggcacgcagcacctgctgctgggcgaacatcaccgcgcggcgctgggctggggtgagttccctgacgcgggcgttgccgctttgcaccgtgggaaccatcgccttgagttccatctgttccttggtgagtgtcatcgtgtccatgccgccagcccctttcgcttttcatacgtacgtccactatggtcaacacccatattcgtggattattcctgtgaaagtgctgaaagagtcctcagtttttccagaatacattgcacggtttcgtgccgcacggcttcccgatcacccttcagacgcagctcataagcagctgtttgacgcgcacgaatgccattgaagccacagggcagggagcagccgatgtacaccaggccggcaggtttgtcaccatccggtcctggccctgcaacaccggtagtggccaagccgatgacacagtctccatcctcggtctgtcggtatagttgcgcggttcccgcagccatctgccgcgccacttcggggtggaccgccccttctcgggccagcaggtcggcattcacgccgagaatcttcgctttggcgcgaatgtcgtaggtcaccgccgagccgaggaacactttcgatgcgcctggtatgcgtacgaaggcgtcggcgagtagacctcccgtcagtgattcggcggcggcgattttgaaatggttggcttcgcaatagcgtaaaacggctgcggccagctcatcgcattgcgattggctggccgcggtcgacgaattttcggattcgctcatcgggatttacttggtttccttttcggattttgcggtcttcttacgtccgccgaacgtgttgacgaggtattcgccgcccgaatacaggcatagaatcaacgccaggtaaatcagggcgtacgtgatcgtgtaataaacggtcatccacagcggagtggtgttcatgccatcagcgaggctccacatcggcagcatgagcatggcaaggccgatgcactggcacagggtcttgtacttgccggcttgggatgcggcgatgaccttgccgccggtgtcgatgacgaagaaacgcatgatggtgatgccgatctcacggatgaggaacagcgcggtcacgacccagccgagcactgcgttgccgaattcgttgaagatggcggcgacgatcagcgtgccgcaggtgagcagcttatctgcgattgggtccatgagcttgcccagttcggtaacctggttatatttgcgggccatccaaccgtcgagcttatcggtgcaggcggcgatgatgaagataatcgccgccacccagcgcatagtcgtgtttttggtaccccatgcgcctgccatgacgtacaacgccaggaagatgacgaccaggacgatacgagagaaagtgacgatgttcggcggggcgttccacccgtcaagcagggacgatttgcgttcttcttgcttttccataccgttcacgttaccccgataccactacttggcgcaatgcgtgcggttgtcgcgttccatcatcgcgtgtccgcagcgtcggccggctgggtagaacctgcggtaagcgatgaggtttcgcccttgatgaaggcgagcacctgcggcagatcctgcggttggacgagcacttcgcgagctttggagccttcggacggaccgaccacaccacgcgattcaagcagatccatgagtcggccggctttggcgaatccgacacgcaatttgcgctgcagcatggaggttgagccgaactgcgtgctgaccaccagttccgccgcctgcaacagcacgtccatgtcgttgccgatgtcctcatccggctcgatggccttcttttcggcctccttggccatctcctcgatatcctcgcgataatgcggcttgcgctgggttcgcacgaactccaccgcgcgacggatttcggactcgtcgacccatgcgccctgcacgcggatcggcttggcctggcccatcggcaggaacaacgcgtcaccttggccgatcagcgtttccgcaccggtggcgtcgaggatgactcgcgaatcggtggcggatgaggtggcaaaagcaagtcgggacgggatgttggccttgatcaagcccgtgaccacgtcaacggacgggcgctgcgtggcgagcaccagatgcacgccggcggctcgcgcgagctgcgtgatgcgctggatggagctctccacgtcgttcttggccaccatcataaggtcggccatttcatcgacgaccacgaggatatacgggtatggtgcgaccttgcgtttggagcctgcgggcgcatgcaccttgccagcgcgcacggcagcgttgaagtccttgatgtggcggaatccgaagaattcgaggtcgctgtatcgtgcgtccatctccttgaccacccattccaaagcctgcgcggccttcttcggatcggtgatgatcggggtgagcaaatgtggaatgcccgcataggcggacagttcgactcgtttaggatcgaccatgatcatgcggacctggtcaggcgtggcgcgcatgatcacggaggtgagcatggagttgatgaagctcgacttgccggagccggtggcgccagccaccaacaggtggggcatcttggtcaggtcggcggtcacgaaatggccttccacatccttgccgacgccggtgagcatcggattcggatcgttccgggccttgtcggagcgcagcacgtcgcccagcaccacggtttcgcggtcggagttcggaatttcgatgccgatggcggatttgccttcgatcaccgacaggatgcgcacgtcggagctggccaccgcgtaggcgatgttcttctgcaggttggtgaccttctcgaccttgacgccagggccaagctccacctcatacatggtgacggatggtccgcgcaggaagccgatgaccttcgcatcgacgttgaactgttggaaggtaccggtcagcgcgcggatcacacgatcgttctccggagtgtgcgcggcgtgcggcgcgcccttcttcagaatgttgaggtcaggcagatgatacggtccctcgggaatgtcatccgccgcttccccgtcaacggcagcagccggcatatcgtcaaggacctcgccggtcgcggcatccaccatgacttccttgccgttggaggtgccgtcctcgtcgatgacggcccatgggtcgctcggagcgacgccaaccggcttgatttcactggacggcaccggctcggcgacgctgggcatggtgccgctcgcggtgccgatcggcgcggacgagaaggagcgtctgcgaccgttctgtggcatggccgtggtgccggacggcgcagcggcggaataatcatctgaatcataatcatcggcacgataatcgtccgaagaaatgctgcgtggcgaatcgacctgttggtacggctcgtcgacgatggtttccgcggtctgtccgtgccgttcggcggcattaagaaacgcttcgtcgccggcgtaatggtcaaggtcgccatcatcgacgttcttgctcttatgggatgcgaagcgttgcttcatacgcgtaaggaagcccagcctatcgtcgttttctccatccgcatcggtgccgtcgtgggcgggaacgccttcggcgaaggcgagtgtcatgtccccaacgcgtacttcgttcgggaactgttcggcctcatcgtcaatgtcatcacggtttttcggcgttccaacaaacttggccgccagagccttcgccttgtccggtatctgcgtgacccgggtatgggtgatcaacagcaacgaaaacaggatgacgactacgaaaatcgcaatggaaaagcctttggaaagcccccacgccaacggacagccaagcacatagccaagcaggccgcctgcccgctgcagcaaagacatatcgaacttctgggagtcggaggcaatcgccgcgtcaagaatagagcagacggaccagaggatcatgaaccatccaagggccatatggaggttctcatccttgttttgcgtcttgcgcatcagactgaacaccacaagcgccaggaataccggcagaatcacgctggtcaatccgaacagtccggaggccatggcatgcaggacctgtccgaaagcgccctggacacggaaccattcggatgcgcagaacagcaccgcgagaatggccatgatgaaacatgcgatgtcgcggcgatatttacgcagtatgccggcgatcggagaggaatcgacctcgtccatgactttggtatcgccggaacgcgatttgcctgcggaacccttgccgcctgatttcgggttggaagatgctgttcgtgccataacagaacttgattttaccgatgtccgacgtcatgacacggcattaaccaaatcgaacaattattcgaacttaatcgaacatgctttttcagcgaatcaaacattgttaagcgtttattcagcgctgtaactgaaatataagcaattccggcggaacacgccctcgtgcacttaaacgattaaataactagcgcggatattaacgcgcttaatcccaatgttggggtgcgcgtggaacatcaaggaagataagtgaaggaaccatgaaaaccacagtcaccaaactgctggcaacggttgcggcggcatcgaccatttttggcatgagcaccctcccagcctttgctgcagaaggaaaatcggcatccaatggcaactccgtgaacatcagcgacgtcaacgccacagcagaaacccgcgccttgttcgacaagttgaaaaacagcggaaaaggagatcttcgtttcggacagcagcacgccaccgacgagaacataagctcaagcgcttcacagggagacgtctatgagacgaccggaaaatacccggccgtcttcggttgggacgccggtcttgcgctgcgcggcgcggagaagcctggatcaggtgccgacaagaacgccaacgccaaggctctcgcccagaacatcaccgatgcggacagcaaaggcgccatcgtgacactgtccgcacactggtgcaacccaggcaccggcaaggatttcaacgacaccactgccgtcgcttccgaactgcttcccggcggcaaatactccggcaccttcaacaaggagctcgacgccatcgccgccaccgcgcagcgggccaaacgcagcgacggcacattgattccaatcatcttccgtccactgcacgagaacaatggcagctggttctggtggggcgccacgcatgcttccgctagtgaatacaaggaactgtaccgctacatcgttgactatctgcgtgacgtcaaagatgtgcacaatctgctttatgcctactcccccggcggcgtattcaacggtgattccactgattatctcgccacctacccgggcgaccagtgggtggacgtactcggttatgacgaatacgactccgatgattccgcagacgattccagcgcatggatcaacactgtggtcaaggatatgaagatggtttccgaccaagcttcgcagcgtggcaaaatcgtggcgctcaccgaattcggacgttccggcgaccgcaagttcaaggaatccggcaccggagacaaggacaccaagttcttctccgaacttgccgaagcacttgccgaaaacgtgccaagcaccgcatatatgatgacttgggccaacttcggtggaggtggagacaatttccaggcgtatacgtcgtggaagggctccgacggcgaagccgatttcaaggcgttcgcggacagcaacaagaacctcatggcctccaaggacaacgtcgactattcgaacgccccggcagccgccatgcaaaatggctccgcgcgtatcgtcactccagtggacggcaatcgtgtgaccgacaccaaggtggtcgtccgggtcaagaccgaaggtgtgaaatactccgaccttgatcttaattccgccatcgtgaccaccgatcgaggccagaacgtcaaactcaagtattcctgcaatggatatttcacgggcatactggatttgaacgcggccggtatcaatcttgaccagtccaaactcactttgactccgcaggtcaagaccaaggacggcaagacactcgcagcggccgacggcaacggttccgtcacagtaaaactgggtgccaaaccagagcagacggtagacaacgtggaggacttcgactcctatgacaacgaagccgaattacagtccgtctattcgccgagccacagcacgaaatcgaatctcacgctggtggacagccccgaggacaatggcaccaaggccggtaacatccactatgatttcgtgagctatccggagtataacggcttccagcgttcccatacgccgaagcaggactggtccggcttctccaagctgaacatgttcctcaaggccgacggttcggatcacaagtttgtggtgcaggtcaatgccggcggcgtgaccttcgaagcctatccgaagatcgatggcacggacggacacgtcgtctcactgaacttcggtgacgccgacggcaacggaggcgacttcgcaccggcatcctgggacaccgcgcatgcgggcatgaaactctcgcagaagctgctgtccaaagtcggttcgttcgccctgtacatcaacgacaatggcggcaaccgtccgaagagcggcgatttgacgctcgactccatcaagctcgacggcaaacgcgacgcttacgcgccgaacaccaatccgacgccgggcaacaccgccaaagcgcaatccgtggatgatttctcaggctattcggatgatgccgcagcacaatcggcttggggcaaccgcggacatacggaagtcctatccctcgatgaaggcccgaccgatgggtccaaggcgcttcgcttcaagtacgacttctccaatggaggctggtacgatgtggcgaaatatcttgacggcgcgaactggtccggcgaatccgtattggctttccaagtcaagggggatggttccggcaacgccatcggcctgcagatcggcacaagcgatggcaaatacttcctcgccagcgtcaaacttgacttcaccggctggaagcagattgagattccattggtcgataacgccaatctgacccaatcctggccggaggacgccaataaagacaatccgatgaccgaagatgatctggcctccatcaaggaactggtgttcgcctcccagcaatggaatagcgaaagcgatgggcttgattcctccatcgccgatatcaaggtcgagcccgccgagaatacgtccaacgagcaaaccccgaaggacgaaagcaaaaccgaggtcaaggccgacaaggagcaggaacagtccgaggacacctccgcggatgtgaccgcccaagatccggccacttgcccgatttcagacgaagattccaagggctcgaccggcaatacgacggttacggtcaagcccacgcccgacaccaaggaaccggccgacaacaccggcaaagatggcctgtcccgcaccggttcaaacataatctctgccattgctgccgtggccgtactgctgctgggcggctgcgccgtgctgatcgcacgcaagcggaagggaggcgatatcgaatagtccaataggaatgaactttctcacgtaggacattacaaaacgggggtcccgcaatccaactggttgcgggacccccgcccgtatttccgcagaaccctgcaaaaagaggctccgcagtgatgaatcatttaggcgatatcgccaagatgatgctgcgtgtacgcatccgcctgcgcgtcgatcgcgtcgtaatcgccggcgtcggcatgctcgatgatggccatggcattgcccagcagcgcggggttgagagcctgcagccagtggatacgcggatcgcggccaaaccatcccatctgtttgcgtgccagacgcttcgtcttctgcgcgatgctcatgaacgtgtcatttaaatcgcacaggccatccaaatagtcgacaacctgctggtatccaagagccttgcctgcggtgatgccaagccggggacggatacgctccacttcctcgacgaaaccgttctccagcatctgcttggtacggatgtcgatgcggcggtcaagttcctcacgcggcaaatcaaggccgatctgcacggtgggaatcacataccggtaatgcggcaggctcgccgaatacggccggcccgtcacttcgatgacctcaagcgcgcggatggtgcgtcgaggattgtgcggatccatgcgggccgcggcttcgggatcctttgtcttgagctcgtcgaacagcgcaccggcgccttcgaccttttcacgttcctcgaggcgtttgcgcacctctgggtcagtgccaggaaaggaaatgtcgtcgatggcggcacgggcgtacagaccggaaccgcccacgaggatagggcgcacttccctggcctgcagttcggcgattttggcgcgggcgatctcctggaaacgtgccacggacatggcgtcgtccggttcgatgatgtcgatcaggtggtgcctgacctcggcctgttcctcaggactcgccttggcggtgccgatatccatgcccttgtacatctggtaggcatcggcgttgacgatttccgcctgctcgcccttggcctccaacgccttggcaatggcgatgccaagccccgtcttgccggacgcagtgggaccgacgatggacacgaccttacgggtttcgggcttgctttcagtggcggacggcataggtttgccccgcttccggattcggatcggcgatgagattgtggcgtcccgcatgggtgacggtggcggtcacgaaatcacccacctgcggcatcggctcgccttccggcacgccgacatgcacgagcacgccggttttctcacgtccggtaacacgatgggtggcggcatccttcttgccggatgcgccggtgaccatcacctcgacgtcacggccttcgaaagtcttgagattctcttcggtgatacgttcctgcagcgccacaagacgttcgaacctgtcctgcaccacgtcatgcggaacctgctccatctcagccgccggcgtgccgggacgcggcgagtagatgaacgtgaacgcggaagcgaatcgtgcctcctccaccacgcgcagggtttcctggaagtcctcctccgtttcgccggggaagccgacgatgatgtcggtggagatctgcgcgtccggcatggcctcgcgaatcttgcgcagaatgtcgaggaacttggcggaacggtaggagcggcgcatcgcacgaagaatcctgtcggaacccgactgcaacgggaaatgcagctggtgcatgacgttcggcgtctcggccattgctgcgatcacgtcgtcggtgaaggccgcgggatgcggcgaggtgaatcgtacacgttccaaaccgtcaatctcgccgcacgcgcgcagcagcttggagaaggcaaaccggtcgccgatgccgtagccgaaggagttcacattctggcccagcaacgtgacttccttggcgccttcgtccacacattggcggatttcggcgaggatgtctccgggacgacggtcatgttccttgccgcgcgtggtcggcacgatgcagaaggtgcaggtgttgttgcagcctacggagatggccacccagctcgacaccttcgacgcacggtcggtaggcagttggcttgggaagtagttgagttcctcctgcaccttcacctgcgcgtggccttcgatgcgggcctggtcgagcagctgaggcagggatccgatgttcttggtaccgaacacggcgtcgacccacggggcttttttcgcgatcttctcacggtcgagctgcgccatgcagccgccgaccgcgatctgcaggttcgggcgttccctcttcaattcggcccacagtccgatggtgccgtacatgcgttcggcggcgttttcgcgcaccgcgcaggtgttcatgacgatcaggtcgatgtcatggttgagatactgttcctcggtggcgggcacgtagccgtcggcctcaagcacgccggcgatgcgttcggaatcatgcacattcatctggcatccgagcgtatgcacgtagaacacgcccttgccgcgcgtgggggtatcgttcgccgccggttcggccagtttcgaggcgcgctccgcctcggtcatcatgtcttcgttcataacgcaccatgctatcggcagggcggcacaggcgtttcggaacgcgggaacgccccgttctcggcgcaatcgcagggcattgaccctcttcgatacacagcatacgttcagttttgcggaaaacgaggcggtacactgttcttccgtgatacttgacaggcaaaatcgaattaacaccaccgaattgcagatgcgtctgaagaacgtcgacgtcggcgagggatccctttcccccgaacagatcaccgagttcatcgaccagatgcaggtgtatgagggtgcgatgtacgagatcagcaccaaattggaaattcttgactcggaattccaggtgcgcttctcccataatccaattcaccatatggaacgccgtctcaaatcgcttaactcgatcctcggcaagctgcagcgccgcaacctgccgttgaccgtcgacgccatcaaggacaacctgttcgacgtggcgggcgtacgcgtgatctgcaactaccgcgacgacgtgtattccgtggcgaattatctgtccgcgcaaagcgacatccaagtgctgcgtgtcaaggattacatcaagaacccgaagcagaacggttaccgttcgctgcatgtcatctacgcggtgccggtgttcctgtcatccggaccgcactacacgccggtagaggttcagctacgcaccatcgccatggattattgggcgagcctggagcatgcgctgcggtataagacggatctgccggacgcgaagcttgccgagcattcgcagacgctgttggattgcgcgcgcagcctgcagaacatcgagacgcagatgcagaacatccatcgcgacatcaacagcgccccgcgtgtgggtgaggcgccgcaggcggactgatgttttcggaaaatggcgattgacggacaaatcattgcctgtcaatcgccatttttcgacgatatcgaacgttattcgcgcttacgcagcaatcgtggtattttcaccggaacctgtgcgagcacggtgccgatgaagatcagcgcgcagccgatgtaggctcgtgtggtcatgacttcgccgagcagcaacgcgccgcccaccgcggagaagaacgattcgagcgacatgatcacggccgcgcgcgacggcggcaccagctgctgtccgaccacctgcaacgtgtatgccacgccggccgagccgatgccggcgtacacgatgggaaaccagctttgcatggcgccggcccagtcgatggagccttcgcatagggagccgatccagctcagcagcgcggtggtggaaatttgtccgaaggacagcagaatcggatccatcttctgtccgaacgtgtcgatgacgagaatatggcctgcgaatagaaccgcagtggacaacagcaccacgtcggcaagggtgatcgagccgaatccgtcggtgatgcacagcagatagaagccgaccacggcgatggcaacgctgacgatgacgttcatggtcacgcggcggcgcagaataaggaaggcgagcagcggcgtcatgacgatgtagagcgccgtgatgaagccggaacggcctgcggaaccggaatagaggatgccgtattgttggacggtgctggcggtgaacaatacgatgccgcagatgacgctgatgaccacgggattgcccaggcatttcggcatggccacggttataccgttgccaagcgtgacggttggacactcattcgattcacggcgtcggcgttcctgttcggcgatgcctcgacggcggaaccacagcaacggtattaatgacagcgcgcccaatgtgaatcgtgtggccccgaagaacagggggctcatggaggccatgccctgcacttgggatacgaatgcgaagccccagatcatggccgtcagaacaaggcaggccatgccgccaatctctttcctctgcatgacccactaccctatggcacgtttttcgccgacagaaaagcctgaccatattctggtcaggctttgtttgagggttcagcgcagaggacgtcgcgggatttttcagtcgcgatcgccgaagagctggagaatatacaggaacatgttgatgaagtccagatacaggttcagcgcgcagatgatggagaccttcttgaccatgtcctcaccctggcctgcgtactgggcgaacagcgcgcgagtagcttgggcgtcgtagacggtcatgccggcgaacagcacgaggccgatggcggagataaccatcagcatggtctgtccgggagcgaagatcataagcagcacttcggcgacgatcagcacgatgaggccgaccagcagaatcggaccggctttgagcatgttgaccttggtggtcatgcccagcatggtgagcgcgaagaagaagccggcgcacaacgccagggagatgccgatggtgccaagatcatacgccatgaaaatggtacttagcgagaagcccatgatcgcggcatacacgtagaacatgacgcgtgcggtgctcggcttgatcttttcaatgcgggcgccaagatagatggcgatcacgatttcgacgacgaacggcgcccaagcgccaatgacgccaagcgactggatgagcgcgatgtaggcaccggtggcttgggtgaggatggccacagccgcggtgacgagcaggccgatggtcatctcaccgtaggcacgggtgacggaagcatgttcggcacgctcataggagtatgtcgcctgagccggaatggtggccgccggagcgccctgcgcatacatgttctgcggcgcgtactggtattggttctgaccgtacggattctggctgtactgcccgtacgaattctggttcggattgtattggttctgcccatacggctggccgttgaatccattagcgttgttgccttggggctgctgaccgaatgtcataatcgctccttaactcgattacgcatcacagtacggtacttttctgactatttcatgagagcccacgtcttacggtgccgagctgaaactaccggcaccgtatatccaatgcgcaatcagaccgtgaacttgtgcaccactttcgcgctatcgttcaggtcgaacaaatcagtgacgtcgaccgtcacttcggaatcgtctttcaaggtatatccaatcgtcacggttccggtggctccgggctggacttcggcgaaatcagaattggaatcgtatccggcagggttctcgctgtaaatggcggtgtcgagagcttgcccattttggaacacttgcgggctggcgaggactgcaaacgaactgtttttatccgtgttgttggtccattcgaatgtgaccaacaccgtgggctgattgttatagtcgttgttgctacgtaccgcggagacgattttcacatgcatggtcttcaaatcgccttccatatcctgatcgcccttcggctgattttttgcggagtcttttgcggatgattgtgagcttgacacgccggtggcctcgtctatggccttgcttgctgcggactgcatggccagagtaatgacgatggccaacaccgacagcaccgcagcgacaatcgccaatgccttgccgcgctttttaccgcggaacgtgccgaccaatgccacaatcgcaagaatcacgccaatgaaaccgaaaatcgcagcaatgttgttgataatcggaatgaagctcagcacgaagccaagcgcgccgaacaccacgccgacaatgccgcacacagtcagtcccttctcttcctgatagaccggctgcagcgggggttggggttggatgggctgctgcggggcgatgtaaccactcatgatcgttccttcttctcgaatcggttgagacactttcgagggtacggaattccgcgctggaccggtattggacgaaaggtcattcccgtctgcactttggggcgtgcgaaacgcacggaagaacaatggcgtctttcggggacgggcccaataatggtaggtatgagcgagacgacgaattccccgacccccatcgaagtgccggtacgtaccagaggctggcaaagcatggtgatggtggtctgcgcgggcttcatgtgcttggcgcagaccgcgttcgccgcgcaacggttcggccaggattccgccgtatacgtatggatggtgttctgcatgctggtggcgttcgccatcgggtttctgctgctcgcccgttcccgttatccgcgtgccacattcgtcgccgcgtgtgtggtcgtgctggttttcccatacgatcccattctcgctttgatggcgttgaccgcgctattggcccgccgtaatgacatgaagaccacggttcgcgcgatcgtggcgggcggtttcgtcacgcttgccgcgcaggtacgcgacgcgttgcggccgccggaggcatccatctggcatatggtgttcgccaaaccggataccggcagccaatatggcaccgacctaatcatgcttgccgatgaccgcaccatcgtcatcaccgcgatagttgcggcattgttggagctggccatcgcgactttggcggggttgcatatccgttctcgcgccttggcatcgctggccacggccaaggcggacgcggcggacgcgcaggtggcgcagctcaagaccacgatcgacagtcagcagctggccgacgcgatcgctgccgaagcgcatgacacgcttgcccattcgctttccctgctggcgttgaatgcgagcgcgctgcaagccgagtcgaagaagctcgcggtcgaagcgggaagtctggacgccggccaactggccgggcaggccagccgaatcgcggacaaaaccgaggagattcgcaaacaggcggcaggagcgttggacgaggcgcacagtgtcatcgacatgctgcgtcatccggagcaggcgaaggcgcaactggcgccgtccgatgagacgtcgttgacccgtgaatcgttggatgcgcttctcggagacgcacgtgccgccggcatgcggctcaacacatggattgacatccaacaattgggccaactcaacagggaaaccggcaaaatcgcctatcgagtccttcaggaggggctgaccaatgcgagccgtcacgcgccgggagccccggtatcggtggaactcaccgtgaaccccaccgtaggcgtgcacgcgcatgtgtccaatccaactaatccgtccgttccggcagcatcggcggatgccacgcgtcccgccatggattccaaaaacgctttccgtaccggtgccggattgccgggattggccgagcgcgtccggcaggccggaggaacatgtcgattcggttttgacgcacgacacgcgttccatgttgatgtgcagctaccatgggttgagtgagcagcgaagagaacagcgatgacaggccgataacggttggcgtgattgatgacgatccgatgatttgccagaccatgcggctgattctcgaagattattccaccggcaggctcaatgtcgttttcacctgcaccgatggcggtcaagcggtcgacgaggccgacaggcatcatccggatgtggtgttgatggatatagccatgcccggcatggacggcatcgaggcgacacgaagactgcgcgcacttccgcagccgccgcatgtgctgatactgacgtccttgagtccgagcgggaccgtggagcgggccgtcgaggcaggcgccgagggttttgtctccaaaaccgatgcaccggaggacatcatccgccgcatcaccgatgtgtgcgacggtctgccgcaattcaatccatccagccaacggcagctcatcaacgatctgaacatgcagcaaccgcaatcgcgccgggacgaggctcgcgccatgctcgacgctctgcctgagcgggaacgcgaggcggtggttcttgcagccgacgggtacaccaatgccgaaatcgcggaacgaatgttcatttcggaacgtaccgtcaaggcgcacatctcatccgcgggagacagattatgcatgggccgggtacagatggcgcgtttggttgaacgtgcggatctgccggaccaattatgaggcgaaggattctacggcagtggagactccgttacgtccatgaaacgccggtgcaccccctcccataaactagaaaacagtatgccgcacctgcggtgcaaacgttatcaatgagggatggcggtcgatatggcgatcagcgcgacggaaaaacccctgggcaaagtgttcacttccgattaccaactcaccatcccttcgttccaacgcgcgtacacgtggcaggcggagaacatcgaacagctcgtcaacgaccttcaggacgcctgcgccgacccggacacgccttacttcctcggctcgctcatcctcgtcaaggacggccccacccaataccaggtcatcgacggccaacagcgcctcatctccctgtcaatcatcatctccgtgctgcgcgaactggaagacgaccccgacctcatcgacagcctcaacgacctcattttggaaccaggcgacaaactccgcggcatcaaagccgagccacgactcaccctgcgagaacgcgacaccgacttcttccgcatgtacgtgcaggaaggcgatttggaaggcctgttcgatctgagggacaacgacatcgcctcgcacgcgcaacgcaacatcgccgtcaacacccgccgcacattcgacctgctcgccgccatggacgccaaagaccgccgccgattcgcctcatacctggtcaacggcgtcaccctcgtcatcgtcaccaccgacgacctcgccggcgcgcaccgcatcttcgacgtgatgaacatgcgcggcgtgccactgaccgcatccgacgtgttcaaagcgaaaaccatcgcggaaatatcccccgccgcgcgtaacgcctacgccacacgatgggacgacatcatggacccgctcggcgatgactcgcacacgctcgaagagttcttctccgacctgcacctgatcgtctcgcacaaggccgtctgcacacagctgcttgaggaattccgcaaagacgtgctcaaaccatacgtgaagaaacagaacgtcatctccttcatcgacgatctgctcgccccttatgccaacgcgtggctcatcctcaaccgtccgaccgacgccaacctgccagacgacatcgtggccatgctcgtctcactcgccgactaccagaccaccgactggaaacccgtggccatgtgggcgctcgtcaactccatccgcaacctcggcagcgccaacgcacaagtgttctccacacccggaaatatcggaaacgaaaccacgaacgcgcacgacgaacgcctccaattacacgacatcgacagactccacgacgttctcgccgcactcgaacgcgtcaccggcgtcgacagcctcaaccggcaaagcccactcgcccgacgcacacgcgccgcaagcgccatccgagacctcaacaaaggccataccctccaacagatccgtggattcctcatcaccgacgaggaccgacgttccgcactcgcgcatctacgtggcgagttgcagaccagtcccgccatgaagaaacttctgctcatccgcgccaacgagcagaaggccggctaccgcatcacccgaccgcgcagtctcaaagcgttgccgatcatgcccgaacaggtcagcgcgaaatccgatttcgccgcttggccggagtcggtgcgtgaccattgggcaaaccgcatcggcaatttggtgcttagtcaggccaatgaaacccaagtcgcgccactcgccacgtatgcgcagcggcgcgaccgcatgctgttgtcggcaagctccagacgttttccgctgacagccgaactcgccaatatcgccgaatgcacaccacagacgctgcaataccggcaggatgagatggttcggctcatcgccgaccattggaatattcgttacgatgccgacgatacggatttgtcgacgttgaacgaggagacgctcaatgtgaaagctacggcctcctcccccacgtccaaacgcgtcagcattgcccaagtgctggaagccgggctgcttatcgccggagagaccttggtatgggagcgtccccgcaagggcgaacgttgggtagcgaccgtcacttccgaaggcaagctgcgcatggatgacggcagggagtatgccacgcctactgccgcggcgcgtgccgttggcggctcatcagcgggtcttaccgtgtggaaacgcacgtcgaatggccagaaactgagtgacgtttggaaggcgtatcgtctgcgcaagcactgaggacgccgaacgaccagatggtcagtctcaaccagccggattcaatcaaccggattcagccggtcaatgccaggccagccattcgacggcgagtttggtgcgattggagatgttggttttggcaagtatgtcgctgatgcggttgcggaccgtgccttcgctgagaaacagccgtgacgcgatctcacgattgtccaatccctcggccacaagttccagcacgtccaattcgcgttcggtaaggccggcgaaacgttcggatggtccgctggaatcggggttccgagatccttgaactgcctgcgcatcatcatgcgacacaacgcgatcgactgatgaggattcgtctgatgtcgtggattgcggactgacccgcagcttgctcaacacttcggcgcccatgaccacttgtccggccatgacggcttgcaccgcgggtatgacggacgaaacgtcctgtttgatcaagtagcctttcgtgcctatttccaacgctttggcgatgtatgactcgtcggcgaatgtggtgaggataaggattcgcgcgttcggatgcgcgtcaagaatcgcctccgacgcttgcaatccgtccattcccggcatctgcacgtcgaccagcaacacatcgggggcatccatctcatattgggtcaccgcatccgtgccggtgttggcggtccatgccacatcggcggtgccggtggcttcgagaatcgtggataatgacgagcagacgattggatcatcgtctgcgatcgcgacacgcattaatgcgctcctttctccggttgcgtcgtttccgaaccactcgccggcttggggatggatacgaacacgcgccaaccctcatgatacggcccgcaaatcgcggagcctcccaacgcacgagcccgttcctcaatgtccgaaatgccgatgcctgtggaatcgttcggtcgaatgaactgcatggcgacggcttcagcagacgatcttctcacggttccatcatcctgcacgcacagctgccacaatgccgggaaatcgcgcagggtgattgaaacgttccttgcctgactgtgtttgaccgtattgttcaacgcctcgcgaatcgcagtggcgaagcagcgggacacggccgccggcgctgaatcgatgccgttgaccagcctcacccgcaaggggccggcgccgtccatgctgtgtgcggccgtctcaatctgcgaagcgaaatccgtaccttcgtctttcaaatcatgcacggctttacgcaccaaagtcatagcctcgctcaccgtgtcatgaatttcacagaaacgttgggcggattgttcctgtccggcaacctgggccaccacgtgcgccgcctcggtctgcatgatggctcgggtcagcatgtggccgacattgtcatggatctcacgtgcgatgcgtgtgcgttcggcaagcgtcgccgtgcgtacggccaacgcacgatcctcgtcgttttcggcgatctgcgagcgcaggcggcgaatctggtcgcggcgggaatcctgcaatcgccgcacttcgcgggcgaggttcgcgcagcgcgcgcaaagcagaccggcagcgaatcccagaaccgtttggagcaccatcaatatgatgatggacaagtcggatggaacgtgcgagccaatcgaacagaaaatcactatcgtcatgggaagaagccacagccatcgcggcaccaacgcttgcaagaagcggctgccatcgacaccagcggacgatgatgccgcgttgaatgctgcgatgggaagcatcagataccacgccggcaccaggcatgcgccgcagtcaagcatgacaatcaacgtcatcgcaagccacgaacccgacgcgtattcccccaccgcggcacaacacaccgccacaagcgcgccgcacatcaggtcaaggccgacatctccggatgcgtatacgcccatgatcatgcccatggccaggaacacggcttggaacaacaaccgtttcatgccgcctcccgtccgccgattcgtgtctgattggttcgcttgcttccagagtaatgcacatggcgcatggcacagccggcggcatcaacgaaggtgacatttgtcatgttcgaaagtgacaccattccggcaattgtgactacgcgcaccatgtcgggggcatccggcggcacgacaatggaatcagaggcatggagcacgagaaaggagctcgtcatgggtggacgcatgaatgacgctgccgatgcggtcagcgcggtcaaggtctcgaaactggtgaaacgttacggagacatgctggcgctcgactatttcgatctcgacgtgcatcagggggaaatcttcggcctgctggggcctaacggctcaggcaagaccacggcgatcaactgcatacttgcgttgctcacgttcgatgagggcactgtgcgcgtgttcggcgagccgatcagccctaccagctatgcgttgaagcggcgtatcggcattgtgccgcagaacgtggccgtgttcaacgaattgaccgtcgaggagaacatcgattatttctgctcgctgtatgtttccgacaaggcaaaacgtcgcatgctcgtggacgaggcgttggatttcgtaggattgcgcgattaccgtacctatcgtccggcgaaactgtccggcggtctgctgcgtcgtcttaatatcgcctgcggcatcgcccacaagccggatctgatctttttcgacgagccgaccgtggccgtcgatccacaaagccgcaatgcgattctcgaaggtatccaacgacttaaccgcgaaggcgcgacggtgatctacaccagccattacatggaggaggtcgagcagatctgcgaccgcatcctcatcatggatcatggccggcatctggctcttggcaccgcggaggaacttaaggcgatgatcagcaccggcgaacgcatcagcatcgaaaccgatgatctgggagggcgctcagattcggccgatacgacgcttgcgcgattgcgcgcattgccgttcgtgaccaacgccgactatgacggccatgagctgacggtgaactgccgccagggcgatcacaatctcatcgacgtactgcagctgttggagcacgagggcacgaatatcgggcatctctccagtcgccagccgacgctcaatgatgtgttcctggaactgaccggcaccgcgttacgcgactgacttggcttgcaaggcttgtggcaaatcgaaaggcatgtgacatcatgtggcagacgttactgatcaatctcaaactgcatttgcgggagaaaacgcaactgttctggctgttcgccttccccatcatcctggccaccatgttcaacggcatgttcggcaacatcgcggaaagtttcgagctgcacacacttgacgtggccgtggtcgaagacaacgcgtggaagacgtcctatggggcgcagacgctgatcgaaggcatttcatccgaatcgtctgcattatcggacaatcacgtgaaagtgagtgccgatggcaagaatggaacgggactcatcaacacgaccaaggtggaatcgattgcgcaggcggaacagctgctggccgacggcaccgcgcaaggcatgctgcgaatcgatgacggcagattgcgattctccgtctcacagtcgacgcaatcgtccgtgtccgatgtgatggcgtcgagcagcggcttggatatttcgctgacggtgctgggcaacatcgtggacctgtacaaccgcaacaccgatgtggtggtggacattgcgaagcacaaccccgaagctctgatgaatggcaaggtgaccggcagcatcggttcggcgaatggctatacaaaggaaatccagctgacgaattttaaaccgagcggtacggcacgatattactatgcactgctgggattggccgcgttgatggccatgagcttcgccatcaacgtagtgacgatgacgcaggcgaatctttcggctttgggtgtccgccgttccgtttcgccgcttccgaaatcgcagcaactgctggctggattcctgtccagttggctgtgttcgttcctgagcctgaccgtggccatgctgtatatccggttcgtctgtcatatttcgttgggcggacgtgaatgggctggtgtgggagcatgtctcatggcttcgttcgcggcgagcgcattcggcacgttgcttggcgcgctgccgaagattccaaccggcgccaagcaggggctgtgcacggcgatcgcctgcacgttgtcattgttctccggactgtacggttcgttcgccatgcagttgagcgacttgatcgcccagcgcacaccggtgctgagtctgctcaatccggcgcagcagatcacgaacctgttctacgacatcctctattacgacaatttcaaaccgttcttcaccaccgccggcatccttgccgcgatgagcctggtctgccttgctgcggcgaccgttctgttgaggaggcaacgctatgaatacctgtaagacggcgctgagaattctcaaatcacgcaagatgtacctggtcatctatttggggttcatcggcatcatgatgttcgccatcagctggcagatcatgcgtggctcgatgacgggtggcgatgaggtgttccatcccgatacggcacgtgtggcggtgatcgaccgcgatggcgatgccgatggtatttcatccgcgctgcgttcctatcttgcgttggatggcgagatggtggaccttgccgacgattccgaagcgttgcagcaggccgtcgcttcgaactatgtcgatttgatcgcaattgtgccgcacggcttcgcttcggattatcagaaatatctggatggttcgtcaaatgaccaaccgactgtcgaaaccgttgtcagctacacttccggagcaggctccctttcgcagctggaagtcaacgaattcctgtcattgacacgcaccgcgtacttgggtcaagccgggaagcagcagtcgatggaaacggccatgcggacggcgttggataccgcgaaagcagatgccaagacgtcgaaaatagcggtggtgcaatcgccatccgcagatactgataataccaagccggcggcatccgcattcgccggcaccatcaaaacgggactctatccgttgctgctggtcatgccgatctgcacgttcctggtgattggcaccttcaatgacagtgagattcgtcgccgcctgtattcgtcgccgacgcgtctggtgtcgttgcagatgcaggagatgctcacctgcgccgccttcggcttggtggtgtgcgtgggttacacggcggcgacattggtcttgatggtggccgcaggagtgccgttcgacgggattacatccacgaatgtggctttgacgttcgtgtcgctgctggcgtacacgttgatggcaatcgcctgcggtttccttctggggtcggttggtttctcggaaatggcggtcaatgcgttcgccaacgtattcggtctgctgtgcatgttcacgtcgggtatggcattccccatcgatatgatgcccgaaccgatgatcatgatcggcaagctgctgccgggatggtggctgtgcgtgtccatcgacaacgtgttcgggcttggcacggcggctgcaaccggtgtggattatggttcttgggcatcgtcggtcggcttggtggcattgtttgcagtggcgttcatctgccttggtctggcattggggcgtatccgtcgcacacgcccgtccttggcctcccccaccaccacgcagttggccaagtaaatccccaagtgttccgttccatcggccgagtcccgatggaacggaacatccgcctttgccgtaggctctcaatcaaatcggatggaaccggacgaaatcggactaggctgaaagcatgatcgaccacattacacttcatgtttcgaacgcggaacgcagcatcgcattctatacgaaagctctgtctccgctcggatacattcccaaagcccatcacgaaccgaccatcggtttcggcgtggatgacggcacgccccgttcggatttctacatctccccgatggacgatccggcgcaacagccgattcccacgcatatcgccttccgcgcaacgaacgaacaagcggtacgcgacttttatgaagccgcgatcacggcaggcggaatggataacggcagacccggaccacgtgcctaccattccgggtattacgcggccttcgtgctcgaccccgacggcaataacatcgaagctgtcacagactggtcgcacacaagccaatcatgaaatcggccgccgaatcgcaaaaagtcatcgggtgacattgcgcagccaacggtacttgcggtagtgcaacaacgcgggaaccattttgatgcattcgtcggtgttgagcagcgcatacaccaccaacacgggcagtttgaacacgaacgcggccaacagcccgaccggcaccacaatcagccacatgacgatggcatcgcacatgagaccgaacttcgcatcgccgccggctggaaaaagaccggcgatcgtcagattcgtcatgcatccgcatgccgcgtaatatgcgcagacgaacagcatgaccgacaggtaccgtgtggcttcgggcgtaaggttcgcccattgcaaagccagcggacgcgccgcgacaatcaacagtcccgtcgcggtaccgaccacggccaccagcacgcacatcctgtcgcccatcaccttcgcctgtcggaaatctccacgtcccagcagattgccgaccaaaatgccgccggcattgcccagaccaagggacaggcacaccagcagatccttgacgatattggcgatggaattggcggcgacggcgtccgcacccaaatgtcccatgatcacggtgtacatggtgaaaccacatccccacaccaattcattgccaagcaccggcaggctgtatttccagaaatccttctgcaacggcccatcgggatgcagcacatggccaagtcgcaggtgggggccacgacgggtcgccacgaccgaccatgccagctcaatcgcacgcgaaatcaccgtggatatagccgcgccgaaaatgccaagcgcgggaatgccgaggctgccgataccgtaaatcagcgccgcgttcaacacgacgtgcacgatcacgccaaccgtgctgaccgtcatgcccatcaccgcggaaccggtgttcttcatcagacacaggtacatctgggacaggccgatgaacaagtacgacaatgacgaaatccgcagatatcgcgcgccaagcatgatcagcgtgccgtcattggtcatgatggacatcaactgttccggcacgagcagtgccgccaggaagaacgccgtcgacagcattccggcatacagcatgacgaatcccagcacgcgttccaccgcgtcacggttgccggcaccccaatactgcgccacgagaatgctcatgcccagggtcagggccgcagtgaacaggctgaacaggaactggaactgcgtggcgagcgagacggcggccaactcgttttgccctacccccgacaacatcagcgtgtcggcgcaggacgacaacgacagcatgagctgttggaaagcgataggcaaagccaatttgaatacatggccgaggaattcccggtccggcatgatggtgcgcacgatagtctccattggaatacaagcccgtttcagacgacgggcaaacgaaaacgtcgggatatgtaggccgaccagccttatcccgacgttgggccgaatattgggcgaggttttacagcgaatccttccatgcgcggtattcggcggccttgccctcccagtattcacggtccgcatcagtgatcttgcgaatcacatggcacgggttgcccacggccaccgaatgggatgggatatccttggtcaccacggagcctgcaccgatcaccacatcatcgccgatggtaacgcccggacagaccaccacgctgccgccgaaccacacgtcattgccgatggtgatcggacgggcgccttccggaccggaagcgcgtacggccgcatcgattggatggtatggcgtgtacaggccgacgcgcgggccgaagaagacacggtcgccgatggtgattctcgccacgtcgaggaagatgcagtccatattggcatagaagttgtcgccgatatacgtgttgcagccgtaatcgcagttgaatggcggttcaaggaacgcgcctttgccgagtgaaccgaacagttcgcggaacagcctgtcacgttcctcgaacgcgtcgtatgcggacgtgttgatggcgtgcaccaagcggcgtttacgcatgttcgcttcacgctgcatatcaccgcaaatatacaattcgccggaaagcatgcgttcccactcgttcgtaggcaccgccgcattatccacggcaacggccgcaccttcattctccgccattgaaagctccttgtgaatctgtttgtcaatcgtttgacgtcctttgacaccattcaacaccaccaacatcgacggtagcactcgcaatgttgtagaatcatccttgttctttgcattatctaccgtttattagagtagtcatgaacactgccgatgaagacgcacagatggaacgggacgaatgggcctcccgtgaggtgatgcccatcactaattggggtcgccgacccgatggttcggagatagtgcagtatgacgcgccgatgttcttctccttcaccgagcattcgctgctccaccagtacccccatatgcgtgcggaatgccattggcatgtcgaccttgaactcacctacatcatccatgggcatatgtggtatttcgtcaacggagaaacagtccggctcgatgaggggcaggcgattttcgtcaactcacgtcagctgcattacggtttcaccaaggacggttccgattgcgaattctcctgcacgttgctcaatccggctaaaatgtgcgcctcattcgaagtgtacgaccgtttcatcgcgccgttgatggcggagaacacgatgccatatgccgtcatcaccgacgacacggcccccggtcggcggctgctcgccaccatccgacagcttcatgcggcgaaattcggtccgctggagcggtcagagcggtcagccgaaccgttgcccgccgacgatatgacgctaaccgacaataccgaggcgttgacggtgctcagctgtttctatgcggtcgtccgcgacatactggcgatcgccggcagtcattgcgcgacttccacagcgccgcacccccgcatcgtgacgctacgcaagatgatcgattacgtgcagagatattacgtgcgtccgatcaccttgaagcaaatcgcatcggccggatcggtgggacgcaccacttgcgcatcgatattccgcgaatcgctcaaccagtcgccaatcgaattcgtcaacgacgtgcgcgtgcgcgccgcagccaacctgctggtaacgagctcgctgcctatcgccacggtcgccaaacagaccggtttctcatccgccagtttcttctcccgcaccttccaccggttcatgggcgtcacccccatcacgtaccgaaccacgcataccaagcggaaatccgaggaataaaaacaatcggctgcgtgccccacgccgtcacgcataaggacacgcagccgattgcgtcacatcaagccggaaacggacacgttcacttcctcttcagtccgcgggcgatggaggcgttgcgcacctcgaccgtgccgtcggtggcgaagacgcccaacgactcgcccggacgctcgtacatgcgcacgttcaacgccaccccatccacgtacaacgtgccgatggtgtcgtcgacgacgagacggatgtggtacgtatgccccgcctcgaggccgatgttcataccctggattggcaacggtgtgttggacggtttcctagaggacgagtccctgtccggtgaattccttcggactccggtatccaagggtggagtggagccgccggtcgtcggaccaccacacgtagtcgtcggggccgcgcctcggctgctcgatcgtggtgtagtggttccggtacacgagctccttcctcagcagcctgtccgtcgattcgaccacggcgctgtcgtagaggtcgcccttgcgcgacagcgatcttttgatgccgaacacgtcgagcggctcgtcgatccccgtgtcgtcgaacccgccgccccggtccgtgcggaacacctggacgtccgccggcgggaagtcgggggtggcgaacgcgcccaataccaggcccgcgtcccgggcccgcccggcggaatggccgacgatgcccctgtccgccaggccggccagcaggcacacgtacgcccatccgctccctaccctcacatacgtcaggtcgctcgccggacgcgtgtgaggggcgtagccgtcggacccgcggtccggcaggttcgcgagcctggcctcgtcggcccgcgtcccgtgcggttcggaccgtccgcgcgcgtacgcgcccgcatgccctgttcacgcatgatgctgccgatgcgtctcctggacgcggtgacgcccccttcccttccagggcggccttgatcttcccggcgccgtagcgtccgcggccgtcgcgccggaccgcgcgcacgtcgccggcgaccggatccgcacgctccgtcccgggacgcccggtcatccagtaacaggtggggcggggaacgcccggtatcccgcatcgcgccgatatcgggcagcgggcggcgttggcccgtatcacgcctgccttcgtgcgaataccggcgccgcttgttctgaaacgtccacctccatctccaactgtcggtcgcgcctccccggctcgaccggctcgttccgcccgggcgtgcggttgtccgcggcccgggtggagccgctgtcgcggatgccttggacccagcgccgcggggtcgatcgcgcgatgtcgtgcctggccctgatctcccgggatggcttgccgctctcgcacgactgcgcgatctgccgtttgaacgcctcgtcgtggtggcggggatgcttcgggtcggccatcgtcggcctccaatcccatgtcattcgtccctcatcggactgtctaatacattgtagccaatccaatgatgccctcgacctggtgttcgaacatgaacgagaaggttctgcgctccacgtcttttctgccgtcggtatccaccaccagcagaattttcccattacgccaggcttcatcctgcgcgccttggatcacctggccggcgaagggcgatgtggccactccgtcgctgatgaagccgatgatgtcggagcggcctcgggccaatccgcgggcgagcgcgttgtgatggtagccgagttcgtcagcggccctgcgcaccttgcggcgtgtggattccgtgatccgcacgtcccggttgtcgttcaccgcccatgaggcggttgcgatggagatcggccacgtcccgcaatgtcactttcgccatgcccgcgtatcagccccgtccgacgcctagcgcatcaggttgcgcaggacgtactggagaatacctccgttgcggtagtagtccgcttcgcctggcgtatcgatgcgaacgacggtatcgaattcggtcgtggaaccgtccgcgtgggtggcggtgacgtggaccgtcttcggggtgacgcccttgttgagttcctcgacaccggagatgtcgtaggtttcggtgccgttcaggccgaggctctcatacgattcgccttcggggaactgcaatggcagcacgcccatgccgatgaggttggaacggtggatgcgttcgaagctttcggtgatgacggctttgacgcccagcatgacggtgcccttggcggcccagtcacgggaggagccggtaccgtattccttgcctgcgagcacgacgagcggcacatcatggtcgatatagtcgcgagacgcttcgaagattgtggtcggcttcttgtcgaggaagtcgtaggtgtagccaccaggggtgatttcctcgccgacggaggcgagcaactggttgcgcaggcggatgttgccaaacgtgccacggaccatgacctcatggttgcctcgacgggaaccgtaggagttgaagttcttcggttcgacgccacggtcggtcaggtatttgcctgccgggctggaggccttgaacgcgcctgccggggagatgtggtcggtggtcacggagtcgccgagcagtgcgagcacgcgggcgccgtggatgtccttgaccggatccggggtggccttcatgccgtcgaagaaggtctgcttgcgcacgtaggtggagttctcatcccatgcgaacagttcgccttccggcacgtcaaggcccttccaacggcggtcgccttcgaacacggaggcgtaatccttgaggaacatctcgcggctgacggtgccatccaccactgcggcgacttcctcattggtaggccagatgtccttcaggtacacgtcgttgccgtcctggtccttgccgagcggctgggtttcgaaatcgaaatccatagtgccggcgagcgcgtaggcgatgacaagcggcggggacgcgaggtagttcatcttgacgtccgggctgatgcggccttcgaagttacggttgccggacagcacggaggtgacggtcaggtcgttggcgttgatggcctcggagatttccggcagcagcgggccggagttgccgatgcaggtggcgcagccgaagccgaccagctggtagccgagcgcgtcgagatcatcctgcagaccggcggccttcagatagtcggcgacgacctgggagcccggagcaagtgacgtcttgacccacggcttgggcttcagtcccttggcatgcgcgttgcgggcgatcaggccggcggcgatcatgacggacgggttggaggtgttggtgcacgacgtgatggacgcgatcgccacgtcgccgttcttgatatcgaagtcgccgcggaagtcagtggataccgcgatcggcttctgcacggttttgtcggtttcgtatgccggtagcgtggcttcgaacttctctttcgattcggacagcctgatgcggtcctgaggacgcttcgggcctgcgatggacggcacaacggttccgaggtcgagttccaggtattcggagtactgcggttctacgtagtccggatcggtggcgtcgccccagagcttgttggctttcgcgtaggcttcgacgagagcgatctgctcttcggaacggccggtcagacgcaggtagtcgagggtgacgttgtcgatcggaaagatgccacaggtggagccgaattccggtcccatgttgccgatggtggcgcggttggccagcggcacggaagcgatgccttcgccgtagaattccacgaatttgccgaccacaccgtgctggcggagcatgtcggtgatggtgaggaccacgtcggtggcggtgacgccttccggaatggatccggtgagcttgaagccgacgacgcgcggcacgagcatggagatcggctggccgagcatggcggcttcggcttcgatgccgccgacgccccagccgagcacgcccagaccgttgacggtggtggtgtgcgaatcggtgcccacgcaggagtcgaggtaggcgaggtcgcgaccgcgctcccccgccttggtcatgacgactttggcgaggtattcgatattgacctggtggatgatgccggttcccggcggcaccacgcggaagttgcggaaggcctgctgtccccagcgcaggaactggtagcgttcgccgttgcgctggtattcgatgtccatgttctgttcgaccgcgtcggccacgccgtacttgtcgatctgcacggaatggtcgatgaccatgtcggactggacctgcgggttgatgacttccggatctccgccaagctccttgacggcgtcacgcatggtggcgaggtcgacgatgcacggcacgccggtgaagtcctgcatgaccacgcgggacggggtgaactggatctcgtggctcggctgtgcggccggatcccaatccaacagagccttgacatgatcatccgtgatgttggcgccatcgatgttgcgcaccaggttctcaacgagaaccttcaacgaatacgggagatgatcgatgcccggcaaatccgcgatacggtaaaagtcgtaatccttgccgcccaccttcagggtgtcgagctggtcgtcgcgcacagacatgctacctccgagcttttgtggctggttgaaactttccagcagccgattatccgttgccaacgatacagccacgttacttcagcactggcgtgtcttcttgaaacgtgagaaaatggcgactattttcggcacgcaccacaggcacagcacgaaaacgatggcggacaccacaagcgcgacgcccgtcgccgcgagcatttcgccggacggtatcacgagcgcgaagaaacgcgcgacgggcggaatgaacatgccggccacgcccgccacggcgaacgccaataccagaccgcctctccacgagttgagtggacgggccacgcgcgccagtacgaagatgcccatcatcagcaggataatcgcgttgacgccacgaagcatgcccagctgcgcggcggaatgctgtgcgtcccagcccatgaacttcggcaacagccacgaatcggcgagaatcgacagagccgtggcgatgcctcccggcaatgcgaagtgcaccacgcgcctgaggaagcccggaatgtagcggcgcgtgttcggcgcaagcgcgaggatgaacgccggcatgccgatggtgagtgcgccgatgtaggtgatatggcggggcaggtatgggaatgggatctgcgtcagcaccacgccgagcgagatcagcgcggaatatacggttttgacgaggaacaggctggccacgcgttccatgttggccatgacctggcgtccacgtgccaccacatcgggcagatgcgagaatttcgaatcgacgagcaccacttgtgcgacggctttggtggcgggtgccgcgttgcccatcgcgatgcccaggtcggcctccttgatggcgagcgcgtcgttcacgccgtcgccggtcatcgccacgacatgatcgcctaggtgcagcgcctggacgatcgccttcttctggtcgggcaggacacggccgagcacgtccacgttctccagtactttcgccagttccgtgatgtcggcgggcagttctcgcgcgtccatgaaccgtggctcctcgtctccggtgagccgtacttttcttgcgatcgcaccgacggtgacgggattgtcgccggagatgatgcggcagcgcacgccctgttcgcggaaccaggcgagtgtggcttcggtgtcgtcgcgaatgtgctcggagcataataccagcgcgacgggccgcgatgcggggtcgatggcgggatcgctttcgtaatcggcgggcgccttgccgtcatgccgtgcgatcagcagcacgcggttgccgtcgtgtgcggaatcgttgaccagtcgaagaacgtcggcgtaatcgccatccaagtgggacagcacgacttccggcgcgcccatcgtccataccgcgccgtcatcggcaatcgagctccatttgcgtgccgacgagaacggaacgcgcgccgcgacgggaccggcggagaatccctgcttgcccagtccgttgagaatcgccaatccggtgccgttcggctgtccttcgttcgacaggtcgtacagcgcctgtttcacggcatgttcgtcaacggtattggctccgatgccatccagcatgcgtatttcgttgagcatgatgccgccgtcggtgacggtgccggttttgtcgaggttcaggcagtccacgcgtgcgagggtctccacggattcgagctcctgcacgagcgtgttcttgcgtgccaaacggatggcggcgagcgcgaagttgagcgaggtgagcagtacgaggccttcggggatcatgccgaccacgccagccacggcggacaccacggcggaacgccattggccggtggagatggctacgtcccaaccgccgaccgcgtgcacctgcgaccagatgagcagcacgcacagcggcacgacgaggaaggtcatgaatttgaggatggtgttgatgcccttgttgaggtcggacacggtctttttgtagaccttcgcctgcgcggtcaaggtggcggcatagctgtgcgcgccgaccgcgttgaccttgaccaaggccatgccggagaccgcggtggatccggaatagatgtcgtcgccttcgttcttgcgcacggtgcgcgattcgccagtgagcatggattcgtcgagttccaggccccaggtgcgcacgatctgcgcgtcggcgggaacctgttcgccggagcggatccacatgaggtcgccgagcacgatttcgttgtgcggcacttcgacgtccttgccgtcgcgtcgtacgagatagtcggaggctacgaggatggaaagcttgtcgagcgttcgtttggctttcagctcggtgacgatgccaatgccggtgttgatgaggatgacgaggccgaacacggcgtctctccatgatcccgtgaccaataccatgaccatggcggcgaagacgatgccgttgaacagggtgaacacgttggctcgcacgatgtcggcgaacgaacgtgacgtggacgatttgacggcgttgacctgcccgctttccgtaagggcggcgacttccgctgcggtgagccccttttcactggtttcaggcatggtttgactttcactcatgctgccagcctaccgcttggcgatgcgcacccgcaggcttttcccgtaaagctccggcaaaattcagggttttctcagggtgcgttcagcgccactcatccgaaccgattcgaactcacccgaatgcgtggagcggttcactgtttgccgccgtggctgatggtggtgacgaggattgttctgtcgtgcgggtcattgttggctatgccggctaccgcgtcggcaagcggcgtcgcatccgtcatgcggtcgttgattgtgagcgtcgcagcgaacagcgtgctgtcggtcggcgtggcgatcgggttgagcagtgccactggaatgcccgcctgtcttgcggttgtcagcgtgtcgtaccagccgtcatggttcacgccggacatgtcgattcccgaaatgacgatgatgctgaccatgcgttgcgccatatcctcgaccgcttgccgggcggtgtcctgcatgtcgaccgtgccggcgaccggcagatacaccggcctgagcccgcccgcctccatggcatccaacgccaggcgatcggtctgttcgtcttgggagccgatcatggccacgtcgagactgttgcggtccttcatgctgtgggcgaccgcatcgcctgcggactgcgtatctcccaccgcggcattgttcggcgtgcagccggccagcatggagatgccgaagacggctgcaaggagaccggctgcggcacgccgcgcgaaaccggtcatcgtgtggctttcctgaatagcgccaccgtttcgacatggtgggtggtcggatagatgtcgaatgcgcgaatatcggcaagatcgtatccgagcgaggccaatgtggcggtgtcgcgtgccagcgatgccgggtcgcaggcgatgtatacgacgcttcgcgcgccggattcggcgatctgcctgcataccttcgcacgtgcgccggcacgcggcggatcaagcaccacgatatcgggtttggccaaatcgttgcgtacgttggcaagcgtcttggccacatcgcccacacgggcgtcgacattgcccaaatggatggccctcagattgcgttgcgcgtgtttgacagcggtcttgccaccttccacgctcagcatgcgcgtgcggccggcgcttaacgtggccaacggcagcgtgaacaggccggaaccggaatacaaatcccacaggcatgcggaagtggcgccgtcaagctcgccatgcaccaaggacatcacatggccggtcaacgcgatcggcgcgtgacggtgcatctgccagaatccgccggcgtccacaccatattcgaattcacgtccgcacaccgtcaccttttcggtaagctcgcgattgcccgccgtcacctcgccatcgacgagcacggcgtagttgtcggcgatttcggcattgccgcgaggctcgggaacagacagacgaatctgcgatccgggagtgaatcccccatcccacacgtgttccttctcggccacgttaagcaacgcgcgactggccaacggcatggtgtcgatcggcacacgcacgtgggtgccgcgtctgcgcatggacggtcggccgttctcgtccgcgatcatctcgatgcgggtacgccagtgcagcccctgctccgcctcatcctcgggcatgcgctcgatcggcacgtcaacgtcgacatggccgagacgtctcatctgttcggcgatggacgtggatttccatttaagctgtccgggcagtgagacgtgcaccaaatcggcaccgccgacgccgccgcccatggcaagcggacccgccaacggccatacgggttcgacgcggtcctcgctggcttccagcacttccgtcacttcgccagtccaaaaacggtcctcgcgatcatgtggctcgtccaacacgacgcgtaccagctcgcccggcaacgcgaatcgcacgaacacgacgcgtccgtcgatgtggccgacgcaacggccttggtcggcatatcgttcgatgcggatggtcgattccatcagtgctgttcctccgtttcgttgttgtcgtccatcgcgtcggcgtttggttcggccaacgtcttatgccgatgcatgggggtggccacgatgaggtacgacacccagatggccaacgcccagaacggaatgcccatgagcagacgtgcagtgccgagccagccgacctggttggacaggtacaacggcacctgcaccaccagtcgcagtgagaacacaccgatccacaacgcggtgatgatggtgtacgcgcggttcaatgccttgtcgccacgccaatcggcaagccatgcgcgcagatgctcggttggcagtgtccggatgaattcgatcaccaagccaagtcccggtacacgtaccatcaacgaaatggcgagcagcacgatgtagaaggcgttggtcaggaatccgaacatgtagtagttgcgcgcctcgtggctgttccatgcccagatcaggcagatgccgactgccagaaggccggagacggcgcccatgacggattggcgttggcataggcggacgatcacctgcagtacggcgagggctgcggatacgccgatggtcagatgcaggtcggaggtaatgacgaacatcaccacgaacaccacgcccggcagcatcgattcgacgacgccgcgcggaccgccgatcgcgtcaatgacggagaaatcgtcggcatcgccggcgtcggcgagcgcgccgaggccggttcttttcttgatttcggtttcagccatgcgtttgtgttttcgtggtcgtcgttcgctcagcgcacttcggagaacatcggtccacgcgacaacgtggtcttgacctcgacctgctggtcggagtcaaacggtcccttcggctggcctggaatgtccatcgtcctgcctgcctgttcggcttcggcggcttccttggcggccttgcgttcggccggggcgaccggcggatgcatcgggatgaggtcacgcggggccagcgggtcctcgccgcgttccacgacgatgttggagaaaagctggttcagcgccttggtttcggcgtggtccggatcggtggcggctttgccggagaagatgccgcgcagcatccaccgcggtccgtccacaccgacgatgcgggtgacgaccttgcgtccgcccttgaccacgaccggcagtgtcagttcggtgccgaacacgccgtcggtctccttggcgtctttgttggcctcaaccaagtcggcgcgcacgtcatcccacagtcccatggtcttcggcgcggcgaaggcttcgatctccacgctggaggatccgtaggtgatggtggtgccgagcacctgctgggtggcgcggttggccttcacgcgcagttcgatgccttggaggaacggcagatagtaggcacccatgtcgaggtattcgtcatagtcgggcacgttctcgtcgtcgacgtcccacggaccgtgctcatcgccacggccgtcgtactcatcggacggttccggaaggatggtttcctgaattccaccggcgggcgcctcggcggtttcggagatggcctcatcggccttgtcgttctcttcggcggcggcttcagcggcttcctcgctctgacgcttcttcttgccgaatccaaacagtcccatgatgttcctcatttcattacggttgcaaccgtgactagcctagcacccatgcttaatacgggctgggaatcggagtgtgtcctcccgttgcccggcattggccggatgacggccgcaaaaactcacacgtcgtaggtgatgctcagcggcgcatgatccgaccatcgcaggtcgtaggtcggagctttgtcgatgacgaatccgcgggccgtttcggcgagttcgggtgtggcgaactggtagtcgatcctccagccgacgttgttgtcgaaggcgcggccccgctggctccaccaggtgtacggtccttggatgtctccgcacagggaacgcatcacatccacgaattccaactcccccagccatttgtccacgtaggcgcgttcctcgggcaggaagccggcgtgcttctcgttggctttcgcgttcttgatgtcgagcggcgtgtgcgcgatgttgaaatcgccgcacaataccgcctgcttgccgccgtgcgccgcttcatcgcgcagttgtcccatacgtaccagcatggtgtcgaggaaacggtatttctgcttcattttctccggatcgtcagtgttgccggcgtgcacgtacacgcatacgacagtgacggtgtacccttgcggggtcttcacatccgcttcgatccaacggccggaatcgacgtcctcggcaagtcccggcagtccgtagcgcttgtcgatgacgggcagcgcggagagcagaccgacgccggcgcgtcccttgatacggcagatctcgttcatgcgatcaagcccgctttggtcggcgatgcgtccggcggtcgcgtattcgaagccgaattcgtcgaagatggggtcgatttcgttttgcggggcgcgtacttcctgcatgcaccacacgtccggcgtgttcttcgcggcccattgctcgatgcctttgcgtttcgccgcgcggattccattcacattcgatgtcgtgattgtgatcgtcatagcgccttagcctagccggaatacaagaaaacctcccttgtgggaagggaggttttccagatggctgacgcgatcagtcgagtccgagctgcagcttgccgcctgggatggcgtccagcaggtcgcgggtgtactgcttcttcggatggtcgaagacctcgtcggtggtggcatgctccaccagcttgccgtgctgcatcaccacgacctcatcggcgatctgacgcaccaccgccagatcatgggtgatgaacaggtagctcagtcccttttccgcctgcaggtcgttgagcaggcgaagcacctggtcctgcaccagcacgtccaatgcggagacggcctcgtcgcagacgatcacatccggatcgagggccatggcgcgcgcgatggcgatgcgctgcctttggccgccggaaagctcgttcggataacggctcatcaccgattccggcaattccaccatgtcgatgagctcgcgcacacgcttggcacggctcttcttgtctccgatgccgtggatgcgcagcggctcctcgatggaccggtagatggagtacatggggtcgagcgatccgtacgggttctggaacaccggctgcacatgacgtcggaagtcaagcaactccttgcccttgaatccggagacgtctttgccgtcgtaggtgacggtgccggcggtcggctcaagcagtttcagcaccatgttggccacggtggatttgccggaaccggattcgccgacgatggccaatgtggtgcccttcttgatggagaagctcacatcgtcgaccgccttgaacatctccttcttgcgcggcagtttaaattccttggtcaggtgatccaccgtgatgatggcttcgcccttcttcagggaatcctcgttcaccgcgtgctccatgaccgcggtggcgtcgccgccatgctccttgacggagatgatgcgctgcgatgccaaggacggcgcagcggcgaccaaacgcttggtgtacggatgctgcggatgctgcagcacttccagtgaaggaccggattccacgacctggcccttgtacatgaccacgatatgctgggcgcgttccgcggccagaccgagatcgtgggtgatgaacagcaccgcggttcccagggaatcggtcagcatgtgcagatggtcgaggatcttcttctgcacggtcacgtcaagcgcggaggtcggctcgtcggcgatgagcagttccggacggcaggccagaccgatggcgatcagcgcacgctgacgcatgccgccggagaattcgtgcgggaactggcgggcacgggtggcggcgtcaggcagaccggcctcggacagcagaccggcgatgcggtcgtccatggtggagccgaccacatacttcttggcgatgtaccatgcgtcatcgtccttcaccccggccttgatcaggccatcggccacacgccagcgggtttcggatcccggaacccattcctcggcgaaccgggccatgatcttgtcaagctcgtcaccgctcttgccgatcttgacaagagcctccttggccgcggcgatcagatcaggcagttccttggaaccaaggaaggtctcatcgtcattgcccttgagctccacttcgtcaccggccagggccttggcgaattcggaacgcttttcgtggtcgatgtccatgttgttggccaccaacgcttccttgacctgggtgccgatgcgccacaccgggttcaggttgctcatcggatcctgcgggacaagacccatcttgctaccacggagcttgtcgaaatccttctgcttgaagccggagatctcctggccatcaagcttgatggagccgccgaccacatggccggttcccggaagcaggccaagcacggccatggcggaagtggatttgccggaaccggattcgccgacgatggccacccactggccgggatacacgctgaaggacgagttgcgcacggcatgcacggccttgccttcatcggtggtgaagtcgacctggaggttcttgacctccaacagcggcccgtgggcgcgctgcatggcctcgaggttgttctcggtattcatttcagtcatcgaatatcccttcacttacactcaggccgtacggctcttcggatcgagcgcgtccttgacggcgtcgcccatcatgatgaatgccagcacggtgatggccagcgcggcggacgggtagaacagcaccatcgggtcagtacgcaggatggactgcgcgttggagatgtctccgccccagctgaccgtggtggtgggcaggccgacgcccaggaagctcagcgtggcctcgagcacgatgtaggtggccagcgaggtggtgccgaccacgatgatcggagccagcgaattcggcaggatgtggcggaacaggttgcggatcggggtggatcccagagcggtggacgccgtgttgaattcaaggttcttggcttccatcacagcacctcgcgcgattcgtgccacggaggtccagccgaacagcgtcatcaccagaatgatcttccagatggagctgctcgttttgaacatctggagcaccacgatggcgccaagcagaatcggcagcgcgaggaagatatcggtcagtcggctcagcacggcgtcgacccatcctccgaagaagccggcgattgcgccgatcagcgttccgagcagcaccaccagcagtgtggcgaacacgccgacgctcagcgaggtgcgggtgccgtagaccacacgggagtatacgtcgcaaccttgcaggtcgaagccgaacggatggcctgaggaagccggctcaagggaattgtcgagcgtgcagtagttcgggttctgcttggtcaacacgctcgggaacagcgccacgaacacgatgaagatgatcagcagtccggagatgatgaacagcgggttcttacgcagggttcgccatgcgtcggcccacatgttcgaagccggtgcggattcgtccatcgagtcgacggccttcaggggcgtctcatcgagcggtgccacatagcgttcctgtcccggaagcacggtggaaggattggtctcattcatttcggtcatttcttgttccctccctcgactcacgcgtaacggattcgcggatcaagcgcggcgtacagcatgtcgaccagcagattgcaaaccacgaagatcagcatgagcagcgtcacgatggacaccaccaggttgccttctcccttgaggatgctctgataggtcaggtagccgatgccatgcacgttgaagatggtttcggagatcatcgcgccgcccatcagtgcgccaagatcctggcccagataggtgacgacggggatcatggagttgcgcagcacgtggcgcagcatgacggatttgttgtccatgcccttggcgcgcgcggtgcgcacatagtcgagggcgatgttggacgaaatctccgtacggctcagacggatgatgtacgccatcgatacagagccaagcaccatggccggcatcagcagatcaaggaatcctggattcgttccggcggtgaccggcagcagatgccacttcacaccgaggaagtactggcagaggaagccggtgacgaaggtcggcacggagatgagcagcagggagaagatcaggatgacggtatcgcaccacttgcccttcttcaggccggagatcacaccgaagatcacgccgaaaaccgcttcgaacacgaaggccatcagggcgagcttgatggtcacggggaaggcgcggccgatcacgtcgatgacaagctgtccggagaaggtcttgccgaagtcgagggtcagcgcgttcttcaggaacagcagatactggacgatgaacggcttgtccagattgtattcggcacggatctgggccgcgaccgcttcgttgaccggcttgtcgccgaacatcgccttgaccgggtcgcccggcaacgcgaacaccagggcatacaccagaagcgtcgtgccgagaaccacagggatcatctgcagaatgcgtcgcagaagatacttgcccattggtttctccttttgattactcactcgttcgccagccgtttgcggcttcgtcccctacgctcacgcgtataggacatgaggcccggggcggccggcgcttgccccattacgtatcagtgatactgcaccacaatgctttatattgcagtttcatgaaagacagctgaaaatataccccacgcgcggacatcttctgttgatgtcgcatgtccagccgtcatggacctccgatggaagccccgtttattacgcggaaaggaaggaacggatattcgaatccgttccttccttcatgtcgatcctacgaaatcaaaatcagagaacggctcacttgccggacttggtcatgttctcgtagaccggcaggttctgccagttcatctcgaagccggagacaccggtcgaggccacaccataggcattggcgtagtacagcggaacggccggcaggtcgttgagcagcacttcctgtgcctgctggtacagcttgttggcgtctgcgacggacttggaggcagcggccttgtcgcacagcgcatcgaactccgggttcttgtagtcgccatcgttggagccgttgccatcggcagcggcggaggcgaagttctgcaccaggtagttttcggcggacgggtaatccggctgccagccgctacggaacgcgccgttcaccttgcggtcggacacggcggtgcggaaatcgttgaaggtcgggtacgggttggtggcggccacgccggcgcccagcacgttgttgatggagttgaccacggcggtgtagatgacttcgtggccaccatcggcgttgtaggcgaaggtgagcttgtcatcggaggtccacgggctgatggcgttggccttcgcccacagttccttggctttcttctcgttgtacttcaggttgccggaacccttgagggaatcggagtagcccggggtcagcggggaggtgaagtcggcggccggggtgccggtgccgttgagcaccttcttgcagatgttctcgcggttgatggccatggagacggcctggcgacgcagggtgccttcctcggtgtcggcttcgaagtgcttcagcttggccgggatggtgaactgctggatgacggagccggccttgttgtaggcctgtacggtggagtccttctggaaggtcttggtggcggaggccgggacggactccatcacgtcgagggaaccggactggatgtcggcgtaggcggcctcatccttggtgtagaccttgaaggtcacgccgtcgttcttggcgacgcggttgcccttgtagtcggggttcttcaccagcacgatctggttgtcgtggtcccaggactggaacttgtacgggccgttgccgaccggcttctcgccgaaggccttcggatccttgaagaaggattccggcagcggagcgaatgcggtgtagccgaccttgatggcgaacacggagtcggaacggttcaggtcgacggtgaattcatggtcgttgacgaccttcaggccctcgagctgttcgtcgcccttgagcttgtctccatcctggagcttgtcgtagcccttgatggtggagaagaaggaggagccgagctgtgcgttcttggcgttggccgtgtagctccatgccttggtgaaggattcggcggtcaccggggtgccgtcggtgaacttccaaccatccttgagcttgatggtgtactgggtggcgtcatcgttggacttgatggactccgccacttcgttggaggcgttgcccttggcgtcgaaggaaatcagacgtgcgaacagcaggtcgagcggcttgccgccgccggtctcgttgcagtcgcccgggatgagcgggttctgcggttcggaattgtatgcggtgatgacgttggaacccttgtcagcggtggagtcaccgttggaagagccgcaaccgctgagcagcatgccgaatgcgcatgcggccgcagcgaaagccagagctttcttcttcatggaattcatattctccttatccattatttccagagccgtaagaccctgctcaaaaagaaggcgggcgtcaataccgtggcatcaacgtccgtcttcgttctgatggtgggttcattatcgctcgattgagggacaaccgctccatatccgagggaggcccatgcaaaatagccaaatcaaaactcatcatctgataaaacaatccgtttttccctcttatcgccgggacaacttatccgcatcgtgtgtatggacggacgcggacatatccgttcgctgtcagcgtactttgccaatccgcgtcacgcccgtggaaacgcctgcccgtatcgtgccttcaactgttcgatggacacgtgtgtgtaacgctgcgtggtcttcagcgaggaatgccccagcatctcctgcacctcacgcaggtccgctcccccgtcgagcatatgggtcgccgcactgtggcgcaacgcatgcggactgatgtctggcacgccggcctcccgtgcccggtcgtgcaccaccttgcgcaccatacgttgatcgatccgcccgccctgcgatcccaaaaagaacgcgtcgtccgacatgtcaccgcatagtacgggacggccatgttccagccaatcgcgcaaggccttgtcggctggtgcgccgaatggcatgacacgctgcttgtcgcctttgccggtcactttcaccgtgcggttgccgaatgtcacgtcggccacgtcgagtccgaccagttccgccacacgcatgccggtggcatagagcagttccagcatggccgcgtcacgcagcgcgatcgcctgttttttcatattcggttcctgcgatcgcgcctccatgccgtcctcatcaacgcggtccatcagctgctgcgcctgcgtttcgttcaataccgccggcagcgtatcggggattttcggcgtctgcaacgaagccgccgggttggcggacgccatgtcatggtcgtacgcccatgcgaagaatccacgcacggcgacggttttgcgcgccatgctgctgcgtgcgtgatttttggacgattcggccatccacaggcgcaaatcctcgatggtcacctcattcagatccacgcaaccctgtttccgcaacgccaccaagcattcctcgacatcgctgcggtacgccctgcgggtgtttgcactcaatccacggttggctttcagataggcgtcgaatccgtccaacgcatcatcgaaacacatgcaaaccaccttccgcttcgtctgaaatgaacagacaccacgcagacaccgtataaatgccattccgcaacgcgatcgaatgtcatctcacgcgatggcacgattccattatgtccccataccgatagactgatgacgattaggcatcctacgaacaggcggtattatgactcgtcattccattcatgacgtacagcatccgacagccgaaaaccccgatgatgggattgtggcccgcgccatcgacctgaccaaggtctacggctcaaaagacaacgaagtgatggcgttggatcatgtgaatgtggaattcaagcgcggtgaaatgaccgccatcatgggcccttccggttccggcaagtccacgctcatgcattgcatggccggactcgacgccccttcgtccggcaaggtgatggtggagggcctcgaggtctcctccatgaaccagaagcagctgacggatctgcgccgcgaacagatcgggttcattttccagtcgttcaatctggtgccgacgctgtccgccgaggagaacatcctgctgccattgcagatagcgaaacgtccgatcgaccgcgactggttcaaccaagtggtcaaggtggtcggtctggagaagcggctcacgcaccgtccaagccagctgtccggcggccagcagcagcgtgtggcctgcgcccgcgccatcatggcacgaccgtccgtgatcttcgccgacgagccgaccggcaacctcgactcgcgttccagccgtgaagtgcttggcttcctgcgcgattcggtacgcgactacggccagtcgatcgtcatggtcacccacgatccgcgtgcggcctccttcgcggaccgtgtgctggtgctcgccgacggcaacatcacccgcgacatgcagcatccgacgtacaacgagattcttgaggtgttcgccggcgacgacgacatcgacgatgtttccaagtacgccgcctccaccgccgttccgaccgtgacggaggactcgcaggcatgattcgcataggattgcgcgacgcgcgcagccatttcggccgtttcatcatgtcgatcgtggccatcgcgctcggcgtgagtttcgtggtcggctcgttctgtttccgcgaaatgctcaacaaccaggtttcacagatgatgtccaccaatgcggaccatgacgtgtacgtgcgcggttcgcaggagaagaaaaaagattcgtcggcgatgtcgatgggatcgacgaaaaactacaacgatgtcgacgtcgatctggcgggtacgatagccaaggtcgacggtgtttcctcggcacgcgtcgtgcacatgctgtccggcgtagtgctgctcgacaagcatggcgatgcggtgaccaccatggggtctccgacgctcgccataggcatgggcaagtcgtcgccgtggcggtccgccaagttcacgaccggcacgtggccgaagaacggcgatgagatcgcccttcattccttcgccgccgaacagtcgggtctgaaggtcggcgataagacgaaaatcgtctatccggacggcgctcataaggtgaccgtcagcggcatcttcaccaccgatgccagccaggcaggcgccatcatcatcgccatcgatcccgcgacggccaaggaacaggcgaacaagcaatcggacgatccggacaagactgcgttgatcagcgtctacggcaataagaccacgccgcttgacgacaacgcgcagcagcagctggcggaccgtatcaacaaggcgctgccgagatcggcgaaggcacatgccatcaccggtgatgaataccgtgacgaatcaaccaaatccacgcaggacgcgctcggcttcatccaaccgcttattctgattttcgcggtgatcgcattgtttgtcggctcgttcatcatcgccaacacgttctccatgatcgtgcgcgagtcgatgcgcggctatgcgctgctgcgttccatcggcgcttctcccctgcaagtgttctccacggtgatcgtgcaagctctgttgctgggcctggtaggttcgctcgcaggcatcgggctcggctggggcatggtcaaactcatcgcatccggtttggcgaatatgggtatgccattgaccggcgccaccaatccgaccgtttccgacatgctcgtcggccttgtggtcggcattgtggtgacgttgatcggtgcggccctgccggcgcgaaatgcggcgcttgccccgccgattcaggcgatgaacgaaaccgtcaatccggaaaagtctgtcctcgcacgtggcatcctcggcaccgtcatggtgctgttgggcttcctgagctggggcttcacctacgctttggccgccgcggatggtgacggcggtccgacgccgtggaaggcgctcaacagtatcgctgtcggctggccgctcggtattggcgcggcgctggccgtgatcggcgtgattgtggcgggaccggcatacgtgtccaccgcgggcgcggtgctcggctggctgccatcgaaggtcttcaccgtgaccgggcgtctcgcgcaacgtaacatttctcgttcgaaacgtcgcacgtccaacaccgcagccgccctgttcgtgggagtggcgattgtcagctgtctgggcgtggtggccacgtcggcgaaggcttcggtcaattcgctggtggataccgggctcaaagccgatttcgccgtatcttcggcttcggccgggcagattcccgaccaggccatcaaagacatcaaaaaggtcgatggcgtgaatcatgtggtgtcgaaccgtgtggtgcttggtgtgaaatatgacggcaaagccatcaacgggttcacgttcgccacacagccggaactgttcaccaagatcttcgccgccgaaaccaccgaaggtgatgccgctgccgcgttgaaggatggcaagctgctcgtcggcaagaccattgccgacgatcgtggatggcatgtgggtcagaaggtcaaggccacggccgagaacatcgtggtagacaaggaggccacagccaaggcgcaggccgattaccaggccaaggtgcaggcgcatgtgcaggaattgcagtcgcaggcccagcaattggccgcatccggcgacttgacaggagcgcaggccaaggcttcggaaatcgaacagtacacgaacgacgccaagaacgtcgatccgaaaacgctggtcaagacgaagaaggtcaccaccggaaagacgctgaccatcggcgcgatcgtgtcgaattccgtataccgcgatttcgcgatcgtcaacgacgatttggccgagcaaatcggcaacaagcagaccatgttcgtcatgcaggcgttcgtcacggacaagcggggcgccgacacggcccaagtcaagaaggccctgaagaaaacaatcaagaaatactatacaatcgtcgtgttcgatcgtgacgagtacaagtccacgatgagctcgatgatcgatcagatgctcatggtcctgtacgcgttgctggctttgtccatcatcatcgccattttcggcatcgtgaacacgctggcgttgagcgtgtcggaacgcaccaaggagattggtctgctccgtgtcatcggcacgtcacgtggccaggtgcgtggcatgcttggcatcgaagcggcgatcatctccgtgttcggcacggtgttgggtttgatcgtcggcgtcgccgcgggagtggtgattcgtgcggtctacgcgtccgaaggtttggagacgctggcgattccgtggttgcagctgctcgtgttcctgctgctatcgattgtggtcggtctggtgtccagcatctcccccgcctcccgcgcgttgaagcagccggtccttgacgccgtggcgagcgagtgagacagttggagcggaacatcgaaaggaggcagcaatgcctattcccaatgagattccagtaggagcgcgcatcgtggtgcgcaccttggaaggcgtcgatcctaccgatcatcgtatgaagttccgcgattacgtaggccacgtgcgttcgtgggacggtcagaaactggagatgacgcgcgatgcggcggcgaacggctcacgtcccgagcagcgtgtcacgattcccgccgacgaaatcgtgacgatcaagccggtgccggaacgttccatgactcggccacgtccgtagtcgcatacctccccctaccgcgcgcaaagacaagagcgccgcaatcgcactgattttctgcgattgcggcgcttttgcatagcgatggcgtcagtcgtcagaccacggaacgcgcctgcgcgatcgcggtacgctcgccgtcgaatcgcacgatatgctcgcctctgcgggcggattccagcagcgtgcgctgccaatcgttttcgggaatcgacagttcgaccgtcgcgcaatgttcggcgtactccggctgcctgctggcggccttgtagtcgcggaacggttggccttgggcgaagaaacggtccatttgcttcacgtcgccttccgtagggcgcacgccggtatcggccatgtcatgcagcacgttggccaccaacgtcaatcggttggccatgttgcgtagcaaggtctccacgttggccgcgtcctcctccaccatggcacgtgtgcggttcggatcggtcagcgccacgcgcgtcatgtcacgccaggacccggctgcgagcgcggccgcgatgttgcggttcgggttggccaccagctcgttgatcatggcggtggcgatgacgtgaggcatatgtgagatgagcgcggcgcaacggtcatgggtggcgtcgtcaagtacgatgagccggttgccgcaacggttcacgatcatgtcggccacggcgcggaaccggcggtattcggtgtgttcgtcgacggtgatggcccagagcgcgtcgtcatagagtgtcgggtcggatgcctcccagccggacagttcgttgccggccatcgggtgtgctccgacgtagcagccgtcaagaccaatggctttgacttggtcgcggaccatgcctttgacgctgcccacgtcggtgagcgtggttgtttccgtgtcgatcaatggtttcaatgcgccgaggatttcgggcatggccttgagcgggttgcacagtacgagcacgttcggtttggtttcggcgagtgccgccaaggtgggtttgcagatgatgccgtcggcttcggcggtggcgtaggggcggtcgttgtggttccatgcggtcacttcgcagccggcgttgacgagtcggcgtgccagtgatcctccgatgaggccgagtcctacgattgcgatgcgtggcttcaccacatcagctcccttctgacggtttcgtcgttctgccaatcgtccggcaggtggctgtcgtcgagtcgtacgccgccttgcggcagcatccatgaggtgacgggcgggttggggtgttccctccgcgggtagacggcgagtgttttggcccagtcgccatgttctgcgatttccacaagcgcgtcgcggaaacgttccttccaaggggcggcgtcgagggtgacgatgaagctgtatgtgccggtgcgtcctttgatgggccgtgagatgaagctggtcatgttcagtcccgcgtcacggaacacgtcgagcaggttggcgagcacgcctgggccggtgacgagcgggatgagcgtcaataccgattcgtattcgacgttagcttcggcgcgtggtttggcgagcagccgtgcgacttcggcgcgtggcgagagcacgaggaagtcggtggcggctccttggtagtcctggatggcggtgccgatgcgggtgatgtcgtacagttcgccgcagatggcgggaccgaaggcgatttcacctgggataaggtcccggcaggccgccgcgttggatgtggccggctgtgtggagagccgatgttcggcgatgaatcgtttgcattgcgcgagaccgtgcggatgggctgtggcgatgcgcgcttcggctggatcggctccttgcgccacgtatgcgtcgaattcgacgttcacaccgacgcgtgcgaatccgacaaggtccttcgcgtcgatcagcgcgtcgaggttgggcaccacgtacccttcgacgttgttctcccaggccacgattccccagccgtcgccgtgctgtgcggcgtcgagaatctgcggcacatcgtccatgggcatcaggtcgaagccttgcggttcgaaccgtgccaactcttgggcggcattgacggccgcctgatgggtgaaggtgccttgtggccccagatagaacagcttgcgtgcgctcattgccgcctgtgcctccttgttgcgggtcatcctaagcaccttagcgcattcgcgaggctgtggaggggtctagtccaccggttgggcggtgtcatggtccggttcagacgattcgttctggtcatattccgtggagtcatcctcagtgcgcggcggcatcgtgaaccagctcttgggcagcgccagcatgatcaatggaatcagcaccacgccgtatagccagaaatagccggcgttgttgctgaaatacggcaacgtcgccgtctcgccgaatccgacgggaatcatggcgtccccgcccggaccgtaaccggccatgacggtccagaccaccagtgatgaactgatcagatgcaatgcgaggcccgacacgccatcacgtgaacgcgccgaccatgtcgagatgatgaccagagcatatgcgatcacaagaccgtagggaatattcgccgacgcgcccatgcggtgcgccatcgtgccgatcacgccgacgacggcaccggcgagcaggtcaaccaaaaaccgcgcccataccggtagacgatgcgaccacggcagcagcctgcggtcgatgccgtcctgtgattgcgattgcggttccggctgtgtttcctgcgtgcgttgcgtcatgtcctccactatgccctacgttccttacaaaacagcaagaaaggcaagagatacgcggaaaaccgccgacatctcttgcctttcttaagcgtttagctcactagcggaacacactaccgttcccgcgaagcgccaaaacaatgcgaagaatcacttgttattctgagcgttgttctggcgacgctgcttggcgcgccacttgtaccaatcctcacggctcagaatgatcttgcgcacgcggatggactccggagtgacttccacgcactcgtcctcgttggcgaagtccagggactcttcgaggctcatcttgatcggcggggtcagggtttccagcacgtccgcggtggcggaacgcatgttggtcatgtgcttggccagcgtgatgttcacatccagctcgtccggcttgttgttgatgccgacgacctggccctcgtacaccggggactgcggctcgacgaagaagttgccgcgtgcctgcagacgctgcatggcgtatggggtggcgacgccctgacggtcgcagaccatggagccgttctggcgggtcacgatctggccggcccacggagcgtagccagcggagatggaggaggcgatgccggtgccgcgggtggcggacagcagcgcggtgcggaagccgatcagaccacgggacggcacagtgaactgcagacggacccagccggtgccgtggttggtcatgttgtccatgcggcccttgcggtcggcgagcagctgggtgacggcgcccatgtactcttccggcacgtcgatggtggtgttttccatcggctcgttgaccacgccgtcgatggtcttggtgaccacctgcggacggccgacggtcagttcgaagccttcacggcgcatctgctcggcaagcacggccagtgcgagttcgccacggccctgcacttcccaggcatccggacggtcggtcggcagcaccttgatggacacgttgccgatgagctcgcggtcgaggcggtccttgatcatgcgggcggtgagcttgtggtccttgccttcggtgccggcaagcggggaatcgttgatgccgaaggtcatggagatggccgggtcgtcaacgtggatgagcggcagcggacgcggatcgtccgggtcgacgatggtctcgccgatcatgatgtcgttcacgccggcgacggcgacgatgtcgccaggacctgcggattcgaccggggtgcgctccaggccctgcgtacgcagcagctcggacacgcggaagttctcgatggagccgtccacacgggacaggccgtaggtcttgcccttctcaagggtgccgttgtagatacggaccagaccgagtcggccgaggaagtcggaggaatcgatgttggcgacgtgggcctgcagcggagcgccctcctcgtattccggagccggaatgttcttgatgatggcctcgaacagcggctcgaggttgtcgttgtccggcagaccgccgttttccggctggttttcggaagcgtaaccggccttggcggcgcagtagatgaccggaaggtcgaagagggaatcctcatcgaggtcgatgccttcctcgatgacgtcctgggccaggccgagcagcaggtcggaggattcaccgacgacttcggagattcgggcgtccggacgatcggtcttgttcacgcacaggatgaccggaagcttggcttcgagggccttgcgcagcacgaaacgggtctgcggcagcgggccttcggaagcgtcgacgagcagcacgacgccatcgaccatggagatgccgcgctccacctcgccaccgaaatcggcgtggccaggggtatcgatgatgttgagggtgatgccttccggatggccgtacttggcggccagcgggccggtgtactgcaccgcggtgttcttggcgaggatggtgatgcccttctcgcgttccagatcgttggaatccatcacacggtccgggacttcctcacgctcgttgaacacgtgggactgggccagcatcgcgttgaccagggtggtcttaccgtgatcgacgtgtgccacaatcgctacatttcggatatcgccgcgaaccgccatcgaaacctctcttagtgttgctgttctcttacgtaaacgttcggtacgtacatgctatcggtacttaaaaatccgtacttacacacaaaccgagccaattctagcgaagcattacgacacatggaaaacggcggacctgtcagatcatgccgacaggcccgccgtcaatcgcgcgaagagacgcgcggaccttaatcctcaagctccttgccagtgcgttcaggcaggcacagggccgccacgcaggcgagaatgaacgccacggcgaaaacgatgaatgccacggccttgttgccaccggacaaggtcaggaaccatggcatcagcagcggcgcgatgatcgcggccacacgaccgcaagccgcggctgcaccggaggcggcgccgcgcagacgcgtcggatagatttccggagtcaccgcgtacaacacgccccaagcgccaaggttggacgcggacagcagcatgccgaagcccagcacagcggccacggaaccggcttgggagaaggcgaacgcggccacggcggacacggcgaggaacacgctcagggtcttcctgcggccccagatctccaccagccatgccgcgaggaagtagccgggcagctgtgcgatggcgatggcgagcgtgtagccgaacgacttggtcagcgagccgaactggtcggccagcagagacggcatccacgtgaacgcgccgtagtaggagaagttcacgaagaaccatgtggcccagatggctgcggtgcgcgcaagatacttcttgccgaacagctcgcgggttttgatcttcggcagcggctcgcccttcggggatgcgaccggttcgacgcctccggcctgttcgaagtagcgcacggcctgctcggcctcatcctcacgtcccttggattcgaggaatcgcacggactcagggatatgaatgcgcgtcacgatggcgtacagcagcggcaatgctccgatgagcagcgcccagcgccatccccaatcgccggtgttaggaatgacgaaatagccgatgcaggcggcgatgatccagccgattgcccagaaggattccagcagcaccgtcatacggccgcgttgtttggtcggagagaattccgagaccaatgtggaggcgaccggcagctcggcgcccaggccgaggccgatgaccagtcgagcgatcagcagagccgccagcgaccatgacaacgccataccgccattggccagaccgaaaatcaccagcgtcgcggagaagaccgtcttgcggccaacgcggtcggccacgaagccgccaagcgcggcgccgatcgccattccgacgaaaccgatggacagcacccagcttttctcggtcggcgtcagattgaaatgcgggtcggccgcgatggcggccacgacgaacgacaccagaccaacgtccatcgcgtcgaacgcccatccaatacccgaagccaccaacagcttcctgtgcgccttgttgaacggcagtcggtcaagacgctcgttgcgagtcagcgagacctctcccccaacagtttgttgcgatgcggacatcaacacccctttatcattgttttcctattgtgtcgtgagctcgttcaagcccgacgatggcaggcgatcacgccgtcatcaatgcggataacgcgtcgtcatcctggaaagcaattcgagtgtcgtccgattcggatgccgttccggcttcggtccacaaatccgttcccggcttccggctgtaccggtagaccgccgccggcctgttacggccgatccgcagtttctcaccggtgtcttccaacagtccggaagcaagcattttacggcggaaattcgccaaatcgatacgctgtccggcaatcgcctcgtacacgtcatgcagttggctcaacgtgaatcgctcgcccaccaatcgagtggcgatgtcaggcgattcgattttgccgcgaagccggttcatggcgtattcgacgatggtgcgatggtcgaacgcaagttccggaagatggttgacggggaaccacttgacgttgtcccctccggcgaagtcgattcgtccatcggcctcgcccaccagggcccagtacacgatggacaccatcggcagaccgccatgcgaacgtgccggatcgccgaacgtgtaaagctgctcaagatatttcggatgcagcgacgtcgtcgattccagtgcggcatacgccgactgttccaatgaatggtcggccctcagaccgcctcccggcaacgcccattgccccaaaaaaggctgacggacgcgtttgaccagcggcatccacagggtggagcccatgccggacgaagcggcaccagcgcccacatctgactgcggaaccggtcccaaagccagaatcaccacggatacgccgacctgcggaggctgcttgcgccgttccgagacattgcccatgatcaattgatggcctcttccaatacttcgaattgcttacaggaaaggagtctaacacttatagtcaacatgactataagtgtgtcgagtcgctcataaacaccaagagcccccaacggggctcttgcaaagttcaggccacgatgtcgttggcgatcagctcgcgggccacttcacggtattccttcgccgtcttgtggttcggcgcgtagatggtgatcggcgcggccgccaccgtggaatccggcagcttgatggaacgcgaaatcacggaatggaacaccttgccttggaacgcctcgtagatacgctgcaacacctcctcgcaatgcagggtacgggtgtacatggtgaccagcacgccatacacttcaaggctcggattgatgcgcgactgcaccttctcgatggattgcatgagcagcgccacgccacgcagcgcgaagaattcggcagcgaccggaatgatcacaccgtcggccgcggtcaacgcgttcaccgtcagcaggcccaacgatggctggcagtcgatgatgatcacgtcgtactcgtccttgacctggcgcagcacaccggcaagcacctgctcacgtcccacttcggtgaccagttgcacttcggcggcggacagatcgatgttggccggcataatgtcgagattctcgaaatcggtgtggtgaatcacgctgtgcacgtccatgcgcggattgaacaacgccgtgtacacggtatcctccaccgcgttggcgttgatgccgagacccaccgtggcggcgccttgcggatcgaagtcgacgatcagcacgcgcctgccgtattggcttagcgcgccgccgatattgatggaactggtggtcttgccgacgccacccttctggttgcacatggcgatgacccttgccggaccgtgcgtctgcagcggctccggtgcgggaaacgtctcataatcacgtccaagcaaatccgtaggcataccgtttaccttaccaacatcctcgtgtcaaaaattccactgtttccatgctagcccatcatcgccgtcagaaacggcagcaacacatgcatctcatgctatcttgcccttggatgcgaggtcagatatgtctcgatgaggttctccgggcttacatgcgtgtagatctgcgtggtggtgacgctcgcgtgacccagcagttcctgcacggtgcgcacgtcggccccgccttggatcagatgcgtggcgaaggaatggcgcaatgtgtgcggatgcaggggcttgtcgatatgcgcgcgttccccggccgcacggatgatctcccacaccgattgccttgacagtcgtttgccgcgcttgttgaggaacaacgcgcgtcgttcggtgggccctttcgccttcgactcgagctgcggccgtccgtttttgaggtatcttgcgatcgcctcacatgcgtaactgccgaccggcaccagacgttgtttggagcctttgcccatcaatctcgcaacgttcgattccaagtcgacatcgtcaagattcgcgccgcacgcttccgacacgcgggctccggtggcgtacatgaattccagcaacgccttgtcgcgcagcatcgcgggatcatcgggcatgtccgccatgccttcggattgaggccgattctgcgagacggggatcgcgtccagcaaactggccacctcgtccacagtgagcacgtcaggcagcgtcgtcgcgcctttgggagccttgacctgtgccgcaacgtcattggacaccacatgttcgttcagtgcgaagcgatggaatgcatggatgctggccagtcttcgtgccttgctgcgcgcggattctccggaatcgtcaagaaaggcgatgtatcgttccacgtcctgcgtggtcactgcattaaggtcttgaatgccttgcgtcgcaagccagccgttgtatttgcgcaggtccgagtcatatgcgcgcaccgtggctttcgcaagtcctcgttccacgtcgatgtacgcgaggaactgatcaatcaagcgttcgatatccgtcatcgtggtcctccgtttgcatcgtcatcatttgtcgtgtccgttccgtcacgctcccgtacggaacgcgttgcccgcatggaggattccaaggacgttcgttccaagtggaagccgtcattggatggaaatcaacattccggaaagtctattcaaagtatccggtatggggaacgcgatacgcaagaacccccgtccgtttgccggatcgggggttctgaagttcacaggtgaaccgtcggggaaactcaggcttccttcggagcgttcacgtcagccggaagagcggccttggcctgctcgacgatggccttgaaagcctccggatcggagacggccagctcggcgagagcgcgacgatccagctcgatgccggcaaggtgcaggccctggatgaagcggttgtaggtgatgccttcggcgcggacggcagcgttgatgcgctggatccacagcttgcggaagtcgcccttgcgagccttgcggtcgcggaagttgtaggtaaaggagtgcagcagctgctccttggccttacggtacaggcgggagcgctggccgcggtagccggaagccctctcgagaacgacgcgacgcttcttgtgggcgtttactgcgcgcttgacacgtgccatatttgattcctcagctttctattaagtctttgtttctaagctctcgctatgctcagcgaccgagcagcttcttcatgttcttgctctgggaagtggccagaacaccgtcggccttcagctcacggcgcttacgagcggacttgtgctcgaggttgtggcgcattgcggagccggcgtgcatcagcttgccggaaccggtcacgcggacgcgcttggaagcggcggaattagttttcatcttcggcattgctgccctccttgtttgttacttcgtttcggaagtcttcggtttgtcggatgccacggctgccttggctgcggctgcggccgctgcctgggcctcctgcttggccgccagacgagccgcctgacgagcctggcgctcggcacgggactgatcgccacgacgacgctgctcggactgggtatggaccttcttgcccttcggcgcaagcgtcatgatgatgttgcggccttcctgcttcggagcgaattcgacagtgccgtattcctccacttcgctggcgagacgctgcaacagctcgacgccgccgatcggtcgggactgctcgcgaccgcgcagcataatggtgaccttgaccttgtctccgccgttcaggaagcgcacaacatggcccttcttgacctcgaagtcatggtcgtcgatcttcagacggaagcgaatttccttgatttccgcggtgctctggttgcggcgcgcctcacgagccttgatcttctcgttgtacttgtacttgccgtaatcgatgagcttggcgaccggaggcttcgcgttgggcgccacctcgacgagatcgaggttcgcttcctttgccaggttcagtgcgacggaagtcgcgatgactcccacctgctcgccgttcgggccgatcagacgcacctgggagacgcgaatctcgtcgttaatgcgtggttcgtcgctgatgatgactccaatcctcatattccatgcaacggaacatcctttgattggcagttttccaaagtctcgattgttcaaggcatgccaaaacgcatcacaacgcgccgtaaacccgtaagagcggcttacatatctcaccgagacgaccggtggaaggcatctgcctgaacccgaggccctgaaaggcttccaggtggggatatcccgctttcttgatttctcaagccttgtagataataccacaccccgggaccagcgcgtgtcgcaccggtcccggggtgttcgtcaccattcggacggcatccgccgtcaggcgatggcgatgacgtctggcttctcgccgtcgtgcacgaagtagacgtcgtaccacgtcaggaacgagtacacggtccagatcttgcggcgatcgtcggttttgccggcatagttgtcatcgatcatcttcagcagcgcgtcctggtcgaagaactggctgacgtaatcgcgttcgaacacggaacggacgtacttgtagaacttctcctcacgcagccacttcttgatcggcaccgggaagccaagcttctcacggtcgtaccattccttgggcagatgacgtcccgccgcctggcggaacgcgtatttcgtgttctcgtcggtgatgaggtacttggtcggcacctgctcggccacgcccatgagctccttgtcgagcagcggcacacgcaattccagcgaatgcgccatggtcatcttgtcggccttgagcagaatgtcacccggcatccactgatgcatgtcaaggtactgcttcttcttcagttcgctcagacccttgccttccacacgcgcatacgtcttgtcgacgatgctttgcacgctcggcgccttgcggtattcaggcttgagcagctgttcggactgcgattcctcaaacacacgtgcctgtccgatgaagctttcctcggccggcgcaagattggcgtacagatgccatgcgcccgggaaggtcttgcccttgcagaaccgggcgatcgccttgcgcgcgccggctggcagatgcgtgagccagcgagtcaccaccttgatgggcttgaatttggtgtgcacgccgtagtcgatgtatccggcgaacaactcgtcggcgccttcgccgctcagcaccaccttcacgtctttggcggccaatgcggacaggaagtacagcggcacgcagctcggattggagtccggctcgtcgagatgccattggatgcgcgggaacgcggcgaacgcctcctcgtcggtcaacgactcggcggtgttgttcagtttgagcagttccgccagttcgccggcctgctgcgattcgttgtacgtgcctttgccaaaaccgatcgaatacgtgtgctgcggacgcgccacggcggcgacgtagctggagtcgacaccgctcgacaggaaggagccgacctccacatcggcgatctggtgcgccttgacggaatcgcacaccgtctggtcgatcgagttcaccagctcgcccagcttctgcttgccttcgcggaaatcctcgtcgtaataccggtggatgtccatcttgccatcccggtacgtgaaatagtgcccttccggcagcttgtagacgcctttgaagaaggtctcaccgatcgccggatactggaaggtcatatacggcttcaacgcctcggcgttgagctccttgacgaaatcggggtggcgcaacaggctcttgatctccgacgcgtacatgaacgtgccgttcatcttcgcatagtagaagggcttgatgccgaaatggtcgcgcgcgccgaacagttcctgcttgttcttgtcccagatcacgaaagtgaacatgccacgtacgcgctgcagcaaatccacaccccactgctcatagccgtgcagcagcacctcggtgtcgcttttggtggtgaaggtgtgtccggccgcgatcaattcctcacgcagcgtctgatagttgtagatctcgccgttgaaggtgatgaccttcgaaccatcctcgttgtagatgggctgctggccgccgccgaggtcgatgatgctgagccttcgatggccgagcgccgcatgctcgtcgatgtaatggccttcgctgtccggcccgcgatgcgcgatcatgtcggtcatacgttggaggaccgggcatttcacgtcaatgggcatatcgttgacgaaaccagcaattccgcacattatctgcaatcccttcaaaacaaactcggtgtcagtgtaccagcatccgcatgtcgaaaaaccgccgccgcgcctccgaaccgattcatgcgtgacaatctccacaggtttcagacattttaggtatgccgcatagccatgaaaatgacgattctttcctttcgtccgtcacggctacactaccgggtatggatttccacgatgcccgcacctgcgtgatcttcggcgcaggcgattattacgatgagacccctgcgattccggatgacgccttcgtcgtcgccgcggacggcggcctcgaccacgcccgcgccttcggcatcgacgccgatttcgtggtcggcgacttcgattcgattaccggcgaccgccccacgcaaaacgaccgcaccatcgcattgccttcggaaaaggacgatcccgacctgctgtcggctttgaagatcggctggctgcgcggcgcgcgcacgttccacatatacggcgcgctcggcggacgaatcgaccatacgatttccaatatccagcttatggcgctactggccgaccgtggcgcgaccggctacctgcacggcgacggatcgatcgtcaccgcgatctgcgacggcgcgctcgatttcccggcggacgacgccgttgcgggacgcatggtctccgtgttctcccacagcgatatctcgaccggcgtaagcgaaacgggattgaaatacgagctgcaccacgccgacatgagcagcacgcgcgtcaacggactgagcaacgagttccttgccggcaggccgtcccgcatcacggtggagcatggcacgctcatcgtcacgttccccatcgaggctcccctgccgcacgtggcgcgatggcatggcttctccggagatctcggtgcattggacacggacgtatcctccgcgctggtcgagccaagcggccgttgaacgcatgcgggacatgcatgtgagcgttcactgaaaatcgcactgcattttggaacacgcgcctcggaacgttgccctaagtacaggtgacgcactacagtggacggtgttggtaaacaatggcttcagtgtgcctggcacacgcgtggcctaccctaaagggagaattacatgacagttaagattggtattaacggctttggtcgtatcggtcgtctggctttccgccgtatcttcgagctgcaggctcgtggcggccaggccggtgacattgaggtcgctgcaatcaacgatctgaccaccccgtccatgctggcctacctgctgaagtacgacagcacccacggcaccttccgtcatgacgatggcaccccggtcgaggtcacctccaccgacgactccatcgtggtcgacggcaaggaatacaaggtctacgccgagaaggatgccaacaacatcccgtgggtcaagaacgacggcgttgagttcgtgctcgagtgcaccggcttctacacctccgctgagaagtcccaggcccacatcaacgctggcgccaagaaggtcctgatctccgctccggccaaggacgagaccaccccgaccatcgtgttcggcgtgaaccacgagaccctcaaggcttccgacgtgatcgtgtccgccggctcctgcaccaccaactccatggccgccatggtcaagctgctggacgagaactggggcatcaaggctggcttcatgaccaccatccacgcctacaccggcacccagatgattctcgacggcccgcgcttcccgaaggctcgcaacaaccgcgccgccgccatcaacaccattcctcattccactggcgccgccaaggccatcggcaaggtcgttccgtccgtgaacggcaagctgcagggccacgcccagcgcatccaggttccggatggctccgtcaccgagctgaccaccgtcctgaacaaggaagtcaccgccgatgagatcaacgccgccttcaaggccgccttctccgacaccgacttctacggctacaacgaggatggcatcgtgtcctccgacatcatcggcgacacccacggtggcgtgttcgatccgacccagaccgatgtcaacaccgttgacggcctgaccatggctcgcaccgtctcctggtacgacaacgagtacggcttcacctgcaacatggtgcgtaccctgctgtacttcgccgagatctccgagtgaatcggcgcggagtaatccgcacggttcgtctctgaacctcagaacaaaggggctttcgcttcggcggaagccccttttcgtatccgaaacgccgcaacggacacgtggaaggcttattatgggcggcatggcaaagaaaaagcatgagaagggcgccggttccacaccggccaccgtgcagttggaaaaagccggagttccgttcaaaacctacgaatacgcgcattcgaacgatcacatggatgacggttatggggttgaggccgccaccaagctcggtttcgacgagcatcaggtgttcaagacgctgatggcggacaccggctccgaacgcgtggtcggcgtggtgccggtcagcggacatatggatctgaaggcgctggccgcggcagtcggcgcgaagaaggcggcgatggccgatccgaaggtcgccatgcgcgaatccggctacgtggtcggcggcatctccccgcttggccagcgcacacaccacaagacggtgcttgacgaaagcgcgctgcaatacgacgaaatcctgctgtcgggcggcaaacgcggtttctcagtcggcgtcaatcccaacgatctgctcaaggtgctcgacgcggtagcggcgccgatcggcacttggtaaaaaacacgccgatacatcacaccaatacataagtgggtggtcggaacaacacgatgttccgaccgcccacttgcgtaagcgaaaggttcgcgctatttgcgcagttccgcaggaagcacgaaatgcatgttctccttgatggtttcgatggtgctcacatcctggtagccaagttcttgcaacgctgcgaccacgccggaaaccagctcgtccggcacggaggcacccgaggaaatacccacggattcgacaccttcaaaccatgcggggtcaagttccgaagcatcatcaacacgatgggcgcgaccagcggcgccaacagccgtttttgaggcgtaccgcgcgctaagtccctcctgagcgacttccatcaaccgcacggaattcgaggaattcgcggagccgacaatcaccacgcaatcggcttgctcggcaacgagcttgaccgccgcctgacgattcgacgtggcatagcagatatcggagttcggcggcatttcaagccatgggaaacgagctttgagcgcggtgatcgtgccagcggtctcatcgacgctcaacgtggtctgcgtaagcagcaccaatttcgtgtcaggttggaaatccaacgagtcgacgtcggacgcatgctcgatcaaatgcacatgttccggcgattcctccaccacgccaacggcctcatcgtggcctttatgcccaatgtagatgatctcgtaaccttccttgacaaaacgcagcacctcgcgatgcactttgcttaccagcgggcaggtggcatcgaccacatgcatgccgcgcgccgtggcctcggctttgaccgccggagacacgccgtgggcggaaaatacgattgggatgccggcttcggcggcggcatcggggatctcagccaattcctgcacgaacaccgcgccctgcgcggccaaatcctcgacgacatgcttgttgtgcacgatctggcggcgcacatacaccggcggcaatccgtcggcacgtggcgtatcggcggatttgagaatcgtccgcaccgtcagaatcgccctatccacgccggcgcagaatccgcgcggatccgccagcacgatgcgtttgcccatgtcaagccgccttccaatcgtatccatccatcacaacagcaatcaccaatattaaggcacgggcgccgtcaatcgacatcggccgtcttcatccgcagaatttccacacgacaaacgcatccaccaccacatcgtgagcggtaacatagtagcggaaacacagtcgacaacactatggagtgatttatgacctgcaccaatctgccgccacgcaccggacagcaattttccatttcgcatggcgattaccatgccgtcgtcaccgagttgggcgcgacgctgcgcaaactgacctaccagggcgaggacatcatcgtctcccccggtccggatgacatggtgacctgctgccacggccagctgctcatcccgttcccgaaccgcatcgagaatggcgaatacaccttcgaaggcaagacctacacgctgccgatcgacgagcatgagcgccacaacgccatccacggctacggcaagcgcgcgttctggaagcttgtctcccttaaagaggatgccgtgaccctcagctggcgcgcccccaacatggagggatatccgttcgacatcgtggtgaccgcgacgtacagcctcgccgacgatggcctgcatctgaacatcagcgcctacaacaacggcgatgcggacgcaccgtgggccttggccatccacccgtggctcgccaacggcttcaacggatacggcgatgagatcgacgcccacaacgccaagtgcagcctgaccgtgccggggcgcacgcatgtcaccgtcaacgagaacctcattccgaccggcaccgagccggtggacggcaccaagtacgacctgcgtaaggacacgctgctcaccgagcagccgttcgacgacgcttggacggatctggagcatgccgaagacggcaccgtcaccgcggtgttcacccgtccggacggcaagaaggtgcgtgtgggcggcgacgagaccgtcacctcgttccaggtgtgcaccggcaccggtttcccggccatcaagcatccggccggcgtggcggtggaaccgcagacggcatacgcgaacgcgttcaacaccggcaaggacctcatcgtcatcaagccgggcgagacgtcaagcacggcgctgttcatcgggatgctcgactgatataatcaccatcggaataagtcccggccacacagcggacgccgaatttggcaaacgtctcgctcgtgtgcgataatcccgaaggcttattaatcgcaagtaaaggagtccaatcatgggcatgcgcggacgtaagcgcaaggatcgtcgtaagaaggccgccaatcacggcaagcgcccgaacgcctgatccctgccggcgcgaatagcgtcacagagcatggaaaaccccgcggaatcattacggttcgcggggttttcccatattcagacgctgatgcggcgggcacgcctcgcgtcacatcagcgtggcacttggcgcatgaaacgccgcacgtccttccaattactcgtcacaacagtggtcgagtgtcgcctcaagcctgtcgatcaggctttgcggcgcgtgtttcggccgcaggtacgcgcgcatcgctgcgatcagcgcacgttcgcgttcatcgcaacaggtctccgggtcgaagcagtccccggaggccacgacatgcacgctggcatgcgtcacctgcgtcaccacaccgttcgtgttggtggtggtcgaagtaatggagatgtgccgttccattggttcgctcatggtcgatccttcccggcagtggcatagccacgttccttggcgtaattggcaagctcacgtttcagctgtgtgcgggcgcggttgagccggctcatcacagtgccgattttcacgccttgttcctcagctacctggctgtatgatttgccgtcgatcgcggcgtcgatgaaaacctgcctgcgttccggggaaagccggttcaaagcggccatgatctcctccggcgcgtaggcgtccaagtattcctgttcggcggatttgagctgttcggaggaatgttcggacgcggaatacaggtcccagtcgtcgtattcgccggtggaatcgttggcgcgttgcggccgtcgcttggctttggcgtactggttgaaataggcgttgcgttcgatggtggtcatccaagccgcgaaattcgttccttctttgaaggagtcgaacgccttgaatccacgttcgaaggtgtcctgcaccagatcctgcgcgtcgtcgggattgttggtcagtttcatcgcctgccggtacagcgagtccacaacgggcatggcaagcttctcaaaccgcgcgcgccggcccgccatggattccatttcttgttcagtcacaccctcattgtaacttccccgacgtcacacgtcgtgcacatggttgccgctaaaatggctcttcggtatccgctcggcgtctcatacacagggagaacacgaaaacatggctttgactctggaatcggcggcccgactgctcgataggcacggactgctgcgcgaaatcatccgcggcgatgtctggacgcttgatccgcacgacatcaagggattcgacgagccgttctccgcaatcacctacgacacccgcaaggtggagccgggcacgttcctgtgctgcaagggccgtttcaaggccgaatatctgcagggcatcgacgaacgcggccttgccgcctatgtgtcggagaacgacttctccgacgccacgcaagctccgggccttattgtggatgacgtgcgcaaggccatggctttgctatcggctgaattctatggtcgtccgcaggaccagttgaaggtggtcggcatcaccggcaccaaaggcaagaccaccaccgcctatctcacgcaggcgatgctcaatggctgttccggcggcaagtgcgcgctgttttcctccgtggacaattgtcttgacggccacacctacgtggaatccgatctgaccacgccggaatccatggatgcgttccgcatgatgcgcgaggccgttgataacggcatggaatatctcgtcatggaggtctcctcgcaggcctacaaggtggaccgcgtgttcggtctcacattcgacgtggccgcgttcctcaacatcagcccggaccatatcagcccgatcgagcatccgacgttcgaggattatctccactgcaagcgtcagatcgtcaagaactgccgtgccctcgtattgggtgccgattgcgcgcgcgccgacctcatccggcaggacgcacgtcataccagcgttcccgtcaccacgttcgcgcttggcggcgattccatggcagacgtcatggccgcgccggcgaatgacgatcacagccgcttctccatcgtcatcgacggcacctcgatcggcgagttgagcctgacattggacggcgatttcaactatgcgaacgcggcggcggccgtcgcgatcgcccgtgcggccggtttcgatttcggttccgcacaggccaaggacgcgttgcgtgagatggagccggtacgcatcgccggacgtatggagcatttcaaggacacgcggtcgaacaccatcgccattgttgattacgcgcataactacgcgtctgtcaccgcgttgcttgactacgtcgatcagcgttacggcagcgaaaagccggaaatcacgctcatcaccggctccgctggaaacaaggcatacgatcgtcgcgccgaaatcgtccacgccgcgcaggaccgcatcgaccatctcgtgcttactttcgaagacaccgacgacgagcctgtggaacaggtctgcgcggacatgaacgacagcgtcaccaacccgcagcttgacgtgaagaccattctcgaccgtgccgaagccgtggagaccacggtaagccgcgatcgcaaggatcccgagcatctgcacatcatcctcatcatcggcaagggcaacgaacgttggttcaaagaccacggcaagcacatcccttacgagggcgacgaccgcatcgtggaacgtgtgttccgtctcaaataacaactaaggtgaaggcattatgacacgattccaaccgattctgctgggcagcgacatcaacgtctacggcatggccagggcgttccatgaggagtacggcatcgtttccgaggcgtatgcgtatttccagctgagccccacgaaattcagccgtatcgtcaacgtgcacatcgtcgacgatttcaacaacttcgtcacgttccgtaatttcatgctcaagctcggcaagcgtatgaaggccgaggatccggaacgcgtgctgctgctcatcccctgcggcgacgtgtacgccaatctgctgagccagtgcggcgacgatcttcgcgaatatttcgtatacaacacgcttgacgtgaacctttcgcgccggctcgcctacaagtccacgttctaccagatctgcgagcagtatgatctgccccatccgaagacgcgcaccgtcaccgccgatgaggtgaaggcaggagcctactgtgatttgccgttcagctatccggtggccatgaagcccgcgaattcggtggaatggctcaacatcgatttcgagggccgtcgcaaggcctacatcttcaacgatccggccgaattggagaccatcatcaagcgtgcgtacgatgccggatacacgtccgaaatggtgattcaggacttcatccccggcgacgattcccgtatgcgtgtgctgaacgcctatgtggaccagcatcatcgcgtgcgtatgatgttcctcggccacccgctgctggaggatccctcccctgtcgccgcgggcaactatgcggccattctgcccgactacaacgagggtgtgttccgtcgtatcaaggctttcctcgaggacatcaagtacgagggcgtggccaatttcgacatgaagtacgacgaacgcgacggcgagtacaagctgttcgaaatcaaccttcgccagggacgttccagctatttcgtcacgctgaacggcttcaatctggcgaagtatttcgtcgacgacctcgtcgaggacacgccgttcgacggcaacaccctgttcggccgcggttcgaagctgtggcttgagattccgaagtcgattttccttgattacgtcgcagaaggcgctgacaaggaaaccggcaagcgcatgctcaagtcgggcgattggggtaccaccttggagtattccaaggatatgaatccgctgcgttggctgatgattcggcacatgttctcgatttacaagaagagctatgccaagtacttcaccaagaagggcgagcttaagtgaaacgaccgtttttcgccgtactgggcggcatgggcacgctggccaccgaaagctacatccgcttggtcaaccgcgccacgcatgcccattgcgatcaggattatctggactacatcgtcttcaacgattcctccgtgccggaccgcaccgcgtacattctcggcgaatccgacgagaatcccttccccgtactcgccgacgatatcgagaaggcaacggcgatgggcgcgagtttcattgtgctcacctgcaataccgcgcactatttctatgacgatttccaggcgttgacgacggtgccgattctgcatatgccacgcggcgcggtggcacgcatggctcagcgttatccgaaggatcgttttccgcgggtcggtttcctcggcaccgtgggttcgcgcaaatccggcgtgtacaagcgtgccgtcgaagaggccgggtacacgttcgtcgaaccgaccgacgagttgcaggcccgtatcacttcgttgatttatgacgatgtgaaaggtagtggcgagctcaatctggaacgctacgaatcggtgttgcgcgatatgctcgatccggcaggcccctgcgcgtgcgacacgctgatattgggctgcaccgagctgagcgtgctcaacgaggcgtttccgctgccccagctgccggtcatcgacgcgcaggccgtgctggtggaagataccgtggcgcgggccgaagcgttgcgcgcgtagctattatttgtcacgcctatcttcgactgcttaggcgtcggacgataaaacaagattgtgggtggcttcccattgcctggggagccacccataatctgttttacatggacggtgtacgccgcacgtatggcgtcatcgtccgatgttgtttcgcttcgtcacttcgtttcgttttccgaagccgtttccgcatccgccggttcgttggcatccgccgcctcatccatttcatccgcatcggcgtctgctaaaacggaatcgtccggaccgacgctgccgaaatcgttgatgttgaaatcagggttggcgtcggattcgaaatccacgtcagcctcgtcctgctttttgcgcggttccggatcgacggcttcctggaacacacgttcggcctttggcttcttcaggtcggggttgatcttctcctccagcatgagtcgcgcatcaccggcggttgtgaagctgccacagacgagcacgccatgaccgtagccgacgcccagttcgtcatcggcatcaaccatgttgacggcttcctggatggcgtccggcaattcgggaatgcaggtgacgcgttccggcccgaaaacacggtccgcgatcttcttcagatcctcagccggcatcactcggtcacgccacgagttctcggtgacgatcacatggctcagcaacggttcgagcacgcccagatactcctcgacctgcttgtcccccatcatggcgaccacgccgacgagctgctggaaatcatagttctcttcaatggcggcacgcagcgattcggccgcgttcacgttgtgcccgccatcaaggatgatggtaggcgaggtacgaatttgttcgatacgtcccggaatgcgtacgctgctcaacgcttcggccaccaaatcgccgtccaacgcgccgttgacgggaatcaccacttccgccgcgcacagtgcggcgagcgcgttgtgtgcctgatgctcgccgaatttggcgatcggcacttccgtgtaggtgccgttcggggtgcgcagggtggccacctggccgccgacggccggcactcgggtaacgacttccgattcgacgccgtcgcgcaccaagctggcgtggttctccttggccgcggcctcgataatcggcatgacctcgtcctcgtgtggctggcggccgatgatggcggtgcagttcggcttgatgatgccgaccttttccgtggcgatttcctccacggtgtcgccgagccatgccatgtggtccatgtcgaccgggccgatgatggccgcgtccgcgtcgagcacgttggtggcgtcccatcggccgcccatgccgacttccacgatggcgacgtcgaccggcgcgtcggcgaatttccagatggccatggcggtgagcacttcgaagaagctcatcttcggcttgcccagctcgtccattttcatgtccacgatggcgacaaggtccttgacctggtcccaggtgtcgacgaaatcgtcgtcggacagctgctggccgtcgatggcgatgcgctcgttgacgtgttccagatggggcgaggtgtataggcccgtacgcatgccgtaggcgcggcagatggcttcggccatgcgtgccgtggagcctttgccgttggtgccggtgatgtggatgacgcggaacgactgctccggatggcccatgatgtcgaggatcatcttcatgcgttgcaggtcgagattggtggtgttgcgttccgatggacggctcatgatgtcgcgttcgacgtcgatcatgctttcgttgttgcgattgggatgttcgaatgacatatttcccgttttcctcccgtaccttgcggacagcacactaaacttttcccattctagatgtccgcatgaacgttgcgcgccgggaaaagttataggatgggttgcggtaatttccgtacgttacgaatgcatgttcaggagatgtgatgggcgaagtcattactgacaaggacaaggaatacgagaagatggagcgggagtccgctccgggaccggatcaggccatgagcgatcgtgtgaacaatcgttcgctgcgtccgcgttccgaggcgttcaaggagttcatgaccaccggttgggatgacaacgagccgcagatcgagccgttggagtcctccaagtacacgccggcgcgtctggaggcgttgggcaaggcgttcccgggcgagcgtatcgtgattccggccggacagccgaaggtgcgcaacaacgattgcgattacgcgttccgtccggatacgacgttctcctactacaccggtttgggtgaggatttcgaggccggcgcggtgctggtgctgaatcccgtcgatccggattctccggaagcgaaggccggcaagacgcatgttccggaactgttcgtggctccgcgtgccaaccattacacgcaggactttttcatgaacgcccattatggcgagtattgggtgggtccgcgtgccggtgtgaaggaaatgaccgcgatgaccggcatcgaaaccaacgacatcgcgcagctgcccgacgcgttgagcaaggatgtcggcactgaggccggcgcggtgcgcgtgcgcgtgattcgtgaagccgatccggcgattaccagcatggtcgaggagatccgtgaagccaacggtttcgctgatccggacaataacaccgctgccgatgacaagctgcacgaattcgccgccgaggcacgcatgtgcaaggatgagtatgaggttcgcgagatgcgcaaggccgtggccgcaaccaagcacggtttcgacaacattctgcgcaagattccgtcttcccttggcaagccgcgttcggagcgcatgctggagggcgcgttcaacgccatctcccgcgaggagggcaacgaggtcggctacgacaccatcatcgcttccggcgcccacgctccgattctgcattggatgcgcaataccggtaccgtggagtcgggcgagctgctgctcatcgacgccggtgtggaggtcaacagcctgtataccgccgacatcacccgcacgttcccgaccaacggcaagttcaccgatttccagaagaagctgtaccaggccgtgttggattcccagcaggccggtttcgaggcggccaagccgggcgccacgtattcggacatccatcatgcgtgcatgcgcgtgatcgccgaacgtctgcatgactggggtattctgccggtcgatgtcgaggagtcgctctcccctgaaggccagcagcatcgccgttggctcgcctgcggcgtggcccaccatctgggtctcgacgtgcatgattgcgcgcaggcgcgttatgagtcgtatcagaacgccaagattcgtccgggcatgatcttcaccatcgaaccgggcctgtacttccgtgaggatgatctgctgattccgccggaataccgtggcatcggcattcgtatcgaggatgatgtgctcatgacggaggatggtccggaatggatttccgcgggcattccgaagcggatcgacgatgtcgaggcgtggatggccgatatggccgccgaaggtgcgaaggcctgaggatgcatcatgcccacgcctgaattcgtactcgaacttcgtaagaagataggccacgatctgttatggctcatgggcgtctccggctatgtcgaggacgagcagggccgtgtgctgttgggacggcgctccgacaccggcgaatgggccatggtgtatggcatcaacgagcccggagaggaaccggccgataccgttgcccgcgaggtcaaggaggagaccggcgtggatgtggtcgtcaccgatctggtgtcggtcaaatcgtccagaaaggtcctcacctatgcgaatggggacaacaccatgtacatggatcacctgttcatctgcaggcccgatccgaatggcaacacggagccgttcgtcggcgatgaggaaagcctcagcgtaggctggttctcccctgatgctctgcccgaaccgttggcagccaccacggtggaacgcatggcttacgtacgcgaatatctgaaggccaaggcgaatggtgattcccatgcccagtttgccttcaacggcaccatccgctgaaatcgccttccatacatcataaaatggaatccccgcaacgtttcaagcgttgcggggattcctttttattagattccgtggatcagctcactgctgggcggcaagcagctcatgcagatgctcgcgatgcttgcgctgttcgcgcggatcgggcaccggcagggaggccagcagcttctgcgtgtacgggttctgcggattctgcatgatctggtccgcatcgccatgttccacgatctggcccttgtgcatcaccatgatgcggtcggcgagcatgtcgaccacggcgaggtcgtgcgtgatgaacaggcatgcgaagccgatttcggcctgcagcttcttgaacagttccagcaccttcgcctgcaccgacacatccaacgcggaggtcggttcgtcggcgatgagcaggcttggcttcaacgccaacgcgcgtgccaaggaggcgcgctggcgctggccgccggacagctcgtgcgggaaacggttcatataggcgcgcggaagctgcaccatctcaagcagatcgcccacatacttgcgggcgtctgataccgacgaaaacttcttgtgcacgatcaacggttcggccacgttttccgcgatggtcatcagcggattgaacgagctgcccggatcctggaacacgaagccgatgtcggcgcgtttgggtttgaagtcgcgttccttcacaccgttcatttctatgcctagaacgttcagggaaccgccggaaatcttctgcaggcctgcgatggcacggccagtggtggatttgccggaaccggactcgcctaccagaccgagcacttcggaacggtggatggtgaagtcgatgccgtccacggccttgaaatcaggctgcatgagatgacccggatacgtgatggtcagtcccttggcctcgaccgcgatgggctgatcgcgccaatccttctcacgttcgatgaccttgccatcggcatccttgacgaccagtttctggccaatacgcggcacggcggcaagcagacgcttggtgtagtcgtccttcggcgagtagaagatctgctcgacgctgccctgttcgacgacgtggccgcggtacatgaccacgacctcatcggcgatgtcggcgatcacgcccatgttgtgggtgatgatgagcacggatgcgtcgaactcgtcgcgcgccagacgcagcaggtcgaggatttcggcctgcacggtcacgtcgagggcggtggtcggctcgtcggccagaatcaggccggggttgagcaccagggccatggcgatgacgatgcgctgcttctggccgccggagaactggtgtgggtagtagtcgatgcgggtttccgcgtccggaatgccgaccttcttgagaatgtcgatggacttggcacggagttccttcttgtccttcatgccatgggcgcgaaggccttcctcgatctgccatccgatggtgtacaccgggttgagcaccgaattgggctcctggaacaccatggccgcttcggcgccgcgcatttcgcgcagctgttcgccggacagcgacagcacttccagctcttcggtgcccgcgcggttcgacaggtacaccgcgccggaggtcgtagcggtctccggcagcagcttgatgagggagcgtgcggtcacggacttgccggagccggactcgcccaccacgccgatgaccttcttacggggaatttcgaagctgatcttgtcgatggctttgatggaaccggcgtcggtcatgaacgagacgctgaggtccttgatctcggcgagattgccttccttgatttcactcatcggttcactccccttcctcggaagcccattcggaagccacgaatgacggatcacggtcggtgacggtcaccggtttgtcgctggctcccatcggattcttcgccgcctcaagttcggcgacgacctcgttgcgcttgcctggctcctggctggggtccacggacgtgtcctcgatggaacccaccacttcgcctgcggacttgcgggcgcgcagacgcggatcggccagatcgttcagcgattcgcccaccagggtgatgcccagcacgatgagcacgatggccagacccgggaacacggcggtccaccagatgccggcggtcacatcggagacggcgcggttgaggtcgtatccccattcggcggccgcggtcggttcgatgccgaagcccaggaagcccaggcccgcaagggtcaggatagcttcggaggagttcagcgtcaggatgaccggcagggttcgtgtggagttcttgaacaggtgcttggtcatgatgcgccacgtggaggcgccgaccacgcgggcggattccacgtacgcggattccttgatgcggatcacttcggcacggatggtacggaagtattgcggaatatagaccacggtgatggagatgccggaggcgaagatgccgctccacaggccggactggccgtgggagatcatgatcgccatcagaatcgccagcagcagcgacgggaaggagtacacggcgtcggcgatcatgacgagcacacgatcgacccatccgccgaaatagccggagaccaggccgagcagcacgcctgcgaaaatcgacagcaataccgcgacgacgatggcgatgacggcggtgcgggcaccccagaccacacggctgaacacatcgtagccacctgcagtggtgccccagatgtgttcggaggacggtgccgcctgggccgggaaggaaacgccgtcggcgcccttgagctgcgcgtagctgtatggcgcgatgagcggcgcgaaaatggcgaccagcaggaagaacgccgtgagcacgaggcccgtgatcagcatgcctttctgccagccgactgcgacgcgcagttccttgatgatcggaatcttatgccagaatggcgtcttgttgccgagcttgagctcgtccagacgattgtcgcctggaacggtgaccttgttggcagatgctgcggtcatgtcagtacctcactctcgggtcgaccaacgcggcgatgacgtcgacgatgaagttgacgacggccacgatgatggcgattaggataacgatgccctgcacggccacgaagtcgcgtgccttcaggtactgcgacagcatgaagccgagacccttccattcgaaggtggtttcggtgagcaccgcgcctgcgagcatcagggcgatctgcatgcccatgacggtgatgattggaatcaacgccggcttccatgcgtgcttgttgagcaggcgtttctcggagacgccgcgggaacgtgccgcttcgacgtagccggaattgtaggtggcgatcacgttggtacgcaccaaacggatgaacacgccggcggtcagcaggcccaacgcaagggccggcagcacagcgtgacggagcacatcaagcaacacggacatgtcgcccaactggatcgcgtcgatgatatagaagccggtcggcgagaccagtcgggagaactgcatctcgctgccaagcgatgagcgcccggatgccggcagcacgttcagccagatggcgaagatgagcttcagaatcaggccgaggaagaacaccggggtggcatagcacaggatggcgaaggtgcggatgcccgcatcggccgcgtggtcacgcttgcgtgcggcgatgcgtcccaagccgatgccgacgatgagcgcgacgatgagcgcgaggaatgccagttcgaatgtggcggagccgtagtggacgaggatgctgctgaccttctggttgtcggtcagcgtggtgccgagatcgccgtgcagcaggccgccaagataatcgatgtactgcacgatgagcggacggtcgtagccggccgcatggatgcgcttctgcagttcttccggggtcaggcggccgccgagtgcggcggagatcgggtcgccggtggcgcgcatcacgaagaaaacgatggttacaagaatgaatactgtaggaatgatcagcagaaagcgtgtgagcacgaaacggaagaatccgcttgaaagcttgtttttcttggctttcggctgagcctcggttgcgctttgcgtcacgtcgggctcctttttccttattggtgtttcagatacaaattgagcccctgcccatcttaagggtgggcaggggcgatcaaaacctttatcaggccttggtcacggaagcgtagcggaagcggaaggaggcgtcgaggacgacacccttcacgctggatccggtgaccgcgacctgggcaccctgcagcagcgggatggtggagaggtcttcggtctcgagcttctggatttccttcagggtgtcttcgcgggccttggcgtcggtctggccggcctgcttgacgatcaggtcgttgacgtccttgttggaatagccgttgttcacgaagttgccgtcacggaagaacggggacaggtagttgtccggatcggagtagtccgggaaccagccgagctggtagaccgggtaggaaccgtccgaatccttggtgacgttacggtccttgttgtactgggtccattcggtggactgcaggtcgaccttgagcaggccgccttcctcgagctgggccttgatggccgcatactcgtcggcggaggactggccgtagtggtccgggttgtactggagcttcaggtctaccggggtcttcacaccggcggcttcgagggtcttcttggccttggccgcatccggcttgccggaaccgtcgccataggctgccttcagggtgtcgtcgtggccggacaggccatccggaatgaaggagtacagcggggtgtaggtgctcttgtagaccttggtggccagctcgttgcggtcgatcaggcttgcgacggcctgacgcacggccttggccttgtcggcgttcggctcgctggacttctcgccgtacggcatgatcttgaagttgaaggcaaggaagcgctcttcgccgcccggtcccttgacgaccttgaccttgttgtccttggacaggtcctcgacgtcggtcggggtcatggagcggtaggccacgtcgacctggccctgctgcacggccatcttcaggttggaggaatcggcgaagtacttgacctgcacaacgtcgttcttagctggggtcaaacccttgtaggaatcgttcttggcatatgccagggcctcgttcaccttgtaggaggtgagcttgtacgggcctgcgaaggcgttgtccttgacgacggtgttggcatcggtcagtttgtcggcggagaaggactcttcgtcgacgatcgggccggccgggctggagagcacctgcttcagggtcacgtcgtccttgaccgcggagtggaacacgacggtggtgtcatccttggcctcgacggactcgatgttggccagcagggaggacggaccgttctcgtcgttgatcttcttgatacggtcgaaggagaacttgacgtcggaggcggtcagatcgtggccgttcgcgaacttcaagcccttcttgagcttgacggtgaactcggtgccgtcggcgctccaggtgccgtcatcggcggcgatgtccggagacagctcggaagtgttgtagttctgcgcgtacaggaacgggaacacctgaatctgcacggcgtaggaaccgttgtcgtaggagccagccggatcaaggctggtgatcttatcggtcgtgccgacggtgatggtgttgccagttgcggcgccaccgtccttcacgccgccgcaggcggccagggaagccagagccgcgacagaagccagagcggcgataactttcttgcgattcactatggaatcctctcttttctatccgaatcgcccctgtgcaaggcgatatagtgacaagaatcggcgcgcaatgttaaccgtacgtttcattggaggccgttttacccacctaccttatattcgccgttttctgctatgcattaaaacggcgaaattccaacgttttaacgactagtgaaagaaaataagaaaaaccagccattttatgagacggacccagccaaagtcgcattcaaggtctacgtccttcttttttactcattgctttcgcacagagagacccagataagcgcgcgacacgcggcacaacatgaattgcattaatcaattaacggcgttaatatattaagaagttcaacgagggtccatgcactgtcgcaaggaggtgagcatgagtaggtacagcgcccaacagtcatcgatttcggaaaacaaccgttcccgcatcctgcaatacctgtaccacaatggcatctgctcacgcgcgcagatcgccaaagccatcaagctcactccggcggcaatcaccaaaatcaccgcgaaactgctggcgcagggcatcatcgacgaaaccggcgacatggacggagacaagaaccgccgttccatcggcctgaatctcaattgtgccaaataccacatcatcggcgtgaagttcgcccgcagtctggtgcaaatcgcggtcttcgacctcaagtgcaaccgtatcttcctgtccgacttgcctaccgtcagcgaagagcacatccccgaaacggtggagcgcattcgagataccgtacgccagctcatcaaggacgaccccagcatcgtggccgtcggcatggcggttccggggccctatttaaaggacgaaggacgcaccgctttggtctcctccatgcagggctggaggcaaatcaacttcatcgacgaattcagcaacgcattcagcgtccccgtgttcgtcgaacaggacgcccgcgccggcgcgctggcgcagttcctgttcaatccggaactgtcggaaggttccctcgcctactatctgcttggcgaaggcatcggcctcggagtcatcgacaacggcaccatctactacggcgagcacggcaccgccacggaaatcggacacgtctccatcgacgtgaacggcaagccatgcgactgcggcaatgtcggatgcctggaacgctactgctccgccaacgccatccacgaacaactcaacgccaacccgagcatcgttcccggatgcgagacgatgacgcatgcgcaggcttgcgcagcactgttcgccaaggcgaacgcgggagacgagaccgcgacgcttctgatgctcgatgttgcccgatacgttgggtacggcgcggtcaccatcatcaacgctttcaatccgacacacatcgttcttggagacatcatcgcgcaagccggccagccgttgctcgacgaagtcacacaagtcgtgcgcgaacgcacgatccccgaaatcgggcgcaacacccgaatcaccctgtccgccctgcccaccgacgccaccgttaccggtgccgccgccgtggccatcaccaattttctggaacatccatcgatgttcttcgacgtcgcatagcacgccgcccaccaaagaaaggaaccacccatgtccaagccaatcgtcatcgccctcggtgaaatcctgtgggatatgctccccaccggcaagcgcgccggcggcgctcccgtcaacttcgcctaccacgcgtcccagaacggcgcagaaagctacgccatcagcgccgtcggtaacgacgagctgggcgccgagctgctcaacgatgcgcacaaggccggcatcaacacgctggtgcagaccaacgaatacccgaccggcaccgtcgccgtggcactgaccaacggcattccggaatacaccatcgtgcagaacgtggcttgggaccacatcggctacaccgacgaactcgccgaggccgtgtccaaggccgacgccatctgcttcggcacgctgggtctgcgttcccaggaatcgcatgacaccatcatcaaactgctccagcatgccaaggaaggcgcgctgaagttcttcgacatcaacctgcgcgccaacttctactccaaggagctgatcgaggagctgctgggatacgccaacatcttcaagatcaacgacgacgagctcatcatgatgcgtgagatgttctccattccggagggcaacgacgaagaggcctgcaagtggttcatggatcgcttcgatctggagtacaccatcctgaccggcggcgcgaccttcagcaccatcatcgccaaggacggcgagacctccactctgctgaccccgcatgtcgaggtggccgacaccgtcggagccggcgattccttctccggctccttcaccggcaagatcctgtccggtgcctccctcaaggaagcgcatcgcgcggccgtgaacaccgccgcctacgtgtgcaccaaggaaggaggctggccggcctacccgaccgaaggcgttccggattacctcgccgcagcagccaagtaagcgtatcttctcctttcatcatcaccgattccgcatgccgtcaaataacggcatgcggaattttttttaccggttttgcgaagtttcgtcggtatgatgaatcgccgatagcataatttggtttgtcggataaaccgtggtatcttgaaatgtctggctataaagctggaaggtttgataattcaatatttggggatgatcggtttcgacggtgacctgttcgtcgcagggaagcgtgccgagaacgtagggtccgctcgtggatgccccctacaaaagaataagtgctaaatctaaccgcactgagttcgctctcgctgcctgagcttcgcgccaggattaaccagtgagcagccgctccgttcactccccctcgtctttgggggatgttgagcgtcgtttagaagacttgccttaccggctgagccacagggccggcaagggacttttactgtagatatgctcgccatcagttgtctgcgacatcgatgggggcagaaaaaccgccgcacggccagcagactacgcacgtagaagactgagggttcggtcatcggaccggggttcgattccccgcatctccacggattgaaagccgccagaaatggcggcttttcctttatttccaacggtttccgccacttttgcaattcgctgcaattcaccctttatcgcgatatttctcaaaaacatgggcaaaatgtgggcacgaatcatgtgtcagcaatgacggctttctgtattggtaatcacatttctcgttcggtgaaacagcgcatgtcggcagcaacgcctccgtatcatcgaaataaccgtccggcgccttccaatattacaagccgccggccagccaaccatcgaaagggacgatatcatggcgaagcttacagaggaaatgaaggatttcatcagcagcaatctcgcttgggtggccaccatcggcaaggatggacacgtcgatttggggccgaaaatgagcacgttcgtcatcgatgacactcatatcggctatcacgagcgtaccgccggtcaaatgtaccgtaatctgctcgacggcagcgaactggtcatcgcagtggccaatcttgagcagaagcgaggttatcgtttccgtggcaacgtcactctgcattccgatgatgcgatctacgatgagcaggtcgccgtggccgaacataacggcacgaagaagcccatgaccattcccgttctggagatcacggagattcaggacttgacgccaggggcgaccgcaggcaagaccatcgtcaaggactgacgcccgttcaacgcatacggctaataccatccatccaaacgcggaaacgcgctctggccctcccttggaaagaaggtccagagcgcgtttcgtttttctgtcaagacaaaaagagctagatcaaagtatttccgctccgtcatgcagtgacgttgcgcaataacgctatttgatgatcggtctcaacggcgcggacacgtccacgttatgcttgtctccaatcacgttcggatcattgacgatcttgtccaccaccgctttcttgagcttcaggtccgaggaatcaccccatacgatcacgcggtctcccccattgagttccgtggtgatggaatcctgggtcgccgcggtgaccttggtgatggagttgcgcatcgattccggcagtgagctgagaatcttcaacgcttccttgataggacgcctagacaggctcgcatcgacgttctgcacttcgatgacgggaatgccttccacggaaacgccgctgacggaattgagcacgcggcccttgctgtcgaccgccgtcatatggtcctcgctggttttgagcatggccgcgggtttctgcgccttgatcgtcacttcaagcgagttcggcagctgtttcttcgacttggctgacgtgactcccggaatcgccttgatctgcttctccacggctccatccgaaaccaggaacaacgattttccggactgctgcctcgcgatgtcaagcacctgcgattcactcacccattcgttggcgccgaccacgctgatgttgcctggctccaaacggaacaccgacgagaagaggaacagccagacgacagctcccaaaaccacggctacgacaagaccgatgagcacgcgcaggactatggctcgcgcgccggcctgacggcgttccttgagccgttcgccgaaatcaaccactttcggacgtgtcatgatgccgatcgtgccggtggtctcctgcagggttttggaaaccaggtcctcgctttgcaaacgtcgcgcgtctacgaagccttcggcttttgaacggtccgcgtacccttcaatcgaccgtccttcggcatgctccgatgagatggaccgtccggaacgtcgtccgcccgactggtccgtctcctgcacatccttgccggaactgatgacccgtcgagccatcagccctcgcaatcccaacgatgcgcttcaagagcatgcaggatgacctcgtccatctgcgtgatgtcgccggcgcctacggtgaagatgacgtcgccatgatgcgcgcgcatcaccatcatctgggccgcggtgtgcatgtcttcgacgccacggatccagtcctttgccggttcatgctcaagcttgagcgcctcgtccacgatggtggccggagtcacgtcggggaaatcctcctgcttctcgcgcgcggggaagatgccggtaacgatgacgtcatcggccttggcaagcgcctgcgcgaattcagagctgaagaaacgcgtgcgggagaacaggtgcggctggaagatcacacggatcttggactgcgggtagcggcgacgggccgcatccagcagcgcagcgatttcggtcggatgatgcgcgtaatcatcgacgaccgtcacttggctgacggtgccacggacctggaagcggcgtgcggcaccgaggaacgaggtgaccgccgcggaggcacgttcgacgtccatgcccaacagcgcggccgcgataatcgccgcggaggcgttgcgtgcgttgtggatgccgggaacggtaagcgtcactgcgatgcggcgctcctcttcgccgatcagtccgcccggaatatgcagcgtgaaatgttcggctccgctttcggcggtttcgctttccgattcgatgcgtaccagcgtggcaccgttcaggtcgcccaattcggcggcgttccgtgttgaatagacgatcgtgcgtccggccacggtggcgtcaagcgcacgtagcacggcaaggttgccttcgtcgtcgccgcacatgattacggctttggtggcgtgtccggcatggtccacgaatgcggcccgatagttgtcctgcgtgccgtagtggtcaaggtggtcggcttcggaattggtgatgatggcgatttgcggatggtatttggcgaagctgccgtccgattcgtcggcctcggccaccagcacgttgcccttgccggcatggccgccgtccaaaatggcaccgtctttgccttggatggaaccgccgatggcgtagctcggatcggcgagctcgccttctccggcgttcacgagaatgtgcgccagcatggagctggtcgtggtcttgccgtgggcgccggccacggtcaccgcacgtttcgcgttcatcagcagggcgaggatgtcgctgcggtgcacgatgcgctcccctgcctcatgcgcggcgacgatttccggattgtccggcttgatggcgctggagaacacgacggtgttcttgccttcgacgttcttcgcctgctggccgaattcgacggtgatgccgaggctttgcagacggtcggttttggcgcttggctcacggtccgaaccatcgacctcgacaccctgctcatgcagcatttcagcgagcacactcatgcccgcgccaccgatgccgatgaaatgcgtggcacctaggtcatgcaccgtctcttcaggtgcgaacgacgcatgggttgggtcaagaattatggtaccggcttcacgctggttgtcagacacgattgctcctcgtaaattgttttcaagctcatttcattatggccgcacccatggtctcccacggggtgcggtcatgattgttcggccggttaatcagctggctgatcgattagcgcgagcacgcgcttcgccatgacttcggcggcgtcgcggatgccgtatttccacgcgttggcaccgtatcgggacagcttgtccggatcggcgagcagttccggcacatggccacggacccaatccggggtgaaatcgccatccgccaccatcaagcccccttccgcgtcgaccacgggctgcgcgttgaaacgctgctcgccattgccgatcggcagaggcacgtaaatcgccggcagtcccaaagccgtcagctcgctgaccgtgccggctccggaacggcagatgatcagatcggcgcaggcgaacgccagatcgatgcgttccagatagggagccacacggtagtcgccatccgaaacgtggtcggggccaagctcgccgagcacgtcctctccggcgcttaccgacaccaaggaacgcacttcgtcgtctttgcccttaccggtcagatgaatcacctgggcgtgcgcaagcagatccttggcggaagcggccacagccctgttcacgttcaccgcgcccaaggatccgccggtgatgaccacgagcggacggtccggatcgacgccaagctgcgccgcggcggctttacgagtggcggtacggtcatgttccagatcggacgccaatcgtgcgattgccggacgaagcggcaggcccacgcgttcgacttcgacgcccctgcgtggtttcagtcctggctgggcgtatgcggcaccgatcatggacgcccaacgcgcgcccagcttgttggccatgcctgcgcgtgcgttctgttcgtgaatcgcaatcggaatgcccatgctgtgcgcggccgcgtatacgggtgcggacgtgtatccgccgaaaccgacgaccacttgggcctgatgccgggtgaggatgtcacgtactttggccttctcggccttccatttggctggaaactgcagcgcagccttgttgggcctgcgcgggaacggcactttttcgatggtttccagttcgaaaccggcctgcggaaccaaatcacgctccagaccgacggcggtgcccaccaccgcgatatccgcttccggttcaagctcgcgaatcacatgcgccacggcgagcagaggattgacgtggcctgccgtgccgccaccggcaagaacgatatgcttctgattgctcataatccacgagcttagcccaccatgcggcggcaggccacgcggcataccgccgccgatgcagatacttacatttcgtctacgtttcttttgcttgcttcgcaactcgcatgacgggaaccgattacagtatgcggttctcggctttgacctgcggctgctccttcatcaggctgatggccacgccggcggcccccagacacatgataagagacgatccgcctgctgatacgaacggcatcggcacgcccatgaccggcagcaggctgacgacgacgccgatgttgacaaacgcctggccgacgatccataccgcgatgcacaccaacgccatggtgatgtaccggtcgcggacctgcacggccaccatcagcatgcaccacgtcatgacgatgaacagcagaatcaccatggctgctccgacgaatccggtttcctcgccgatgatggcgaagatgaaatcgttgtgcgcttcgggaagatagccccatttctcgccggaattgccgatgccgacgcccaacaagccgccggatgcgatcgcgtatttgccgtggaccgcctgatagcacacgccctgcaggtcggacggagagcaggtccggtaggccgccatgatgcggccgagtcggttggggctggtcagaatgaatccgacgataccgcatatgccaagcagcgcggctccggcaagccatttgccggggaatccgccaagcagcaatgcaatgccgccaattgcgagaataatcaagcccgtaccaagatccttgccggacatgaccaggcagaacgcgcacagatagccgagaataagcttggagtacgcgcggggcgcgccgaccttcttcacctgcttgcgcgcgttgatcagctcgttcggcatccagatgcataacgccagcttgacgatttccgcgggctgcatggtgaacacgcccggaatgccgatccatcctttgttgccgttgacttcgacgcccaatggcgtcagtgtggcggcctgcatgaccatggcgccaagcaggaaccagaagctgatctttcggtagaagctggccggcagcatcatcgtgatgaatgctatgaccaggccgaacacgcagtacatgccctgtttcagcgcctgcgcccatggcgactgcccgttggcgatcatgttcaccgaagagctggagaacaccatgatcacgccgaagatcgtgaggatgatcacgcataggcggaatccgtggaagcaccataacgggttggcgagattacgcgttccgccgttcttcaacggttctcgtgtctgtgccgcggcgccgtccgtcatgttcgggcggcttgcggaagacgtgatgctacggctggcctcaggcttccccatgctcattcacccaacgctgagcctgctgcgcgaactggtttccgcgatcggcgtacgacttgaactggtccatggacgcgcaggccggagccatgagcaccacatcgccggattgcgcgtaagtgccggcagcatcgatggcgcgggccatgacggtgtcgttgtccgtgggatcgatgatggacatgggaatgtcgggagcgcttgccttgaacgcgtccagcattggctgctggtccttgccgatgatgatggccgccttgatggtgcgcgcctggtcggcgacgagctgttcgaaacggcttcctttggcaagtccgccggcgatccacaccacggacttgtccgcgaagctgttaagcgacgccttggccgcatgcgcgttggtggctttggagtcatccacgaaacggatggtgccaccgtcggacgttttggcgacggcgacggtctggatgcggtggccgcccggcgtgaactgcttgagcgcggccaacgccttgtctttgtctgctccgagacccaacaccagcgccaacgcggtcagggcgtcggcgagcagatgcgggtagaccgtgccatccggctcggtcagatgcgtgaaatcggtgaccttcgccacttggaacggctttcccgcttctccgccggcaatgccggacatgtcgacgatccagccatctttcacaccgatctgcccgtccttcggctcggccaacgtgaagccgatccggcggcattccggcgcggtctgggccgcgaacgccagtttggtgacgcgttcgtcgtcggcgttgtagaccagcgccttcttgacgttgtggaacaccttcgccttgtcggcggcatagttctcgatgccgccatgccaatcgagatggtcgtcggcgatgttggtgatcgccgcgcagtcgagttccagagaataggtgaaatgcagctggaacgagctcagttcgacgcagagcacgtcgttcgcggggtcgacggcggcatgcgacacggctttgccgatgttgccgacggcgggagcggccaggccgcatgcggtcagcatttcggaggtcatttccgtggtcgaggtcttgccgttggtgccggtgatgccgatccactgcgccggcttgccggtggtgttgctgttcacgcgcagctgccaggccagttcgacttcgctcatgaccggtatgttgcgtttctgcgcctcaaggatgaatggcgtgcgcgggttgaagaccggcgaggtcatcaccatgtcggtattgtcccaatcgatttggtcgaaggaatgcaggtcggcgtccggcttcttctcatccacgcccagcactctgccggcacgggagcccagcacttccatcatgctttgcccggagacaccgagaccagccacgattacggtcttgccatccatattcatatccatcaccctccaatcggaaacgtcatttgccgtgatagcacacttatattgcgggcgtaaagccgcgcccgcaatcgtgtcacaggccggaacgggccacccaatcgccgtagaacagcaccaaggcgatcagcacgaacagcatctcgatcatccagaaccggaccacgaccttcacttccggccagcccttcaattcgaaatgatgatggatcggggccatcttgaaaacgcgcttgtgggtcatcttgaagtagccgacctggatgatgtcgctcatggtctcgatgacgaacagaccgccaaggatgatcgccaggaattcggtgtgcgtggcgatggacatggctgcgaacagaccaccaagcgccaaggagccggtgtctcccatgaagatggaggccggattggagttgtaccacaggaagccgaagcaggctacggccgcgcacgccgcgatgatggtcaggtcaagaggatcggacaccgcataggtgaagcctggatggtccgaacccttgaggtggtagaactcccagaacgcgatgatcgcatagccgatgaaggcgatcatcgaggagccggcggccaagccgtcaagaccgtcggtcagattgatggcgttggtccatgcggtcatcaggaaattcacccagatcacgaacagcacgatggccacgacacgaccggcgaattcaaagctgaagaacggcttttcgatgaagctcatgccggcctgggcgctggggaagccggatttggtcggcagaatcagcgccagcaccgcgtatatggtggcgaggatgaactgtccgatgaacttgcccttgacggtcagtccctcgctctgcttcttgcggaccttcgcgaaatcgtcgatgaatcccaagaatcccatcgacagcatggcgaacagcaccaacaccgcggaccacgacggcacctctcccctggtgaggaaccgatacagtgccgaggagcaccagccgagcaccaccgcgaggttgatgaccacgccgccaagcgtcggcgtgccgcgcttgacgagatgcgacttcgggccatcctgacggatgtactgtccgtagttgagtttgtgcaccaacttaatcagcagcggagtgcccacaatcgtcacgacgagcgacaccataatgccgatgatgagtgaaatcacctgatcttctccgtttcagtcagctatgatcggcacgacgccgattccgtcagttttgcgtccaacgctccgccagagcgctcaatccggacgcgtgggatcctttcagcaacaccactgtaccctcatggtcggtcgcaagccgggtgaccattcggtcggcctgttcggcatcatgcgcccattgcaccatcgtcgggtcggcggcaaccgccttgccgccctgcgccatggcctcggcaagcgcgtccaacgcctcgtcggaagtactgccgaccgtcacaagcgcgtccgcaccgccctcgacggcgtatctgccgacgtcctcatgcaggcgatgctcatccggtccgagctccagcatggctccgagaaccgctattctgaacggctgctgctcggcgccggcatgccagcgcgacaggccatcgagtccggccttcatggaatcggggttggcgttgaacgaatcgtcgatcagtgtgaacgacgtttcgggcttggtgacggtggacaccgccatgcgatgcgggctgatgctcgtcacgtcggacaggccggaggccacagcgtcaatcggcatgcccaacgtcatcgccaccgtggctgcggcaagcgcgttcatgacgttgtgctgtccgcagatgccgagcgtgacgttggcgtgccggcctgtcttgtcttccagtacgaatgacggatggtcgagatcgtcgcagcgcacgtcgagcgcggtcgtgtccagttgcgcgtcttctttctgcggcaggccgaaccacagcacatcggccggagcgatggcgctcatcgcggccacatgttcgtcgttggcgttgaggatggtcaggccgcccggcaccagtccgcgtacgatttccgatttggcttgggcgatgcgttccgcagagccgaattctcccagatgcgccacgcccaccttgagcaccacggcgatgtccggcggaaccagggaggtgaggttggcgatttcgcccacgtgattggcgcccatttccgccaccaggaaacgcgtgccggcgttcaccttgagcgacgtcagcggcaggccgatctcattgttgaacgatccgaccggagcgacggtgtcgcccattttggacagcagcgatttgagcagatccttggtggtggttttgccgacagaaccggtgatgccgatgacggtgaacggcgattccagcgcgcgccgacgctcgatattatgcttggcgagcgctcccaacgccttgacggtgttttctacgacgatctgcggcacctgcgcgcccgcgatttcgtggtcgaccagtgcggccacagccccctgcgcgccgaccttcggcacgaaatcatgaccgtcgacgcgttcgccggcaatcgccacgaaaacggatcccggcacgatctggcgcgaatccgtgaaggcgctgatggccaccggttcgtcggtcggcacggtcgtcggcatcaaccgtccatcaaccgcctgcgcgatctccgtcaggctcatcggcatcatggtcgggctgctcactgtcgttactcctctaatggttgggtttgtgtttgacgtggagaatgtttcgttccacgtttagttcaggtcacgcgagacgcgtaacgcgcttttgatgttggctttcctcacgccggcggccagcaccatggcgatggacagggacagcgaacggctgtccgtctggccgtatgccgtcgcggcctgcgccgcaagcaggtcggattcctgggttcgtcccgcgatgcgggtctgtttgccgaccgcgcatccgaattttgcgacgagtttcgcaacctcggcatcgctcaaaccattgtcatcgcaggcaagcacatcgacgctgaccgattgcaacgcgtcctcacgcagggtctcttcatccaacgcgaggatcacagcggctgcgccgtcttcggcgcacaccgccatggtacgttgcacatcgatggccgacagaggatattccagattgaggaagcgttccaatgactgtgaatcggacgagctgatcacgccgacggggttgcccagcatgtgcaggaaatccgcgaggttcctcacttcggattccacgatctccctgttcttccccgtgatggcgaacacggccaatgcgtcggacggattgccggccatgtcgctcaccagtttgccgagctgtcccatggtgggttcggcgtagatgagcggaatctggatgtcgtcggtttgaccgcgcagcgcatggggcacgatcgcgccatatgctccctgctcctgagcctgcgacaactggtgcacgtccacatcggcggacgggacgaacagtgcgccgggacgcaccgattcgacatcatccgcgatggaagtgatcgtcacttcagccgccgacgtcggatcaagatcgaaaccgtatcggctggcaagcagccctaaagtcattcgtctgttcatggattcgctgaccgcgctcacctttccgcccctccgtgtctgaatacgtattcgctcaccaattcaccggaatagcatccgtgcgaggtgaagacgccggcacttcatacttctgcataaggaattcaccaatctccgcggtgacaggacccgccgtcaaaccgccgaagctgccttgggggtctttgagcaccacggtgatgacgaagcgtggattatccgcgggaatgatcgtcgagtaatcgctgatgatcgaggtcagttggccgttcgctccggcgacttctgctgtgcctgatttcgccgccatacgatagccgtcgaccttcacgaaagtgttgtagtgttcagcggacgattccatggcgttgagcatctggctcgccacggattcgtcgatgacgcgtgtcgcctcgcccttggactgctgctcttcgacatgccccgcggtgtcggtgatggacttgatgatgcgttgcggctttttgacgcccttgttggctatcaccgaaatcgcgttggtcagctgcatgacgttcaccgtgtacccttgaccgaacagcacggtgttgcgggttcgcctgtcccagctatccgaggggtgcagcacgccttcggattcgcctggcaggttcagtcctgtggcctgtccgataccgaatttgctgatgaagttgtaccgctgctcgttggtcatcttgtctccggcaatgaccatgccaacgttcgacgactgttcgaggatgccggcgagcgtccaatgttcgttgccatggtccaccgcgtccttataggtctgtccttccacggtcaccgtgttcggtaccgtgaatttgtcatcgatcttgtgcaatcccagttgcagcatgcccgacatggccagcaccttgccgatggagccaggttcgaaggtctcgctcaccgcccgggaggcgcccatcttcgcctggtcgcttccggcctcggtcgtatcgctgtccgccaaagcgaggatgtcgcccgactgcacgtcctggaccatggcgatgccccaagcggaatggtatttgttttcgctgtcgctcagcactttctcggtgtaccattgcacatcccggtcgatggtgagggtgacgtcggatccgttgaccgcgtctttagattcggtcatggttccggggatttcgacgccgctgttgccctgttggtacacctggtagccgtcacggcccgtcaatgtcttgttttccatctgctcgatgccggccacgcccttgccgtcggcgtcgacaccacccaatagcgagcccatcaaagtgccgttggagtacagacgttcgttgcttaattccgcgtagacgatgccgccgaggttcagcttggagattttacgcttgaccgcaggcgtcacgtccttcttcaataccacgtattgcccgctgatcgacagtttggcgcccagttccgtggcgtccatgcccaatacgggggccagcagacgagccacggctgcggctcccgtcacgccgaccggcttgccgttgatctggtggcagttgctgccggtctgtttggtgcaggtggtcggtatgaacgcctgcgcctgttcggggttgccgatgatggtgtagcgttcgacgctttgcgcgagaatcgcgccattggtatccatgatcttgccgcgtcgagccttcaacgtcacggtggtggtacggctttgcgccgcggcctgcgccatgcctttgccgttgaccagttgaatattggcaagttggataaggcaggtggtgcccatcagcgccagaacgacgccgatggccatggttttcgtcaacaggttcttgtggaagaacgtgtagatcctgcggatagggttcaccgggtcttgtctccacttgcgtttgcctgatagccgttcagatcgatggtcaatgcgcctttctgcgggaccatgcccatctcttcggccttgctcggcaatgaggcgtcaagttcgtcgagcttggcctgatcgtcctcgacgtcctgggtcagctgggtgatatgcgtttcgatttggctcgcctcgaaggaattctgcaccatttgggtgcgcagcatcagcgagcccagcaggcatacgccaaggaacaccgcggcgatgaccaggtgcagcagcggcgtgctgcgggtccgcgtccatgtgatgagttgttcgaagccgtgacggatgccgttgccttcgactctggtccctttgatgacgtgcagttcgggacgcgtggtgccgatggtctcggtctggcttttgcggccggccggagccgcattcgaagcgatcgttcttggtgccgccacttcagtcccttcttccttgtctggtcatgcttgcgtaatccgcgccttggtcgaaccgtttgcgccatcgtgcgggaatcggtctggtcaattccaccgcgcgcaatctgacggacgccgatcgtggattgttggcgatttcctccgcgtccgccttgatggcgccgcgggtcagttccttgaagaacggcatcatgtcgggcggcaccacgggcatatccgccggagcgtcgaccttaagcccttggttcatgaaggctttgacggttttgtcttccaacgagtggtacgactccaccaccagacgtcctcccacggcaaggtggttggcgatttgcggcagcgtgccggcaagcttgtccagttcgccgttgacttcgatgcgcagcgcctggaagacgcgtttcgcggggttgccggcgggacggtgggcctgcggcacgacctcgtccaccaaacgattgagctggcccgacgtggtcagcggctcggtttcacgccggcgtacgatttcccgtgcgatctgcttggagaaccgctcctcgccgtatgcgcggaagatacgcaccaaatcggcgaacgaatattcggcgagcacctgctccgcggtcaggggctgcgtcacgtccatacgcatgtcgagcggcgcgtcatgggaataggagaagccacgttccgtctcatcgatctgcaggctggacaatccgaggtccatgaacaccgcgttgaccttgtcgacgccttggtcggaaagcacttgggagaagtcgtcgaatgccgcgtgcacgggcgtgaaacggtcggcaaggccttccatttccatgcgtttcgtggcgagcgcgagcgcctcggtgtcccggtcgatgccgatcaggcgggcgttggggcttgctttgaggaacgctgtggaatgcccggcgaggccgagggtgcaatccaccgcgatcgagccgggcttcgccaatgccggtgccaccaagtccacgcaatcgcggagcagcaccggctgatgaatcgtcgtcacgtctgtcattagaactccatcgccggcaatacgtcatcggcaatgtcggaatatccttgttccttgtcggccaagtaatcctcccatgcctgtctgttccaaatctcggcccgggttcccacgccgatcaccacaatgtcgctgcccagattcgcgtaatcgcggagcatctgcggcacaagcacgcgtccctgcttgtctggttcctggtcgaccgcgccggaaaggaacacacgcaggtagtcgcgtgccgccttgtttcccatggacgtgcgttggatctgcaccgcgatccgtctgaattccgattgcggcagcaggtagacgcatcgttcctggcctcttgccatcaccatgccggagcccagttggctgcggaacttcgcaggcaatgccatacgtcctttggcgtcgattttcggagtgtaggtgcccagcagcaatggcggcaagcccgccatcatgccgccggattgagccgggtcatcgtcggagacgggttctgctccaatgtcatggaccattaccgcacctcctttttgcccacactcggcccaccaatccgagacactttccccactctaccccaccgctcaccatttttccccacgaaaaagcaaaaatgcctcaaaatattgtcgatttctccccatatttgagattgcgcgtccgcaccgtacagttccggcgttgtcagcccatcgcgattcgccgcggccaatcgccgctcgtagaagccttggggtacattagagtgccttaagtttttgatgaagggacagcaatgtcgagttattccgcccagttgcgtgaggagcaacaggccgtcagccgcgcatatgatcgtctggacgcgttgagggcgcaggctcggtcgcgtctcgacacggtccgggccgcaggatcgcacggttcgcccacgcaacgcaccgaacgcgattccttcgccaccatgtacgaggaccgtctcacccagcttcgtgcggtggaggatcgtctggttttcggcaggctcgacgacgtgcatggcgcgcatcgctacattgggcgtatcggcctgtccgatgaggatcatgagccgattctcaccgactggcgcgccgacgcggcacgcccgttctatgaggcgacgccttcgaatcatggcgacatcgtcatgcgccggcatatcacgttgagtttcagggaagtggtcggcgtcgaggatgaggtgctcgacgtgcattccgatcaggtcggcgaggcgtcctccaatggcacattgaccggcgagggtgctctgcttgcgtcgcttaacgccaaacgcaccggcaagatgaccgatatcgtggccaccatccagggcgagcaggaccgtatcatccgtgcggacctcaaccaggcggtggtggtgcagggcggtccgggaaccggcaagaccgcggtcgcgttgcatcgcgcggcctacctgttgtatacgcatcgtcgcgcgttgcagcgttccggagtgctggtggtcggccccagctcgacgttcctgcattacatcgaccaggtgctcccctcgctgggtgagacaggtgtggtcagccgtaccatcgcggatctgattcccggcatcatcgccaccgcgcatgacgacccgtatgcggccaagctcaagggtgaacgccgtatggccaaggcgatcgccaatgccgtggcggctcgtgaacgcgtgccttcgcatctgccggtcatccgcatcaacggtttcaacgtgccgatggtacgtgcggatatcgagcaggccatcgccgatgccaagcgcacgcggcagccgcataacaaggcgcgcgagaccttcgtgcgcgacatgctgtcggccatgcgcaaccggtacgtcgaacggcttgactacgagccggagcaggccgagcttaacgatgtgatgcagcagttgcgtatgaacgacgatttgcgcaagacgctgaacctcgcatggctgccgatgaccggcgaatggttggtcgaccagctgttcgcgaaaccgcagcaattgcgccgtttcgccccctggctcgaagagcgtgacatcgagacgctgacgcgtccgaagggctcgcccttcaccgtcagcgacgtacctctgctggatgaggccatggaattgcttggaccggatccgaaggccgtggccaggcagaaggcgttggatgccaagcgcgccgaggaagagcagttcgccaaggacacgctggcgcaggccggtatcggttccggcatcgtcacttcgcagatgctggtggacaatatcaatggtatggacgccgaattaaccgcgcagcgcgccgcggccgaccgcgagtggacgtatggccatatcgtggtggatgaggcgcaggagctgaccgcgatggattggcgcatgctgatccgtcgttgtccgtcgcgctcgttcacgattgtgggcgacgtggcgcagacctccgcgttgggcggtacccggtcctggcgtcgcatgatggacccgctgttcggcgaacgcaactggcagctcaacgagttgacgatcaactaccgcaatccgaaggaggtgtcgcagctcgccagcgatttcgcctcgtccgaaggcctgtacatctccacggtgaacgccgtgcgtggcgtcccggattcagtcaagcgtctcaccttgcgtgacgatagcctgatcggcgacgccgtcgcgcagcagaccgtcgagttggtgcgcgcctacgtttcctccgacggtaccggtcgtgtggcgatcatcgcgccggacgatatgctcaagccgttgcgcgcacgcgtatacgcacaacttcaggatgagctcgacccgaaggaattcgacaggctcgatgcccagagttcctgggacgagcaggtcaccgtatgttccacacagaccgtgaagggtctggagtatgatgccgtgatggtggtccagcccggacgaatcgaggagaacgcgccgtcgcgtatcgtagcggcctccgatttgtatgtcgccatgacgaggcccacgcagcgtctgcttatactgcggacaaaagacgacgaaaagctgctcaagctatatggtaggaaccatgcctaaagcattgttacttgaaaacatccatcccgacgcggcgcagtcgctgcgcgaccatggcttcgaggtcgagtgcctcaagggagccctgagcgaggacgagctgattgatgcgttggaaggtgtcgacctgctcggcatccgttccaagaccagtgtgacccgcaaggtcatcgacgcgcgtccgacgctcaccgcggtcggctgcttctgcattggcaccaaccaggtggatctcgaatacgcgggcaagaacggcatcgccgtcttcaacgcgccgtattcgaatacccgttccgtggtggagctggtgatcggcgacatcatctgcctgatgcgccgcattcccgcgcacacccatcatatgaagcacggcatgtgggataagtccgcctccggctcccatgaggtccgaggcaagacgctcggcatcatcggctacggcaacatcggctcccagctttccgtcgtcgccgaggcgcttggcatgcgcgtgctgttctacgacattgaagagaagctcgccatgggcaacgcccaccgttgcgacacgctcaacgaattgctggaacagtccgatgtggtcacgcttcatgtggatggacgcaagtcgaacacgggattcttcggcgaagaccagttcgagcatatgaagcaggatgccatcttcatcaacctgtcccgtggtttcgtggcggatttggatgcgttgaagaagcatctggattccggccatctgtccggcgcggcggtggacgtgttcccaatcgaaccgaagaagaccggcgacgagttcctgaccgaccttgcggacgaggacaacatgatcctcaccccgcatatcggcggctccacgcttgaggcgcagaagtccatcggacagttcgtctcccagcgtcttgaggattattggttcaagggttccaccatgttgtcggtgaatctgccgcagatcaccctgtccgacatcaagtcgaatttccgcatcgcccacctgcatgcgaatcttccgggtgtgctggcacgcgtcaaccgtgtgctgggcgaggacggcatcaacatcgccgcccaggccttgggcacggaaggcgagatcggctatgtggtcaccgatgtggcgcagcgcccggaccagagggctctcgaccagctcgcctccatcgagggtacgatccgcatgcgcgtgatcagctgagcacgcaatacgaaacgttacgataatgcgggcggggttccaaccatcaggattggaaccccgcccgcattatatatgctgtatttgcttacagatgcggcacccgtctcacgccatcattcggaacttgcgcccttcagctcgtcgatggccctttggaagtcctccagattctcgaaattctggtagacgctggcgaagcgcatgtacgccaccatgtccaagtcacgcagcggcttgagaatcgccttgccgacctcatcagatttgacttgggccaatcctcgtgaacgaagatcctcctcgaccttctgccccagcatcttcagatcgtcctcgttgatgggacggccctggcatgccttgcgcacgccggaaatcaccttattgcggtcgaattgctcgacgtttccggaacgcttcacaaccaatagcatggtcgtctccaatgtggtgaatcgcttggagcatttcgggcattcgcgcctgcgacggatggagtgaccatcgtcgctaatacgggtatcgaccaccttggtgtctggattctggcaaaacgggcaatgcatgttgtccagaatagactgagcccttgaaataagccacgcttggcggcccctacgcctcatggggaacaatgaggcgctgccccgcatgcaaagacaccgtatcaaggttgttcagccgcatcagttcatccaccgtatctccgacattgccaccctccggagtgatgctcgccgcatacctccacaaggtgtcgccgggttgcaccgtatacacgacgacagcggtggaatccggcgcggactgcgcacttccgggcgcgatgaatccaaaaagacaccaggcaaaaccggccgccatgatcgccatggcgattcgatttgccacatttccgatattcgccgcaccgttcaccacgccactccttttcgaacagctgttctatcgaacgcttgttccaagtatggcacatatgttcgataaacgcaaacacacctcgaacagatgtttgattttatcggcgtttcgcgttatgcttctaaggaactacgaaaggagcccatcgtgagcaccatccccttcacgcccaagaagagcgacgagcgtccggatgaaagcacgttgaccgaccgccagcgcaaggtgcttgacgccatcaaaacgcatttggccaagcagggattcgctccttcgttccgtgagattggtgaggccgcagggcttaaaagcccgtcatccgtcaaacaccagcttcaggttcttgacgaaaaaggcttcatccgcatgaacgcgaacaaggggagggccatcgaagtggtgaacctcaatgacgaggagccgaatggaaaagtcgcccaggtcatcccgttccccagtcaggacgatgcatgcggctccatcatggcctcgcatgacgttccactggtcgggcgcatcgccgccggcgtgccgatcacggccgagcagcatgtcgatgatgtgatgaggcttcccgaacggcttaccggcaccggcaatctgttcatgcttgaagtgcacggtgattccatgatcgacgccgccatttgcgatggtgatttcgtggtggtccgcgagcagaacagcgcggagaatggcgatatcgtcgccgcattgctggatgacgaggccacggtcaagacgttccgcaaggatcacggccatgtctggctgattccgcacaatccggcctactcccccatcgacggcacgcatgccgagatcatgggcaaggtcgtcaccgtgctgcgcaagatctgattgctttcacacgttaaacggcaaagggcgtcgaacataccattttgaggcatgtccgacgccctttgccataccctttgccataccgcgcggttgtgcattcaccttgcgaatccatcaagaatgaacgcgagggcatttcaaaatgtcgtcgcattcttgaagttcgggagcacggttcagaaatgcagttccttgcggctgtccgaatcgtatccttcaggttcaagctggaaggtggtgtgcggcacggatacggggaagtgctcacgcaggcagttctgcaattgggagaggacgtcggcggcatcatccatggtcagcccgcgctccactaccacatgggccatgacgacgggcatgccggtagagacggtgctggcgtgcaggtcgtgcacggccaccacgtgcggcacctgctcaagatgttcgcgcacctcgtccagatcgagttcctgtggggtttcctccagcagcacgcgcacggcgttgcgcagcagcacgaacgcccgggggatcatcatcaatgcgatgatgccgcccgcgacggcatcgaagccggcccagcccgttgagatcagcacgatggctgaaacgatcacggccacggaccccaatgcgtcgttcatgacttcgaggaacgcggctttcatgttcatgttgtcctcgctttgccccgcgaggatgaagatcgaaccgacgttggcggcaaggccgagtatgcccatgaacagcagcaaccgcacgtcatgcacttcgtcggcggctccgccgaacagcctcatgccggcttcgacgagcgcgtagatgccgacgatcaggagcacgagcgcgccgaccgcggcggtgagcacttcgagtcgcgcccatccccaggtgcgtttgttgctgggtttgcgttgcatgagcaccgcggtgacggtggaggcgatcagcaccgacatgtcggtgagcatgtggccggcgtcgaccagcagcgccagcgatccggtgacgatggcgctgaccacttcggcgatgaacaccgtggaagtcagccccaatgacatcatgagtcttttctggtgttcggccccgcttgcggcggtcgtggcgtccacacccgcatggttgtgtgccatgatgggtttcctttcgtcgtctttggttcgatccgcggctattgaaaccgcttctcaataccattttcattcgtctcaaaacgcaggaaaccccagcccgaaggctggggtttccaagttctgctgacagcctagcggctcaccgctcccctgtcaataaagtcaaaccgtcaattaaaaaccgaactgggcggcggtttccttcagcgtctccgcggaacgcttcagggccgcgagctcacggtcggacaccggggtgttgatggcggtattgacgccggaacggttaagcagggtcggcacggacatgcacacgtcggagatgccgtggaagtcgtgcagcatggagctgaccggcaggatgcggttggagtcgcgcatgacggcttcgatgatgtccacgccggacatgccgatggcgtagttggtagcgcccttgccgttgatgatcttgtaggcagcgttcttgacttcctggtggatctgctcacgcacttcggcgtccagcggatcgtggcccggcagcggggtccagtcgcacatcgggacgccgccgatggtggcggaggcccacagcgggacttcggaatcgccgtgttcgccggcgatgtaggcgtgcacgttcttgacgttgacgccggtctgctgcgcgatcaggaagcgcagacgggcggagtcgaggttggtgccggagccgaagacctggttggccggcaggccggagatcttctgggccacgtgggtggcgatgtcgaccgggttggtgatgagcatgtagatggcgttcggagcgaccttcacgaggcccggaatgatggccttgaggatgttgatggtggcaccgaccagctcgaggcgggactggcccggcttctggcgcgggcctgcggtgatgacgatcatgtcggcgtcacggcagatctccggatcgtcggagccgtcgatggtcacggtcggatagaagctggagccgtgctgcatgtcgagcacttcggcctcgacgcgttccttggcgatgtcttcgagcacgatctcacgtgcgacgccacgctgagcagcagcgaaagcgagagtagagccgactgcgccggcaccgatgatagcgagctttgtgggcttgattggtgaatccaccatgtgctttacctctcttttgagcaagaagaacgtcccgcgttgtggcagggtattttctttcgatttcaaccctactttatccatacagcatgacgtttcgccgtgaatccgcatgatttgcaaccactgaaaagtgattttcgtcacagcttttgtgagcgctcacatacactgcacccgttgaaatgcagctgttgcaatccgttgcagcgtttgcacggccgctccggcaaacgtcatcgggaacggcttgcacggaagctcagtcgatggcctgctccacgatctgcgcggccagctggtcgtcgacctccgcttcgagcatcatgccgtcgtcgcggtattcgacgttgaccaccctgccgtactcgcgcacacgggacatgagcgagccggcggcgtacggcagcaacgcctcgacatgcacgtttggcgtcggcagcatcgattccaccttctcgcgcagcgcctcgacaccttctcccgagaacgcggagacaatatacgcgtccggcatcaacgcctcgacccgctcacgcgcggcctcatccatacgatcggccttgttgaatgccacaatcgtgggaatcgtttccacaccatcaatgtcggaaagcacgtcattgaccgcgtcgatctgtgagaacggatcaggatgcgatccatcgaccacgtgcacgatcaaatccgcgtcggcgacctcctccaacgtggatttgaacgcctcaatcagctgcgtgggcaggcggcgcacgaaaccgacggtgtccacatacgcgtacagtcgcccgtccttggctttcgcacggcgtacggcggtgtccaaagtggcgaatagcgcgttctccaccagttccgcggaaccggtcagccggttggtcaacgacgatttgccggcgttcgtatagccgaccacggcgacggtcggcaggccgaagcgacggcgcgcgccacgtttgacgtcacgggcgggcgccatctgtgcgatctgccggcgtagtttggcgattctgctgcggatcacgcgacggtccatttcgattttcgtctcgcccggaccacgggagccgatgccggcgtcgcctgccgcacggccgcccgcctgacgcgacagcgacccgccccagccgcgcagtcgcggcagcatgtattcgagctgtgccagctcgacctgcgccttgccttcgcgcgacgtcgcatgctgtgcgaagatgtcgaggatgacggcggtgcggtcgaccaccttcactttggtggcgtcttccaatgcgcgtcgttggctcggcggcaggtcatcgtcgacgacgatggtgtccgcctcgtcctgcgccacgatgccagccagttcgcgcgccttgccggaacccacgtatgtggccgcgtccggcttgatgcggtgctgcagcaggccgtcgcacaccacggcgcccgcggtttcggcgagcgcggcgagttctcggagcgattcctcggccgcggcctgcgtggtctcgcggctggaccatacgcctacgagcacgacgcgttcgagcctgactttacggtattcgacttcggtgacgtcctggatctcgcccagacccgccacatgcttcaatgcgttgcgggattcgcgttcctgccactgttcgtcgtgggtttcgcgaaggtgttccccgccgttggtatcaagcagcacgtcggattggtcagcgagcacgcccgtgacgtcgcctgcggtcatgctctgctcgatatcgttgtcttggctcaatggcacctctcacggttgaactatggtgtctttattatcatcattgtctagagacatgggcatccatgctttcgccacgtggacgggcgcggcgaaaaacaccatggattgccgcagacgagcgtttgcaaggagatcggacatggcacaggccgaacagtatttcgcggcggagccgcagtcgaaggacgtgcgcaaaacactgcacgtcacgttgcgcggcaacgaggcggacgtggaggtgtcaaacggcgtgttctccggcaaccgcgtggatttgggcacgtcggtgctgctgcgtcaggcgccggaacctcccgaggagggcacgttcctcgacctgggctgcggttgggggccaatcgcgttggcgttgggcttcgcttcgccgaaggcggacatctgggcgttggacgtcaatgagcgcgcgctcgaactgacccggcgcaacgccgagctcaacggcatgggcaacatccacgcggccacggccgacggcattcccgcggagacgacgttcgacctgatctggtcgaatccgccgattcgcgtcggcaaggaagtcctgcacacgctgctcatgacatggcttccgcggctgaacgcgggaggcgcagcatatctggtggtgcagaagaatctgggttccgattcgctgatcccgtggctcgccacgcagctcggcgacggatatgaggtaagcaagtacgcgagttcgaaaggcttccgcgtcatcgaggttatgaaggcatgagattcgaatatccctcccaactgccggtttccacggcgcgcgacgacatcgccgaagcggtcagagcaagccaggtggtgatcatttccggacagacgggttccggtaagaccacgcagctaccgaagatcctgcttgagctgggccgcggctcgcatggcaggcagatcgtgcacacgcagccgcgcaggctcgccgcacgtaccgtcgccgagcgaatcgccagcgaaatgggcgtgaagctgggcgaggaagtcggctatcaggtgcggttcaccgacgaaagctcgccgaagacacggctgcgcgtcgtgaccgacggtatcctgctggcgcagatccaacgcgatcccaagctcatgcagtacgacacgatcgtcatcgacgaggcgcatgagcgcagcctgaacatcgatttcctgctcggctatctgaccgcgttgctgccgaaacgacgcgatctgaagctcgtcatcacgtccgccaccatcgattcggtgaagttccaggagcatttcgaacacgcgctgcatacgaaagtgccggtgatcgaagtgtcgggacgcacctaccccgtgcagatcgtgtacgagccgttgggtaccgcgccggcgctgatgcgctccgtgccgggcttcgaaaccggcgcgatgccgggagacgctgactacgagagcctgtccgcagcgccggatggtagggatggccgcgattcacgcgatacgaacgtggacatgcccaccgccgtggcacgcgcctgcgccgaactggtcatccattcaagccacgaccgcgggccacgcgacatcctcgtgttcgcctccggcgagcgcgacatccacgaattcgaaaacgcgctgcgccgccattacggaccgcgcgcggtggacatgcgccgccccgacgcgatcgagatcgtgcccctgttcgccaggctctcctcgaaggagcagcataaggtgttcgagccgcacgagcatcagcgcatcgtgatcgccacgaacgtggccgaaacgtcgttgacggtgccgggcatccgctatgtggtcgatccgggcacggcgcgcatctcccgttattcgaagacggcgaaggtgcagcgactgccgatcgaaccaatcagccaggcgagcgcgaaccaacgttcgggccgctgcggccgtatcgccgacggcatcgcgatccgcctgtactcacgtgaggatttcgagacgcgtcccgaattcacggagccggagatcctacgcacgtccttgggcgcggtcgccctgcacatgctgtcggtgggcgtggcgcgcaccgcgcgggatgtgacggatttcggtttcatcgacccgccggatatgaaggccgtatccgatggtttcaacgagctgaccgaactgaaggccatcgcccgcaagcatggcgaagtggtgttgacgcatacgggccgcatgctggcgcgcatcccgatcgacgtgcgtttgggccgcatgatcatcgaggccgcgaagtcaaccacgccgaacacactggccgccgtattggtggtcgtggcgttcctcagcctgcaggatccgcgcgaacgtcccgatgagaaccgtgaggaggcggaccgcatccacaaccggtatgcggacccgaccagtgacttcctgaccgcgttgaacctgtgggaccgcgtgttccaagctgatggcgaaccaagcaattccgcactgcgccgcatctgcaagaccgagtacttgagttggctgcgcatgcgccaatggaaggatctggtcgcccagctgcgcgaaatgtgccgggagttcaaattcaagctcggcgagccaatccccgtgtcccgcccaccgttggaaatccgccagctaccgctcaaccagcaggcagcgcattcgctgtgctgctcatgggacgcgcagggcatccacacgtccatgctttccggcctgctgtccatgatgggcatgcagatcgtgcgcgagccgaaggcttccgatttcgccgggctcaagggagcggcacgggcacgcgcgatgaaacgtgcgcagaagatggcgaagaacgactatcagggcgcgcgcggcacgcatttcgccctgttccccgcctccgccgtagccaagtcgaccccgcaatgggtgatgagcaccgaactggtggagacaagccggctgtgggcgcggtactccgccgaaatcgacccagcgtgggccgaaccgctcgccggagcgttgacgcgcaccacctacgccgatccgcactggtccggttcgcgtggctcggccgtggcgagcgcgaaggtgctcctgtacggcctgccgatcgtgcaggaccgcaccgtgcaatgggggcgcatcaacccgctcgaggcacgcgacttcctcatccgccaaggcctggtggaaggcgacatccagcaacggttctcctacgacgatttcgtcatgcggaaccgcgacatcctcgaagacgcggccgacgacgcgagccgcacccgccaggtggcgcagaccgtcggcgacgaggacctgttcgacttctacaacgccatcatccccaacaccgtcaccagcgtggccgacctggcgaaatggtggaagacaaggcacgacgagcagcccgacctgctggatttcgacccggacaaggtggaacgcctcgccgactccgattcggtgtccttggacgactatcccgaccattggcatacgctcggcaccgacggctcccccatcgacctaaggttgagctacatctacgatccgcacgacccgaacgacggcgtcaccgtgcacgtgccgttgaaggcgctgtcgcggctgaccccggaacagttcacatggaacgtgccgggactgctggacgggctcatcgtcggcatgatcaaatcattgccgaaaaccctgcgcgtacagttcgtacccgccccggacacggcacgcaggatccgcgcctggatcgacgaacgctaccccgacctacccggctccggaagccagcaaaaaccaaacctggcccccgaaaacgaggatggcgtcgccgcatggcccgacctgccacacgcgttcacccaagcggccatcagcatcgtcggcgcgcaaatccacccggaagtcctcactggcgaactgtggaacaagctcgcaccatacctgcgcatgaccttcgccgtggaacagcagctgccacccaaccgcaagaaccagcacggcagacggcacgcgcgaggccccgtcaaaacactcggcaccggcaaatcactcgtcgatctgcaacgcaaattcgccgagcaggccaaagcgtccgcacgccacatggtcgagaaacaagcccgaaacgccggagaccaaggcaaaatcgtcgaaaaagccaacctgctcaacaaagcgggagcaaccaccgaagcacgcgccaccatgctctggcaaggtgcactcgacacgctgcgcctgcccggtgaacgcatctcctcacgctggctcggcacggaagcgctcatgctcgcctccgccccctacaagtccacgaaggaactcaccgaagacctgcaattggccgccgtcaaacgactcctgccgaacgtggaccagctgcccgacgacgaagcgctcgccaacgcagtgctcgacgtgcgcgaagtgtacgaggacaccgtgtatgcggtggcgcatgacgtgatcgccatactgaaacggtatgcggaagtcgacaaagccgtgtccggcaaagccgacctgcccctgctgagcgtgctgcagtcgatccgcgagcacatcgccacgctcgtcttccccggtttcatcggcaagacgccaccggacgcattgccgtccatcgaacgatacctgcacgccgacctgctgcgcctcgccaaggcgaaaaacgacaagaaccgcgatgtgcgctgggcatgggaagccgacgaagccaaacaactcgccgacaacaccatggcgaaagcacaacgcgaaccagccggcccacgccatgaaacactcatgaaacaggccgagaccttgcgctggatgctcgaggaattctacgtatccctttgggcgcaggaactcggcacgccgaaaccgatcagcctgcaacgcatcaaaaaggccatcgcctagccaccgaccaaacaacccaacggattgttccgtttcctcaaaccagtcaacgcttcttgaagaaacggaacaactgcgattcccgaatcaacaaccctgcaaacaggctcgccaccatcacaccggcgaacacagccaacggcgtacgcaccgcagccgccaacaccgccacccaatgcgccacgatgagcgatgccatgagcaccgcgtgcgcgcagtagatcggacggatgtgcgtcagcggctccactcccctgccccggtccgcgagcttgccgccatacaggttgctccacaggcaggccgcgccgaagatcaccagtccgacactcagatattgctccggcgcatgcacttcatcgcgcatgatcggagtcaggtacgtgtagaacacgtagcttgcggccgcgccgcacaccacgtcgagcacgcccagctggatgcagcggtcgaagaacaggcgaaactgggacaggaagccgatttttgccgcatggctgttgcgcggcagcacggcgaccatgccgatgatgagcacgacggtaagcgcgttgaccagatggaacgcccaacgccagccgaacgcgttggccacccaagtgccgaccggcacacccaccacggaggcgatggagaagccggagaacacccatgcgatgaatttcgtgcggaaggtgtcggtggccacatcgggcgcgtaggtcatggcgatggccaccagtgtgccggacaccagcgcgatcaggatgcgtccggccatcagcaccgcgtagttgggagcgaaggcgcacagcaggttgcccgccaggaacacgccaatcagcgtcatatgcgtggcgaaccgcgggaagcgcgcggacagggccgaaccgagcggcgtgaccggcgcgtacacgaacgcgaacagcgacaccagattgccgaccgtcacctccgacaccttcaatccgacggcgatgtccggcaggatgccgaccatgatgaattcgctcatgccgagcatgaagctcgaggcgatcaggataagcaccggaagattgaagaaccgttcctttgccatgccgcatttcccttccacaccgggacatcaatcgattgacgtaaccaatccgaggcgacactatgccatgcgcgatacaatatgacgcacgatgacacgcaagacgaacagcacgcgcaaagcacggaaaacccgcaatcgcaagcccctcaatctcaagaatctccgcaccatgtggcggaaggcgaatcccgtcgcacgcatcggcatggtcgccaccgcgaccgtggcagcgatcgcggcgatcgccatcatcgtgggggcggtgcgcttcatcggctggcgcgtgcaggtgaacgaggcgctcaccgcgcaaagccagtcgcagtcgcaatacgacttcaatcccggcaacatcatttccgacggcacgttcttcaacggcaatgcgttgagcgagcagcaggtcagcaccatcatcgaacagcagggcgtggcctgcagtggcgaacgatgcctgaagtccatgacgttcagcaccgaatcgcagtccgcggacgaatattgccaggcttatgatggtggcccgaacgaaagcgcggcggcgattgtctacaaggcgggcaaggcatgcggcatcagccagaaggtgctgctcaccgtgttgcaaaaggagcagcatctgctcacggccaccaatccaaacgatttccaattcaaagcggcgatgggcctgagctgcccggatgatgcgaactgcgaccccacctatgccggcttcttcaaacaggtgtacggcgcggccaaacggtaccagtactatcttcggcacgagggacgctacggctaccatgccggacggctcaattacatccagtacaatccaaatgccggctgcggcggcagcaacgtgtacatcgagaaccgggcgaccgcgctgctgtacatatacaccccgtatcagccgaatgccgcggcgctcgaagcgggggccggtgaaggcgattcctgctcgtcatacggcaaccgcaatttcgcgattatctaccattcgatgttcggcagcccgcgaggctgatgcatcccaatgaggatatgccgttcgagcatatcctcgaccagtccgacaccgattccccgtggcctttccgccatagacgtgtgcgaaacgcacgagcaaggccgccgcccggtttatgttccggacggcggcctcgtgtatgacgttttgtctatcgatggtccgcgatcacagcttcggcagatacttcttcagctcgaacggggtgacctgcttgcggtactcatcccattcctgatgcttgttgcgcaggaagtattcgaacgcatgctcgccgagcacatccgccacgaagtcggacttctccatgatcttcagagcctcgtcaagcgattccggcagcggctggatgcccatggcctggcgttcggcgtcggtgagctcccacacgtcgtcactggtcggctcccccagctgcatctgcttgtcgatgccatcgagtccggcggccagcagcacggagtatgcgaggtacggattggcgaccgggtccaacgcgcggaattccatacgggcggagttgcccttacctggcttgtactgcgggatgcgcagcaacgcggaacggttgttatggccccagcagatgtagctcggcgcttcggcaccgccccacagcctcttgtaggagttgacgtactggtcggtgaccgcgcagatctcggccgcgtggtacaggatgccggcggcaaactgacgtgcggtgacggacatattgaattcctggccggcctcgtagaacgcgttggcatcgccttcgaacaggctcagatgcgtgtgcatgccggatcccggagcgtcgacaagcggcttcggcatgaagctggcatggatgccacgctccagagagatctccttgacgacggtgcggaaggtcatgatgttgtcggccgtggtgagtgcgtccgcatatcgcagatcgatctcgttctggcctggccccgcctcatgatgcgagtattccaccgaaatgcccatctgttcgagcatattgacggtggcgcggcggaagtccatgccagggctacgcggcacgtgatcgaagtaaccgccctcgtcgattggtttcggtgtacgggaccaatcatcctgcttctcgaacaggtagaactcgatttccggatgcacgtagaacgtgaatcccttttccttggctttggccagcgcctgcttgagcacatggcgtggatcgcccaacgatggctcgccatcgggggtgagcacgtcgcagaacatacgtgcggtgccctgcgggcctccgcgccacggaagaatctggaacgtcgacggatcgggcttgacgatcatatcgtcttcggacacgcgggtgaggccttccacggcggaaccgtcgaatccgagcccttcctcgaatgcggcttccagttccgccggcgcgatggccacggacttcagtgttcccaacacatccgtgaaccatagacgaatgaagcgcacgtcgcgttcctcgaccgtgcgcaaagcaaactcttgctgtttatccatagtgtccaatcgttccatgcgcatgttacgaacgtcgttaacacatgccgtgtcgcgacatgtcagcgtgcgacttcgagggcttcctccagcgtgaaggcgcgcgcgtacagcgatttgccgagaatcgcggcgtccacgcccagttcggcgagctccttgatgttgcgcaggtcgtcgagcttggagatgccaccggatgcggtgaccttcgcgtcggtgcgggacgccacttcgcgcagcagctcgatgttcgggccgctcatcatgccgtcgcgtgccacgtcggtgaccacgtaacgggagcagccgacggagtcgaggaacttcatggtctcgaacaggtcgccaccttccttcacccagccgcgggccgcgagggtgtggccgcgcacgtcaaggccgacggccacacggtcgccgtacttcttgatgacggaagcggtccagtcggggttctccagagccgcggtgccgatgttcacgcgggccgcgccggcttcgagcgccgcgtcgagcgaggcgtcgtcgcgcacgccgccggacatttcgatgttgaccttgtcgcccagttccttgacgatggcgcgcagctggtcacggttgttgccggtgccgaatgcggcgtcgagatcgacgaggtggatccattccgcacccgattccacccacgtgcgggcggcttccagcggggagccgtagtcggtttcggagccggattcgccttggcgcaggcgcacggccttgccatcacggacgtcgacggcgggaagcagcgtcaaagacatgtcatacctttcgttgcgttgaacggttttcggccgttcaacggatcttgcgattaccgatttgaatttacgattttgcgattgttgcgattgccttgcacgaatccgcgttcagaacgtcgcaacccagttacgcagcagctgcgcgccggcttcggcggatttctccggatggaactgcgtggcgaacaacggtccacgttcgtaggcggccacgaatcggctgcgcccgtaggtgcaccacgtcacatgctcttccgcatcgccgaagtccagctggtcggcggaggtgtcggcaggcgaagcgctcatcgcggcaaaggagtgcacgaaatagaatcgttcgttctccacgcccttgagcaacacggaaccttccggcgcttcgacggtgtcccaacccatgtgcggcaccacgtcggcgtcgagcagctcgacatcgcccttgatcagaccgagaccgggcgtgccgtcgccatgttccatgccacgttcgaacatgatctgctcgcccacgcagacgccgagcaccgggcggccggcgcgcagacggtctttgatgaccctgtctccgccgacgcttttcagtccttccatgcatgcgccgaacgcgcccacacccggcaccaccagtccgtcggcttccagagcctgacgatggtcggacgtgagggtcacgtcgaggtcgagattggccagcgcgcgcaccatggaacgcacgttgccgaaaccgtaatcgaacaccaccacggaagtcatgggcgctctccttcttttgcttgccgaagaatccatccttcggggaaaaacttattcgatgcttgacgaaccacgaccgaatcgcgtgtgctcggcgaggatcttcatggcgtcatcacgggtcaggcttgcggaatcgacggtttccacgccggaatcacgcaccccctgaacgtcggtgatgcccagcagcaggtcttcgacgaacggcgcggtggaggtgagcagcaccggtggcgcgaacgtctggccgaccttgccttgcaggtacatcgtcgcctcgagcttgtccgcacggttgatcgcgaggacggcaggcatgccggagaccacggtggtcagatctttgatggccgcttccgggccatcgccgtcgagattgcgtaatacagcgaccgcgccttgcggtgaggcgaggcattgcgcggagatgtcggacagttggcagaacgcggcgaacaggcgtgcggaggcaagtcgggtgatgatcaccgcgactttcgcacggttgcccagcagcccctgcaactcgtcgtcgaatgacagcgagttctcggcttcggacagtaccgcgtcggcttccttcgattgcaggccgtcctgcgattcgtcggaagacgcatcggaattaaccgtctcatccggctgatcgaatggcacctgcgcgggagcatcgttctgttgggcagcttcctcgtcctggaattccttttcgaagccggccatggccgcttccagctcctcttcgctgaaatgcatgccgtcgtcgttggtcttccccaagccgtcgaaaccgttcaaatcgtccttgtcgtcggacatcacagcgcgcccttcgtgctgggaatgccgtcgacgcgcggatcgggttcgatggcgaaacgcaatgcgcgggccaaagccttgaattcgacttcggcgatgtggtgcgggtcgcggccggaaatcacgtgcaggtgcaggcagatgccggcatgcatggcgatggattccatgacatggcgaacgagcgaaccggtaaaatgcccgccaatcatgcagtattcgaagccttccggctctccggtgcacacgcagtacgggcggccggaaatgtcgacgacggctttggcgagtgcctcgtcgagcggcacggtggcgtcggcgaaacggcggatgccacgcttgtctccgagggcctgcttcagagcctcgccgaatacgatggcgatgtcttcgacggtgtggtgcgcgtcgatgtcggtgtccccggtggctttgattttcaggtcgatcagcgaatgcttgccgagcgccgtcatcatgtgattgtagaacggcacggatgtgtcgatgtcggttttgccggttccgtcgaggttgagactcagctccaccttggattcgctggtttcacgaacgatggttgcagtacgtgccatgttgcgactccttttgcgatgttgcagttgcgatattacagctacgatattgcgattgcggtggttgcgtcttccgcagccaccgcgattctgttctgtttcaagcttattgccgaatactgtcacgaacttccgttccggacagtatcccagcttgcgttccggcttgttcagccctgttccacgatgcgcagcacttcgaccaacgcctcacggaaccgtgccatttcctcgtcggtgcccatgcacactcgcatccagccttccggaccgacgacgcggatgagcacgccgcgcttcaacagttcgtcgaagatgcggtcgcggtcgtcgaaatggccgccgaagagaatgaagttcgactgggtttcggccacttcgagcggctggcccttgtaggtctgctccttgagccatgcggaggtggcgttgcgggtttcgcgcaggtgcgccacgcggctcagctgttcgtcggtgtgttcgaacgcggcgagggcggcggcctgggtgacggcggacaggtggtacggcatgcgcacgatgcgcacgcagtcgatgatgcccttgttggcggccaggtagccgacgcgtgcgccggcgaaggcgaacgccttgctcatggtgcggctgacggcgaggttttcgtattcgccgatgagttccagcgcggtgggcgtgcccggatctcggaattcgatgtacgcctcgtccaccacgaccaccggatgcacgccttcggcggcgcctgccacttcggcggtacgggcggcttcgagcacgcgcttcagatcttccggcttgagcggggtgccggtcggattgttcgggctggtgagcacgatcatggccggcttgacgtcttcgatcgccttgatggtggcgtccacgtcaagcgtgaagtcggcgttgcggtgcgcaagcttccacgtggtgaacgtgtcgcgcgcgtattccggatacatggagtacgtcggatcgcagccgagcgcgatgcggccggggccaccgaacgcctggaacagctgcagcatgatctcgttggagccgttggcgccccacaactggtcgacgctgagcttcacgcccgattcgcgttccagatatgtggagaaagccttgcgcagttcgatatgctcgcggtccggatagcggttgagcgtcggggcgatctccttgacacgctgggcgatggtttccaccacggccggttcgggcgcgtacggattctcgttgacgttgaggcacaccggcacgtcgagctgcggcgcgccgtacggttcttcgccgatcaggtcgttgcgcagcggcagatatgccggaatcgcgttgctggaagtctcgctcatcggaggccggcctgctcttcctgttccttgatggtcgccttgttgtacgggtcgtcgatgaagcggctcagcacgcattcgccgtgtgccggcagatcttcggagacggcgaaggcgttcacacgggcggcgagggtcttcagtccctgctcgtcgtattcgatgacttcgaccggcttcatgaaggtgtgcacgccgaggccggcggcgaagcgcgcggtgccggaggtcggcagcacgtggttggaaccggacatgtagtcgcccagcggaaccggggagtacgggccacggaagatggcgccggcgttgcggatcttggcgatcacggcatccggatcagcggtctgcacttcaaggtgttcggccgcgtacgcgttggccgcgtcgatggactgttcgatgccgtctgtgaggatgatgccggactggcggccgcgcagcgacgtgttgacgcgctcggcgtgttcggtgcgaggcacgcggtacttgaggctttcctgcaccttgtcggcgatgtcttcgctgtcggtgataagcacggagccggcgagctcgtcatgttcggcctggccgatcagatcggcggcgagccagcttgggttggcgcccttgtcggcgatgatggcgatttcggtcggaccggcgacggcgtcgatgccgacgatgccggagaccatgcgcttggcggtggcgacgaagatgttgcccgggccggtgatcttgtccaccggatcgcacaggatctcgccgtcctgcggttcggagcccttggcgccgtaagcgaacatggcgatggcctgagcgccgccgaccgcgtacacctcgtccacgccgaggatggcgcaggtggcgaggatggtcttgtccggcagaccgtcggagctgctgcggctcggcggggtggcgatggccagcgattcgacgcctgcggcctgcgccggcaccacgttcatgatgacggagctcgggtagacggccttgcctcccggcacgtacaggccgacgcgctgcaccggaatccaacgttcggcgacgcgcgcgccttcggccaggtcggtgtggaacggggccggcacctgggatgcggatacggcgcggcagcggcgcacggattcctcgatggcggcgcgcacttccggatcgagctcgtcgacggcggccttcatggcctcgaccggcacacgcagatgctcgggacggatatggtcgaacttctccgcgaagtcgcgcagggccgcagcgccgcgggccttcacatcatcgagaatcggctgtacgagctcagtggcctcgttggtgcccatctcggcgcggggcatggcttccagcatttcagctcgggtcagcttcttgccgcgcaggtcaatgattcgcatatagttttcttcgctcataacgccccatggtaacaacgccaagtcacgagaacgtcccgtcgtctcacattcagccgcattgtgagacacgcagatccgccgttttccatgccatgccgatttccgcgaaaaatatatgccggtcgacgccattcagcatcggccggcaatcaaaaacctgttcaggtcaaaccgttcaagtcaaaccgctcaggccaacggaagcgagctcggtccgaagagaatcttgatttcggcgaacagcgacgtgtcgcgtttgacgcggaaccggtctccgaacgtcagcaccttggcgttgcctttgtcgtccatcaacgccagtttcacctcgcatgggccgggatggctggtcagaatctgcccgagccgccgcacatgcgactggtcgagcgcgatcggcggcagcacaatcgtcagcggacgttcatcctgcgcctccaacgtcggcacggtgaattcggtggcgcgcatgctcactgtctcatcgcgcttctccacctggccgcggatctgtaccacggtgtcgacggcgagctcgggcgcggcggcctcgtacaccttgccgaagaacatgcattggatggaactttccaaatcctcgacggttacgatggcccacggattgccctttttcgacacgcggcggtccacattcgtgatcaggcccgcgatcgtcacctgctggccgtccggcatgcttcccgcgcggtcgatcaggtgcgctatcgacatttcgcgcaacgacaccagaatcgactgcatgccgctcaacggatggtcggacacgtacaggccaagcatctcacgttcgaagttgagcttggttttcttgtcccactcctccacgtcgggcacctgcaccatggcgtctcccatggcggaatcgttctctttggaatcgtccaggtcggcgaacaggtcgaactggccttccgcctgcttgcgtttcaggccgacgaccgaattgatggccgtttcgtggatggtgaacagcgcacgacggttcgggtcgatcgagtcgaacgcgccggccttgatcagcgattccaccaatcgcctgttcagcgcctccaacggcacgcgtttgatgaaatcggtgaagttcacgtacttgccgtggccgttctcacgttccgcgatgatcgcatcgaccgcgttcttgccgacgttgcggatggcgccgaggccgaatcgcacgacgtcgccgactgccgaatactcgtacaccgactcgttcacgtccggagaaagcacctggatgcccatgcgtcgcgcctcgcccaggtacagcgcggtcttgtctttgttcgtgctggcgccttgcagcagggcggccatgaactccaccggataatgcgttttcagatacgcggtccagtaggagatcaaaccgtatgcggccgaatgcgccttgttgaacgcgtagccggagaacggcacgaggatgtcccacacggcctgcgcggcctcttcggaatatccatgctccttcatgccggcgaagaacggaatcttctccttggccagcacttccggcttcttcttgcccatcgctcgacgcagcacgtctgccttgcccagcgaatagccggcgaggattcgcgccgcggactgcacctgctcctggtagacgatcagaccgtaggtctcgtcgagcacttccttaagcggttcggccacttcggggtggattggcgtgatcttctgcagaccgttcttgcgcttcgcatagttggtgtgcgaatccatatccatcggacctggacggtacagcgcgatcagtgcggaaatatcgttgaagttgttcggcttcaacgttttcagcagcgagcgcatgccgtcggaatcgagctggaacacgccgagcgtgtcgccacgggacagcaggtcgtaggtggggcggtcgtccagcggaatcttcgtatggtcgatgcgttccttgccgttcgcctcgatgttgttcagggtgtctcgaatcaccgtcaagttggaaagtccgaggaagtccatcttgaccagaccgagcgtttcgcacgtatggtattcgagcgtggtggtgacggtgccgtcggtacgttccagcagcggcgacgtgttggtgatcggctcgctgcccatgatggtggcgcaggcgtgcacaccggtctgacgaatcagaccttcgatgcccatcgcctcgtccgtgatgcgtttcgtgtccgggtcggaatcgtacagttcgcggaattcgcgtgcttccgcgtatcgtttcgcgcttgggtcgaagatgtcgtgcagcggaatgtccttgccgccggtctgtgcgggaggcagggctttggtgatcttgtctccgacggagaagtcgtatcccatgatgcgggcggagtccttcagcgcctgcttggttttgatggtgccgtagatcacgcactgcgccactttgtcacgtccgtatttctcacccacgtagtcgagcacgcgtccacgaccgtccgggtcgaagtcgacgtcgatatcaggcagtgagacacgttccggattgaggaatcgttcgaagatcagaccatgttcaagcggatcaagttcggtgatgcccatcgcatacgcgaccatggcgcctgcggcggagccacggcccggccccaccatcacgccgtgggccttcgcccagttgatgtagtcggccacgacgaggaagtagccgcagaactgcatctggcagatcacgccgcattcgtagtcggcctgccgcagcacttcgagcgacggcttgccgttgtaccggcgttccaggccttcctcgaccttcttcaggaacagcgacgtctcgtcccagccttccggacagtcgaattgcggcatgaacgcgccgtcttcatgatcgtcaaacatgacgttgcagcgttcggcgatctccaacgtgttgtcgcacgcttcgggaaggtctttgaacagttcgcgcatttcctcggcggatttgatgtagtagccggtgccgtcgaatttgaatcggcccggctcgtccagcgtggagccggagttgatgcacagcatggcgtcctgcgcgccggcgtcttcggcacgcgtgtaatgggaatcgttggtggccagcagcggcgcgttgagcttttttgcgatgtcgagcagcccgtcggtcacttgcttttcgattttcaggccgtggtccatgaattcgatgtagaaattatcgcggccgaaaatgtcttggaattcgccggcggcacgcaacgcgtcatcgaactggcccaggcgcagacgagtctggatgatgcccgacgggcagccggacgaggcgatgatgcctttcgaatatttggcgaggatttccttatccatacgcggatagcgcatgactcggccttcaaggttcgcgtcggtggaggctttcatgaggttgacgaggccttcgtcgttttctgcccacatggtcaggtgggtgatgacaccgccgccggacacatcatccgggttacggcggcgatgcagcggatccagatccggattccagttggtgtcccagctcacacgggtggggtcctgacgtgcggtttccggcgtcacataggcttcgatgccgatgatcggcttgatgccggcgttgaccgcggcgctccacatctcatacgcgccatgcatgttgccgtggtcggtgatgccgacggccggcatgcccagttccttggcgcgcttgaccagatccggtattttcgatgcgccgtcgagcagcgaataatgcgtgtgattatgcagttgcacgaaatttgcggaagtagccatgcgttccaatttagctgggcttcatgacggcgtggagtcgtttctggccgtccggccacacttttatagggactggtcggcgtgccgtgcgcgcatcacgtcaagcgcatgctgcaggtcggcgggatagtgcgatttcaccgtggtccacacgtgcgtacgcggatggcggaattccaattgcatggcgtgcagccattgccgttcaaggccaagcgcctcgctcagctgcggattcgcgccgtacatggcgtcccccgccaacggatgcccgatggatgagaaatgcacgcggatctgatgggtgcggccggtttccaggttcacggatacgagcgtggcttcgccgaaacgttccatcacgtcccaatgcgtgatggcctctttgccggccggtgtcacgcagaagcggaagtcggagactttggcgcgtccgatcggcgcttcgatggtggctttgtcttctttgagattgccctgcacgagtgcgtgatatgttttgacgacctcatgttcggcgaactgccggcgcatctccacgtacgcaagatcggacttgcatacgagcatcagtcccgatgtgcccacgtcgagtcgtgacacgatgccttgacggcctgccgcgccatatgacgtgatgtgcactcccctgtcgatcaggctgccaagcaccgtcggaccggtccatccgacggatgcgtgcgcggcgacgccgaccggcttgtccaccacgaccacatcgtcgtcctcatagacgacggccatgtcatgggcgatcggttccggttcggaccgttcctcgacgatgtcgaattctacggtttcgcctgcctgcagggtcgacgatttggaaatgtccctgccgagcacgcgcgcctgtccgctttcgatgaggtcggccgccttggcccgggaaatgccaagcattttggcgaccgcgacgtcgaatcgtttgccgacgagcgcgtcgggagcgggtacgagacggctcatgctgctttcgccccgtcgtcggttgcgttcgcatcatcaccaagcgtcttgccgttggcctcgtcaaggtccttttggctgaacggttccccgaggaacagcagcaacaccgccgcaacgcccgcgagcatgaggaagatgtccgccacgttgccgatggaccatccgtagttcaggaaatccacgaccttgccgttgaggaacccttccgcatagatgacgcggtcgatgaggttgccgaacgctcctgcgaaggcgaaggcgaacagcaccgtccatttcatggaaatggtgcggacggcaagtacgaccaacgccacgcaggccgccatcgccagcagggaaatcagccacgtcatgccggagcccatgccgagcgaggcgcctggattacgcaccaatgtcaacgaaagcaggccgggaatcacgcgtatggtacggccatcggccaatgcggacaaagcccacatcttggtgagctggtcaattgcgatcgccgcgatcgcaatacacgcaaagacggccacgcggtcgcgcagccgtctttgatcattcttcatgatgtcagacacaggctaatctcagtcgttgttgtcctgagggtcctggtcgtagttgttcgtatcggacacctggttgacgagctggccgaggaagtcggtgagtcgtgcacggtattcggtttcgaactgcttgaggcccttgatgttgccttcgatgaccttggtctgggtctcgaggttgtcgcggacctgctgggcgtagtcgtcggcagcggtacgggtcttcgaatcgtagtcgaaggcgcgcttctgcacttcggcttcgtagttgtcggcctcggtgtgcttgtcggagaagtacgtgtcggcgtcctgggtcttctgagccaggtagccgtcgccctcttcctgcttctgcgcgaagtaggcgtcgccttcctgctgcttctgctccagataagcgtcgccatcctgctgcttgccggccagataggcattgccttcctcggtcttctgcgcaaggtaggcgtcgccctcctcggtcttctggttcaggtacgcatcgccatcctgctgcttctgtgccagataggcatcgccatcctgggtcttgccggacaggtagttgtcggcgttggcgcgggtgtcggtggagtactggtcagcctcggaacgagtgcggttggagtagtcgttggcgctgccgatgatctcttcgtacttgcgctggctttcctcggtgatctccttggccttggccttgcccttgtcgacgtactggtcgtgcagctgcatggccagcgtcagcatggcggtggcgcgctccggctcggtattggcgcttgccgcggcacctgcgatcttctgcaggctgccggtttcggtgctcggctcggacttggcgacctgttcgcgcagctgtgcctcgcgaatctgggaatccttcagctgctgggcaagctgctgaatctgcatggcctgctgcttcacctgggcatcctgctgctgggactgggcagcatgctcctgagtgagctgctgggcctgagcgacctggtcctgcgcttcctgaagctttgcggtgagctgatcgatctgctccttctgacgctgagccacgaccacctgctcctgggccgatgccagctgacgggacaggtcctcggtctgtgcgcggaacgtgtcacgctcgtgctgcacggcggtaagctgctcgccaaggtcggcctgaccggccgcttcggctgcctgggcggtgagctgatcgacctgcgcggacagacgatcgatctgccccttgagctgctcgttctgggaagacagcgcacgattgctttcctctgcctcggaaagcttggcggccgcggcctgagcggcctgagcggcctggtctcccgcaccagctgcctgctcggaggcggacttcagcgtcgcgttctcctgctgcagggactggatctgagcattcaactcggaaatcttggaattgagtcctgcgacatctgggccaagagactgcgtggcctgtccgccggcaactgcctgcttgccaagggcttccaccgtctcggttacctgatcgaggaagtcatcgacttcatcgacgtcatagccttccttgaaccttacggtctggaaagtatgctccctaatatctttcggcgtcaacagagccataaatccttacacctcgctttgggcttgatgccttactgttgttgctttcagtgttcgactctagcacgaaaccatagatattttgcggaaaaacggttttttagaggtgctaaataaggaaatcaatgaccacaagaacgaaataaagcacaagatacgcgacgtcaaaatagatcggtccgagcggaacgggacgaatatactgccgcaaccaccttaacggcggctccgtcagctggtagatggcgtcgaacaacgaggccacgattccgcttggccgccacgtcggcgacaatgccaacacccagtcgagaatcatgcggacgaacagcaccaggatataggcgttgaccagaaaatggacgacgctaccaattatcgagagaatcacgttgccactgtatcaagcgcgcataacaaaatgcccccgctttcagtgggggcataatcgtctgatttgtgcttgctctgtgctacacggctcagtcggcgaacaggtcgtgggccggacccttgtcttcaggctcctcgaccttgatgttcacttgggccgggctcagcaggaacacgcgcggagtgacgcgttcgatggagccgcgcacgccgaacaccacaccggcggagaagtcgacgatgcggtatgccacggcttcggccacacctgtcaggttcagcaccaccggaatgccgtcacgaatggcgcgaccgaccatctgcgcatcgtcataggtcttcggatggatggtggtgatgcgactcactctaccccctggaacgggttggactgctcacgcggagcggacggcgtggaagcggaagccgaagaggaaggcatcggggtgacggaatgatccgaatcgaacgaggtctcgccggtgtcgacgtcatcctcgaaatcatcctcaccctcggcgacgtcggacattcccaagtacgacatcgcgttcttcatgaaacctgccatgtatgttcctttcgcgtctacgcgttgactttagcgcaggaaatccggaatatcgaggtcgcccggatcgttagccgaaaccacttcatgctcggtggtctggtcgaacgaggcgacgttctggtccggagtggacggaatgtagctggacagcggctgcacctgcggcaccgccggagtctgcaccggctgcggctgctgggcgggagcctgcacgccggcggacaacgcggacagcggtaccgtgtttcccttggccgcggccggcttttcttcggccggctggtcgggcttcttagaattggcatcgaaacctgccgcgatgacggtgacacgcacctcgtcgccgtaggcgtcgtccagggacaggccccagatgatctgcgcttccggatggatggccttctgcaccagcgcgaccgcggctgcggcttcctgcagcttcaggtcggtcggaccggcgatgttgatcagtgcgccatgcgcaccctcgatgctttcctccagcagcggcgagctgatggcgatttccgcggcctgcgtggcgcggtcctctccccgagcggaaccgatgccgaacagcgcggtgccggcaccacgcagaatcgcgttgacatcgttgaaatcaacgtggatgtacgaattcgaggtaatcaggtcggtgatgccctgcacgccggccagcagtgcggtgtcggcggtcttgaacgcgtcgacgatgccaatggtgcggtcggacagttccagcagtcggtcgttcggaatgacgatcagcgcgtcgacttccttgcgcaggttctcgatgccgagcgcggcggaagcggaacgctgcggaccttcgaagctgaacggacgggtcaccacggcgatggtcagcgcgccctgctggtgggccgcacgtgccacgatcgggctggcgccggttccggtgccaccgccctcaccgcaggtgacgaacaccatgtcggagcccttaagcgcctcttcgatgtcggactggtgatcctgcgccgccttggcacccttttccgggtcggcgccagcgcccagaccacggctggaggcatcgttcagcgagatcttgacatcggcgtcggatcgcagcagatcctttgcatcagtgttgatcgcaataaattcgacgctttgaagaccctccgcaatcatgcgattgacagcgttgcctccggctccaccgacaccgacgaccttgatgttggtcttgtcgttgaaattgtcagtctgggcaatctcgctcaccattgtctcctgttcactcacgtatatgaacaactctatcgcaatcgcgccgatgatacgcgcacttttccaggcgtgtaccaccgttttttcacttttttgctgtcagcatgttcattctgcctgcgttgaccccttcagtcatttgtacacggctcttcgaacatgcgtgacgggctttagtagctggcatccatcgggtcatccccgaacagcgcctcacgctcctcgtgcgtggtttcccgggattccaaccatccgtaaggcagatgcacctttttggcgaagcgcacgcgcccccttggcttgtcggcgatgcgttctgggaaccgaatgttcgggtcgagtctgcctatctcgcgccggacatcctcaagattttcacattccatgaacgcacggcgtgtggaaccgcccacggggaagcccttcagataccacgcgacgtgcttgcgcaggtcatgcacggccatccgctcgtcaccatcatagaattcggtcagcagttcggcatgccgttcgatcacgcggcacacgtcgcccagcgtggggtcgacgcgctcgtcactgccggcgaacgcgttcttgatgtcggcgaacaaccatggacggccttggcagccgcggccgatcgcaacacccgcgcaaccggtttcggcgaccatcgccaacgcgtcgttggcaccccaaatatccccgttgccgaagacgggaatatcaagctcggaaaccagctcgccaatgcgggaccaatcggaatgcccaccgtaatattcggcggtggtgcgcgcgtgcagggtgacggccttgcagccttcctcctgcgcgatgtgcccggcttcgaggaacgtctcgtgttcatggtcgatgccgacgcggattttggccgtgactggtacgttggccgcgtcgcacaccttgaccacgcgttggatgatctcacggaacaggtccgtcttccatggcagcgcggatccgccgccacgacgcgtcaccttgggcaccgggcagccgaagttgaggtcgacatggtcggccatgttctcgtcgatgacgattttcgcggcctgctccacaatcgagggattgacgccgtacagctgcagcgaacgaatcttctcgctgggtgcgaaacggcataggcgcagggctttcggattgcgggccaccaatgcgcgcgcggtgatcatttccgccacgtacagaccgtcgggaccgtagctttcgcagatcacgcggaacggccagttggtgacgcccgccataggcgaaagcaccaccggcgtttcgacgtgcaccggacccagatcaacgggctttataacgggaggaaccgacggccgttccgcgtcggtacgcgggtcgagcacgtcggattcctcgtaggcattcacaatgctatctggcataggtcagacttgttccgttcgatatgaccgattcggggcgatcagtacaggccaccggcttcggcgatcttgacggactcaggccaagcctcgccgcccatttcgaccggcatctgcggcacgctgacgcgcttctcgccgatgcgctcggcgatgtagtcggccaccttgtcgaggctgacgcgctcctgctgcatggtgtcgcgttcacggatggtgacggcctggtcgtcgagggtgtcgaagtcgacggtgacgcacagcggggtgccgatctcgtcctcacggcggtagcgacggccaatcgcgccggcctcgtcgtagtcgatcatccactcgttctggcgcaggtcggcggcgagcttctgggccacggactgcaggtccggcttcttgctcagcggcagcacggcggccttgaccggagccagacgcgggtcgagatgcagcacggtgcgcttgtccacaccgcccttggtgttcggagcctcgtccacgtcataggcgtcgacgaggaagcacatgagggagcgggtcaggccggcggccggctcaatgacatacggcacgtacttttcaccggtggcctggttgaagtagctcaggtcctcgccggagtgctccgcgtgcgcggacaggtcgaagtcggtacggttggcgatgccttcgagctcgccccaatcggagccctggaagccgaacttgtattcgatgtcgacagtgcgcttcgaatagtgggccagcttctccttcggatgctcgtagtggcgcaggttctccggcttgacgccgaggtcgaggtaccactgggtgcgggcgtcgatccagtactggtgccaggcttcgtcctcgccgggcttgacgaagaactccatctccatctgctcgaactcacgggtacggaagatgaagttgcctggcgtgatctcgttacggaaggacttgcccatgttggcgatgccgaacggcggcttcttgcgggaagaggtcatcacgttcttgaagtccacgaagatgccctgcgcggtttccggacgcagatagtgcagggagttctcgtcctcgaccgggccgaggtgggtgcgcagcatcatgttgaagtcgcgcggttcggtccacttgccgcgggttccgcaatccgggcacacgatgtcggccatgccgttctccggcagcttgtctccatgcttctcggcataggattcctcaagcttgtcggaacgctggcgcttgtggcagttaaggcattccaccagcggatcgttgaagacggccacgtggccagaagccacccacacgggggtcggcaggatgatggaggtgtccacgcccaccacgtcgccacgggtgacgaccatggagcgccaccattcgcgcttgatattgtccttcaacgccacgccgagcggaccgtaatcccatgcggaacgggttccgccgtagatttcaccggcgggaaaaacaaagccacgacgcttggcgagggatacgacttcatcgagtttggatacagccacaatgcaccttctggattgaatggtttggggtctttacaaccgcacagcctaccgtcacatgctgacagcccagccgccgtcccgcatgcgcacgggagaccatgcggcaagcgatcggaacggcggcagacgatgcattacacaaagtaggctggagatatgctgtaccacaacccgaattcgcgcggccggcgaaatgtcttgcgcatcgtgggcgtgcttgtcgtgcttgcggtcatcgccagcgtcgccaatttcctccgcaccaccaccagcgacgcggtcagtaacgtcaagccgcagatcgaaacgatgcaggacatccggcagaccgcgcaggacagcatcacgttcgcgcagagcctggatgatccggatcaattcgccgcacacatcgaaaccgtgcaacagtatatggacgattacgaccggcttgccgacaccaagcagatcaagtatctgctgtcggacaatccgcaggaacgcatcatcgggctgttgtaccgcgaccagcagcgcaccatcatcgacagcatgcgtgtggcggcccataatctcgacgcacagaccaaggagctgctcagcgcggtcgacgcggccatggcggacgatttcagccagcatgcggcgcaatggctgctgcaggtggacgatccgacgcaggtgaacgagctcatcgaccgatacggcaaacagcgtgagtattcgtcgatgcgggaaatgctcaccggactggaatcattgcacaagctgcgctcggacgtgaagcagcaggtctcgtccgcggtcagcaatctgcacagcgaggaagcctcggcggctgcgatcgccgtacctgagcgcaacggcgatctcgatccggccggatggtacacgctcgccacgaacgtggtatcaacgatgggcgtgcagatcgagcagaccatggaattcaactgcggcggccagtcaggtgagaatccgaacggattcgtggcggcctattactgccagatgcccgaccgcacgcagcgggatgtcgtgcatatcctcaccacgcacccaggttggacgcagaccgcgcgaagcccttggctggtggacatggtcaagcacgagctctcgcaccgttcgatcatggtctcctgcggcaccacccaaccgacgatcgcggccgaccgcaccgaggcggtgacgaattcctattcggtgctgtttttcggggccgatcgcaaccgcatcgccgaccagcagcagggcgtcgccgaatacgcgatggatgcgcacagcgaccagctggccacagccatccacgatggcaattgcgggtgatgtgagtcggtttccgcttggcgactattgcacatccttgaattcgatagtccagttcttcgcgtcgtcgccaagcacattgcgcacatactgctctagaatagtccacgcgcgagcttcggcttgggcaagcaacgccgaatcggttttcgcctgcttcagcatgctttgctgggccttatcaaacatttccgttttctcttcggcggtaatcgaagtggcgaaaccagtgctcaccagcggtttgctgaacgacttctcatttacgtccggatcatccaacacgtgagctggaggcacggtaatgattactttatgaccgttggcatctggactaattgttactttatcggcatcaataccgtacttcacgatgccactgtattccatccacatacgtttgtagccattattgaaaaaccacgatccctcatgactgagcttggccgtgttgtggtaataacattttaatgtggccatctgtgcgatatacgtggcattcgagaaagttgggatagcttctttcttttcctcgccgcaccctacagcagaacatgcaagcgtagcaacacataatgcggcaatcgcacgtttcatggaacgattattcgtcagcatgcgcggtctccttagtgagctttacggtctcggccttctgcaatttgtatccttttgcttccacgagatccttggtcaacgcatccacagtttgttcaagattgctggcagcaatagaaataatgtctccgtttgtcttggtttcctgttgcgcatcctgcttgcaaagcttgatcacctcatcaatttcaacggacggattgttctcgaaaaagtcgaggctgccgctatcaaccacgacgtccccaatagtcggcttcggcagaatcggagtgacggtcttcgcggtatcgtccacttcgaacgtgatatcgctcatcttgacgccagcagtcaccgtcgcctcatatgcaacatgccacttgtccttaccagcattgtctttctttacagcaacaccgccataatggaatttcgcggtcgatagatcgtcgatattcacagccgcctgcaactggctttccacactgatggtagattcggtccttgcattgtcaaaaacaggtttaacgacaccgttccacacaaacaggacaactgcaacagtgacaattgccgcaacagcgccaaacaacaccttacgcaacttttttgcactgagatcgccgaacaacctatcgcaaagaccgccccgcctccttcgactcccgtcatttctcgccaacgcacattcctttcacggttctcttccgtcaacaattctatccccgcacgcaaatacatagggacgtcacaaacgtctcaggaaataatacggggaagcccatctcgtggaatgattatcggaaataatccgatatttgatgacgtttcatcataatgaaaatgcccgccatgtcttcctgcaaggcaggacagcacacataccacttactacttccacgccggcttaaacattcggatgggatactcaaaagagcgtggaagaggcgacctgctattcagcacacgaaatgctgcagccgaacgtacaatggtcgccccatgtcttcgctattcggcgataccgtttttggactaaatcagccaatcggtcacgtccttctcggaaacagattccgagaaacggtgcccggtaagccatgtaccgctgcctgccattttctggagcgtggatgcactgttgccgatatcggagctggcggaagtgcagaacggaatgatcgtcttacctgcgaaatcgttggatttgacggaatcgttcaccagccaaacaggtgccatccaccaaatcgggaagcccagatacacagtgctgccggcaccgaccatgtcatggaccggaatcattcgcggccggcacgttccttgacataaccgacgaagcggtcgaccgcctcaggggtgtcgtggcgaaagaacatgctggtcttggtgtcaaggcccgcgatggttgccatctcgctgtcggagagccggaaatcgaaaatgttcaggttttcttccatgcgctccttgtgcgtggacttgggcagagcaacgatgtcgcgctgggtgagccaacgcaggatcacctgcgcgacggacttgccatgcgcctcgccgatcctggccagggtgggattggagaacatgttctgcatgccctccccgaacggagcccatgcttcctgagccacgccccgcttgaccatgttcttgcgagcttcgatctgctggttgagcggattagtctcgacctgatcgaccatcggggcgatctcattgaaggcgaccatatcggccagacgatccggatagaagttactcacgccgatggcgcggatcacgccgtccttgtagagcttttcgagtgcacgccacgcgccgtaggtatcggaaaacggctggtgcagtaacaccagatcgagatagtcggtgccaagcttcttcaaggacacatcgacggacctcagcgtgttctcatagccgtaattgctgatccagatcttggtagtgaggaacagatccttacgatcgataccggaatccttgattccttggccgacttcggcctcgttgaagtacgactgtgcggtgtcgatatggcggtacccggtctcgatggcctcgcgcacgcagcgaggagcatcgtccttgctgatctggaagacgccgtatccgatcttcggaatctcaataccgttggcaagtttcacgtattccactgtttttccttccataaattcgtcggtattcagtgccggcatgtatgccgttctgacccccacgataaaatccggtagctgctaccggtcaaattacggcacgccggtactatctaccggtattaataaccggaaatgtgacatgataggtacaaacaaaaagaacaatgcgcctcaagcccgaccccatccggcggcacccgccgaacgtcctgccgcgcagcgtccgaaaggagccacgtatggcaatcacggcagtgccactccataagaacatgaaaacctatacgatgaagcaggcctgcaaactaaccggcatgaattacgaagcattgaagttctattgcaattcaggactcgtgcccggtctcaaacgagaccagaacaaccgacgcgtcttcgacgagcgatgcatcgcatggatcaacggcctgacatgcctcaaacgctgcggtctgggcatcaaggagatgcggcactacacgcaactctgtcttaaaggtgagtcatcgataccggaacgtcaggaaatccttgccgaaaaacgcgagcatctggagacgcaactggaggaactgcgtaaagccatcgcatacatcgatgaaaaacagcgcttctacgccgacgtgactgccggcaggacggcatactgcagcaacgtcatcgacacgacgcaaagcgactgactgcgttccgtaggtgatttttgcgttccgtaggcggtcagcttcgaatccggacacgagcaaacgcctaattccaggcatctcgccgatgcttatccggcagcaaccacctacggaagcccaaaatcacctacggaatcgcgcctgtcaagggacgcagatagattaaccactgttgtaaacatgcgggggtgcttgatgtccaagtccatcaagctgagataggcatgaacgcctgaccctttgaacctgttggttaggaccaacgtagggagcagatcatgagcgatgacccatccaccaatgacgcactcggcacattgcgtgccgccatcaaacaagccgtcacggacgtgcgcgggcagacaccattggcgcagtcgttcaccaatttcgtaaccatcaatctggtggccaacgcgcagctcgccgcgggcggcaccgcggccatgagctatctgccggatgacgtgatcgccaccgccgaaatcgcaggatccaattacatcaacgtgggaacgttgctgccgttcttcaagaacgcgctgcccgagatcgcgcgcaagctacatgagaacggcaaaacctgggtgctcgatccggtcgcggccggcatcggcgagacacgcaccgccatcctcgaatcgttccgtgacgttccgccgaccatcgtgcgcggcaacgccagcgagatcatcgcgctcgacgcgatgtggggactcgccgacgccgacagcaccacgcccgcgacccgtcccgccggcgtggaagccgtcgatgaggtcgatgccgcggtcgacgcggccaagcgtctcgcccgccatctggcgaagcgctcccccgttggagcaggcgcggtcgcggtgtccggcgcggttgatctggtgaccgacggcgagcgcacgttccgcctgcccggaggcagcgcgatgatgacgaagatcaccggcgccggctgttcgctcggcggcgtgaccgcaacgtatcttgccgtggccgagccgctggtcgccgcccttgccgcgtcgctgctgtatgatcgtgcgtccgaaatcgccgaagtcaaatccgatggccccggttcgttccaggtggcgctgctcgacgcgctgtggaacgtcaccgccgaccaggtggccgcgtccgacatcatcgaaaccaactgaccgcaacgttccgtggatggtttcgcaccatcgcaatcgtatatacggaatatatacgttcagtgcggtgcgacggaaaataaacggaaaataacaagacttcttctggagcacttacccaaagaacaacaaaggggagaccaatgaataattatccattcgcctcgatgcgcgactgctttgatatgagcgcgtatttcgtggtcggtccgcaggattgcaagggccggccggtgacggatgtggtggatgacgcgttgcgtgggggcgcgacgttcatccaattgcgcgccaagaacgcggatgcgaaggatatcaccgaaatggcccgcgatatcgcgcaggtcatcaagaacagcggcaagtccgattccgtggcgtttgtgatcgacgaccgcgtggatgtggtgtggcaggcgcgcgacaagggcatcaaggtggatggcgtgcatatcggccagaccgatatggaaccgcaggaggctcgcgcgctgctcggcgaggatgccatcgtgggcctgtccgccgagaccgaaagtctggtgaagcttatcaacgagctgccgagcggctgcatcgactacatcggcgccggcccgctacatgtgtccaccaccaagccggaggcttccgtgggcggcaacgacggttccgggcacacgcttgacgaggaacagatcaacgcgatttgcgcggcgagcgagttcccggtagtggtcggcggcggcgtacatgccgacgatatggagatgctggcccgttcgaaggcggccggctggttcgtggtgtccgcgatcgccggtgccgacgatccggaagcggccacccgcgaaatggtgacgcgctggaaggcggtgcgcggcgacgcgaagcacggctatgcgccgcgtgtgaagtagtccgtcgtacaggaaatcgacaagcccgctgagatgagcgagaagttccgcaaaggtggttctacactgtatcagtgagctcagtgaagataatcaatgaatcagtgagcctaataaggagagttaccatgaccagcacattgccaccggtattgagcatcgcaggatcggattcgtccggcggtgccggcattcaggcggatttgaagaccatgctcgccaacggcgtgttcggcatgaccgcgatcgcggcgctgaccgcgcagaacaccaccggcgtgacgatggtcaccaacactcccccggaaatgcttgcggcgcagatcgacgcggtgttcgaagacattccgccggtggcggtgaagattggcatggtgtccagcgccgagctcatcaccgtgatcgccgaccgtctgaccgcgcacaacgcgaagaacgtggtgctcgacccggtgatggtggccacgtccggcgcgaagctcatcgaggatgatgccatcgcggcgctgacgtccaaactgttcccgctggccactgtgatcacgccgaacatgccggagacccaggtactgtgcgacttggccgtagagcagggtgcgggcgcaatcgactatgagaacggcgaatccatctccaccgagaacgacatggtgaccgcaggtcatctgctcgccggccatttcggctgcgcggtgctcgtcaagggcggccacggcacgcatgacgcgagtgacgtgcttgtcgagccggatggcaagatcacctggttccgttcccgtcgcatcaacaacccgaacacgcacggcaccggctgcacactgtcttccgccatcgccagccatttggctcttggcgaggcgctgccgacggccgtcgaccatgccaagctgtacctgaccggcgctttggaagcgcagctcgatcttggacatggttccggtccgatggaccacgcgtggaagtggcgttgagccaagccacgcgaaccacggcaaccgttggaacagtacaacaagtaatcgcacgaaaacacacgagacaacgctgagaaaggtaatcatgacgctcgatcgcaacgcagaaaagcaggaagtgcccgtcaatccggaaaccggcaaaccgtatatcaacacgcttgccgcagtagccatctcccccgccggcgccagcccggagaagtccacgtacgtggcgcaggccgtggatgtgatccgtgaatccggcctgccgaacgagacgaacgccatgttcaccaacatcgaaggagacatcgacgatgtgctcaaggtgatccgcgacgctaccatgaagctcgccggccagggataccgcaccgacgtggtgatccgtctcgacatccgccccggtttcgaaggacagatccacgccaagcaggaactggtaaacgagattctgtcgaaataaccccctttacagtggtgaaacgaaaccattccatgtaaaaaagcgcgctttttcttggcaaaagcgcgcttttcgcgtttatttgggtatagtgttgcgattatgacgacaatgaaggaaatcgccgaacaaacgggggtatccatctccactgtatccctggtgctcaacggacgcgacgaaggcagggtaaatcccgcgctcgccaaactcgtacgcaacaaagcgaccgagctcgggtacaagatcaatccgttggcgcgaagcctgcgtaccaacaaaacccgaatcctcggcttcatcagcgaggaagttgccaccacaccatacgcaggcggcatcattctgggcgcgcaggatgcggccagtgcctacggctacatgctgttcacagtcagcaccgacggcaaggcgagcgaggagaacgaaatcgccacgttgaaacgatacggcgtggatggattcttctattcgaagatgtcgaaccgcatcgcgcatgtgcctgaatcgttgagcgattatcccgtggtgatggtggacgccaccgattatgagaacaaggttcccagcgtcgagcccgacgagttcatgatcgctatgacgccacgatacggttgctgcaggccgattgcaaacgtatcgcgtacgtgggttgcgcggaaaacatgatcgcgcaggacggtcgtcttgccggctactgcaccgcgttgcaggaggccggacgtgcgttcaacccatcgctggtatgcaacgtaatgaacgacggtccagctttacgcgccgtgaacaagttgttcgacgacgagcatccggacggcttcttctgcttcaatgatgcgcgcgcctggtatgtgtacgaatgcgcggcaagaagagggcttacggtaggcaaggatatttccgtggtcggcgtggacaaccaccgcgtgttcgcagagacacttgaaccgcagctgaccaccgtcgaactgccacattacgaaatgggctattggtcagcctgcaagctgatttccatgattgaaggcaaggatgtggataccagttcatgtccatccgccagagcttccctgccgccgcttgatgcgccgattccggcgaagatccactgcgcattgttggaaaaagattccgtcatatcctgatttttctgtttttacaacgattcaaatgcttacgattgttcgcacagccattttctatacatgaaaattgtgcgtttgttcacgacacgccgaataaagcaatcgtgccaacagtccgccagcagttgattcaggcttaatttcaactatccgcaaatccttacaaacgtttgacgtcaaacgattgacgtcaaacgattgacgaagcagttgcaacatgctatcttgaagccatgttcgcttttcggcacggcagctgaaatcagagcaggcgcaagccaaaacaacatcggaagcgatcgctgccgcgcggcagcggcagcgcgaagagaaaaagagaatcaaaatggcaagcaaaacacgttctgtatggaagaatccttcctatctgcagagctccttcggcattttcatgttcttctgttcctggggcatctggtggtccttcttctcccgctggctcactgacccgacccacggtctgggcatgagctccgcggaacagggccagatctactccatcaactccttggccaccctggtcatcatgttcgtttacggcaccattcaggaccagctgggcattaagcgtaagctcgtgatcttcatctctgcggtcgctgcatgcgttggcccgttcgtgcagttcgtgtaccagccgatgctgaccgccggcggcaccacccgattcatcggcgtgcttctcggctccatcgtgctgtccgcaggcttcatggccggctgctccctgttcgaagccatcaccgaacgttactcccgtaagttcggcttcgaatacggccagtcccgcgcttggggctccttcggctacgctgtcgtggcactgtgcgcaggcttcctgttcaacatcaacccgctgctgaacttctgggttggttccatctgcggccccagcatgctgtgcgtctatgctttctgggttccggccgagcagaaggaagaactcaagaaggaagctgatccgaacgcaactccgaccaacccgtccttcaaggaaatggtctccgtcctgaagatgccgaccctgtgggtgctcatcgtcttcatgctgttcaccaacaccttctacaccgtgttcgatcagcagatgttcccgaactactacgcctccctcttcccgaccaccgaaatcggcaacgccacctacggcaccctgaactccttccaggtgttccttgagtccgccatgatgggcgtcgtcccgatcatcatgaagaagatcggcgtgcgtaactccctgctgctcggcgccaccgtgatgttcgcccgtatcggtctgtgcggcgtgttccatgacccggtctccgtctccatcgtcaagctgttccactccatcgaggtaccgctgttctgcctgccggcgttccgctacttcaccctgcacttcgacacgaagctgtctgccaccctgtacatggttggtttccagatcgcttcccaggtcggccaggtgattttctccaccccgatgggtgctctgcatgatgccatgggcgaccgtccgaccttcttcaccatctctgccatcgtgtttgcggctctggtctacggcttcttcgtcatcaagaaggatgatcaggaagtcggcggcgatccgttctacactgacaagcagctcaaggccatgaaggccgctgatgcggaagtgaaggcctgagtctcagcccgtactaagtcggcgtacggcgtcgatggtggtcgcaacctacatcccttctcccgcgatcatcatcggtaccgtacgcatcataacaacaatcgtggtgtccgaagcgtttccctttttccgctttgggcaccatcttcaaaaagctttttatccaacaattcataacccagattcagaaaggcattcaacgatgactggctttactccggacgcacctgtccttcacgaaatcaagaaccacagcgaggaactcaccaaggcagaggccggtgtcgcggccttcgcagccaagcgtaacaaccgctggtatccgaagttccacatcgcatccaatggcggttggatcaacgatccgaacggcctgtgcttctacaagggccgttggcacgtcttctaccagctgcacccgtatggcacccagtggggtccgatgcattggggtcacgtctcctccgccgatatggtcaattggaagcgtgagccgattatgttcgccccgtctctggaagaagaaaaggacggcgtcttctctggctccgcagtgatcggcgacgatggcaagctcaagttctactacaccggccaccgttgggccaacggcaaggacaacaccggcggcgactggcaggtacagatgctcgccgaaccagacaacgatgagctgaccagcgccactaagcgcggtatggtcattgattgcccgaccgacaaggtgaaccaccactaccgcgacccgaaggtctggaagaccggcgacaagtggtacatgaccttcggtgtctcctctgccgagaagcgcggccagatgtggctgttctcctccgacgacatggtcaagtggacctatgagcaggtgctgttcgagcatccggattcgaacgtgtttatgcttgagtgcccggacttcttcccgatcaaggacgtcgaaggcaacgagaagtgggttatcggcttctccgccatgggtgccaagccgtccggcttcatgaaccgcaacgtcaacaacgccggctacatgatcggcacttggactccgggtgagcagttcaagccggaaaccgagttccgtctgtgggattgcggccacaattactacgcgccgcagtcgttcaacgacggcaagcgtcagatcgtctacggttggatgagcccgttcgtcgagccgattccgatgcaggacgacggctggtgcggcaacctcaccctgccgcgtgagatcacgctgggcgccgacggcgacctgcacaccgcgccggtggccgaaatggaaggcctgcgcgaggataccgtcgatttcggtgcgatcgatctggacgtcagcggcgagaagaccattgtggacgatgccgaagccgtggaaatcgaaatgaccatcgacctggccaactccaccgccgagcgtgccggcctgcgtgtccacgccaccgaggatggcgcctacacgtccgttgcgtatgacgatcagatcggccgcgtggtggtcgaccgtcaggccaacgctcagggcgatcgcggctaccgtacggcaccgctgtccgaagccgaacttgccgccggcgaactcaagctgcgcgtgtacgtggaccgtggctgcgtggaggtgtacgtcaacgacggccgtcaggtgctcagctcgtacagctacgcgtccgaaggtccgcgcgccatcaagctcgtggccgaatccggcacgctcaaggtcaagtccctggtgcttcaccacatgaagtccatcggactggaatgatagacgtctgtcatggttgacaggcaaacgaccataaggcagtagcaaggggtatatgggaaggcctccgcatcggaagggtgcggaggcctttctatatctgtctctctatatctaaagtgatatctgggatggtatccaacgcacgttatctctcgttactgccgtacttgctgtgcgggtttgcctacgttccgccccaccgtctatactggcgagccggtaacaatcttttctggccgattggcgggcaggctcctcaccttactgatttcccgcagtcggtcacgtgcgcgtccactttgacgcagaaagcaaggtgaacgatggcggaatcgcacgttcaacacaaactactcggtatggcgaagcgtcgtattccaacgctgatcgccgtcatcacactgcttgtcgtatgggaggcatgggtgcgattggggcacgtgccatccacgatgatcgccgcccccagcgaaatcgcgcaggcaaccgtcgaaacctggcccacactatggccggcgacgcaggtcacgctactggaaggcaccgtcggattcctgctggccgtggcatgcggcatcttgatcgggattctgctgtattgctcccgtgttgcgaacgccgcactgttcccactgctgtctgccgcgcagacgatgccgttgatttcgatcgcaccgctgtttctgatctggttcggtttcgaagtttccggcaaaatcgtgattgtggccgtattcggcttgtttccgatcgccgtgcagacggttcgcgggcttgaggcggtgccgcagttctattccgatgtggcgttgacatgcggcgcgacccgcgcatggacgctgtggcatgtgaagcttcgcgtcgccgcacggcagatttacggcggcatccgcgtatccgccgcatacatcttcgccaccgccaccactgccgagtatctgggtgcgcgcaagggcctcggcatctggctgcaggcggcttacaattcgttccgcacgccgctgatcttctcggccacgctggtcatcatcgtcatcaccggcatactcatgtgcctcgtgaatctcagcgaacgcctgctgctcggcccagccgacgcggacgccgatccggacgcggaccagtgaaaacgcaacaatcaccattgcggccctcatcatcgtcatgcacacccgtataatgggactcgctgtttagccaatgtgtggcaaaccggcaatgttccacagcttcggcgtcaaacggtcaaccgggcggcggcaggcatcataaggaacgtcgggggcattggacgagcgggggccttagcccttcgtatcgttttctgcccgaaccccgcccgcagcgtcatccctagaaaacggtagagaagcaagattcaagggaaatcgcaaggtatgaagaagaccatcttcagcaaagcaatcgcaatcctcggctcgatcgccatgctcgtcggcgtggccgcatgcgggcaaagcaacgactccacgaaaaccgcggcggacggcaacggcctcaccaaggtgacgttcatgctttcgtgggcgcccgacaccaaccatatcggcgtgtatgtggcgaagaacaaaggctatttcaagcaggccggtcttgacgtggacatcgtggcggtggcgcaggccggcgcggagcaggccgtgaacaacggcatggcggatttcgcgctgtccaacctcaccaacgtgggcatttacacgcttaagggcgcgaaaatcaaacaggtcatgcaggtgcagcagaagccgagcgccatctggtgttcgctcgcgtcgaacaaggacatcaagtccccgaaggatttcgacggcaagaccttcgccacgttcggctccaacgaatccgacgcggtgatccgccgcatgattcagaccgacggcggcaagggcacgttcgacaaggtgaccgtcggcacgtccaccttccagacgctgtccagtggcaaagccgatttcggtggcttctacgccacgtgggagggcgtgcaggccgacatgtacggcccgaagctcaactgcttcagcgagcctgattacggcgtgccgggcaacgccgacgccatcggcatcatcaccaacaccaagaccatctcgtccaatccgaatctggtgcgaaagttcgtgcaggccaccaagaagggttatgagtacgcctacgcgcatcctggcgatgccgccggaatcctcgtcaaggaggctccggacgcgaatctgaagccggctttcgtcaagaagagcatgaagaccatcgtggacggtcaatattggggcgatccggccaaaatcaaggacggctcgtttactttcggtaccaacgatctgaagggcacgcaggaatatttcgacttccttgccaaagccgacacgtataccgattcgcatggcaaggtgattcaccaggctccgcagtcgaaggatctcgccaccgacgaattcctgaagtagcggattttgaaataacagctttcttaagaaacgaatcctgcttaagaaagcgaatattgaaataacggattcccctaagagaaagaccggccgatgacgctcacaccctccggcaaacgcaagatgattctcgatgtcgacaccggcatcgacgatgcgctggctttggcgtatctcgtctcgtttgacgacgtcgagatactgggcgtcatcggcacctatggcaacgtttcgactgacaccgccgtacgcaacacggcttatgtactggaacggttggggttccgggacgttccggtgatgtgcggctcgacgcgcccctcctgggcggccgcgttcattcccgacgccggctgcgcgcagttccacggcacggatggattgggcggattcggcccgtccgctgattgtgccgtcggacggcatacgtctgtttgtgacgattcgaacatccagacactcaatccggcacccaatgtgtccgattcgtcaggattggatgttcgagcgatgcgcgggctgatttccgttggcggatatgacgtgcacgaccttcacgccaatcccgcagccgactcgttttcgctttcgtttactgtccgcgatgccggcggcgacaacgattgtgaggaccgttcccactcccctgtcgctctgccggacggcgttcgattcctcatcgacgcggttcgcttctacggtagtgacgtcacggtggtggcgaccggcccgctgaccgacgtcgatgcggcgcttgccgcggcaccggatatcactagccggctccggctggtaatgatggggggaacgctgacgcaggaaggcaactgttgggatgcgaccgccgaaacgaacatcatccaggatccggaggccgccgaccgcgtgttccattccggtgcggatgtgacgatggccggactggacgtgacgcatcagtgcctgttggggtccgacgcgaccgtacagtggcgtcaggccgcatcgcaatcgcaggatggcgacgtgcggacgttccttgccgatatcgccgacttttccatcgcggccaatttcgccgcagacccccgactattcgcagccggcatgccattgcacgatccgctcgccgcagccgtagcggtggatccgagtttggtggaatgtttcgatctgccgatgaaggtcgaaacggagacaggcgattttcatggcacgcgcggccgcaccatcggcgatccggccggaatgattgacccgtcggcgccacgcgtgcatgtggcgctcaccgtggatcatgatcgtttcgtggctgatttcacgtggcgaatcgcgcaactggcaggcgattaaaagccgttttaggagcggaaaagaaaaagacccccgcgggggtctttttcttatttcttcacgtcctgcaattattgacggcctacggccggctcaacattaccctcgcggcatagccgctcgggcgtgaagctggaacagcccaccgggctgttccttatcgcttcacgcctccaaagcgacgatcgcggtgaatatagtggtcgatggagcgccacagcacatcacggccgcaatccgggaacagttccggcacgaagtcgagttccgcgtaggcggcttcccacggcaggaagttggacgtgcgctgctcgccggacgtgcggatcaccagatcgcaatcgggaatatccgggttgtacaggtgctcggcgatcatcttctccgtcacacgatcgccggagatcttgccgtcacgcacctcacgtgcgatggccgcgcaggcgtccgcgatttcggcgcggccaccgtagttcaggcagaacaccacgtcgatggtcttgttgttcttggttttctcctgcgccacttccagctcgtcgatgacggatttccacagcttcggacggcggccggaccagcgcacgcgcacgccccactcgttcatctgatcgacacgacggtggatgatgtcacgcgagaagcccataaggaaacgcacttcctgcggcgaacgcttccaattctccgtggagaacgtgtacagagacaggtagcgcacgcccgcttcgatggcgccggcgatggtgtcgaacaccaccggttcggccgcctgatggccgtcggtgcggatgagtccgcgctgctgggcccaacggccgttgccgtccatgatcacgccgacgtggcgcggaaccttgttctttggaaaatcgggaatgatcgacgggtcggaaaacggtgccgccggaatgtcaagggatttgtaatccacgttctcaaaagccatacccgctaatctagcaagcgcatggaacgaatcggccgttccaaatagtattcgccccattcttccactatttggtgggtttcccgttgaatcgacgcggacgccggaacaccgtccagctcccccaatcgccatcgacaagcgccgaaagccggcaaatcgcatcccacgacaccgcttccgattcgggggtatggtcggcggcgcacatcaggccgccggcgggaatcgaaaaataccaggacagcgcagacgaaatcggctcgccgcacaccacgcagacgcgcagacggggtgtccaaccagcgatcgccagtgcgcgcagcacgtacgaatcgccaatcgtggacggctcgtgcgcatgtttggcaagcgcgttcaacgcgcccaataccagccggtattgtgcgaccgcaggctccttttccgtggcgaccagcttgtcggcggtttcgcagatcacgttcgccgccgtatacgcttgaaaatcggcgcaaatcggccctgcatacgcggcgatcgattcggcttgggacacgacgtcgagcgaacgaccttccgcaatgagcagcgccacgcgcatgaacggttcgagtcggcctccgaaacgcgatttggtacggcgcacgcctttcgcgacggcgcgtactttgccatggtcacgtgtgagcaaggtgagtatgcggtcggcttcgccgagtttggcggtgcgcagcaccacgccttcgtcttgatacagcggcatcgcacctccttttcttgccgttcatcgcatcctgttatgcatacgctcgccgcacgtgcgcgttccgaaatacattcgccccgtcagtagatgaacagcccccagaacgcgaacaccagcaatacgcagaacatggcggccacggtcagccagaacatcacgcgtccgaaccgcgtggaagccagcaccggctgccgtccgctgacgatttcgccgatagcacccttacgtggcggccactgcgcgatgcctcgatgggttgcctcttcgatcagccgcatgaacacgcgggaccatgcccacaccacggcgacgcacacgatctggatcaccggccagctccaatacatcacgcccggattctccactggggcactgccccatgccagtttgaccacacccatgatcacatcgccaaggccggcgcagaacagcacgaacgtggccatagtggcgatagtcaacgtgaccagcgagtttttgaacccttgcgcaagccccagccgataccgtcgtccgtgggcacgcgcccagatcttacgcatcagcacggcgagccacagcacgcctgcggcaagcagcagcaccagcatgctggcatgcaacgcgaccaggtagatggtcaggccgcgattggctttgaggtccaatggcactgcgattgactggtacattctggtgccggccacgcgttcgctggtctgtttgagtccgtgcgtggtgccgacggcccagtcgaccacatcgtccacgtacgcgtcggcgaacggggttccggaattggcttcgtcgccgagcctcagcacatggttggcgatggggtacgtgcgtatggtgacgtcccagttgccggcctggtgagccagatcgacgattttctccgtgccttccacctgcgcggtcatgacgtctttcgtgccatacgccaccaatgtcggaatggcatacgctttcggcgtcaacgtgtcgatgtcgaggttggtgagtccgaacagggacgcgtcgatattgaatacgcggcggacgatcgactggtagccgtcatgcgcgccgacgagcgcgaagtcctgtgcggcgaggaagcccagcgaataccgcggctcgtagaccatcggactgagcagcacctgaaaagcgacgtccggatcgcgctgcagcagatacgatgagatccatgtgctttcggaagtggcgtagatgcccactttggaggcgtccaccgtatccattttccgcaggaggttgatgacctggtcgtagatggcggcggaacccgggtagtcgcgattggcgtcgttggtggaccagaccggcttgtcaagcaccgccgtcacgaatcccgccgaagacaggtcggaggccatgtcgccgaaggaattgtcgcaggtgccatagccggcgccgtgcatgaaaaccacaccgggacgtccgttcccagcccctttcggtttgcggatcagcactttgatgttctgtatctcaccggtggaaggccgtttcgctttgatggtgacgtaccgtttcgccacctcgtaatcgccttttttcgccagtttttcgccggatggattggcgaaggtcacggcggtgttggcgtcaagcgtttcgatggtctgctcggtcggctcgtagttccatgtggatgccgtcagattggccacggacaccagaatgcccagcagcatgatgaaaataggcaggttgaccatgagtcgccgtccgcgcgtccacggttgatgttgcggttgcggacgcgcgggcgatgaagccgattcttgccgtaatgattggctggcggctgatgattgacgttcctgctctgacacgccgctcattctaccggcctttgctgagaagcctgcgattgcatgctaccgacggcacgctggaacatggctttcagcagttgccgttttgcgtcaccggcacgaccaccggaccggtggcggtggcaggcaactgaccgtcggtctccatctgcgcggcgatctcctgcgccttggcgagcagggtttccacgatctggtcttccggcacggtctggatgaccttgcccttgatgaaaatctgccccttgccgttgccggaggccacgcccaaatcggcttcgcgagcctcgcccggaccgttgacgatgcagcccatgacggccacgcgaatcggcgcggtcacgtccttcaacccttcggtcaccgcgttggccagctgaatcacatccacctgggaacggccgcaggacgggcaggagatgatgtcgaacttacgcgggcgcaatcccatgtattccagcagcttgcagcccaccttcacttcctccacgggaggcgcggacagtgaaacgcggatcgtatcgccgatgccttcggccagcagcgcgccgaaggccaggcagcttttgattgtgccttgccaggtcgggccggcttcggtgacgcccaaatgcagcggccaatcgcccttggaagccaacaaacggtacgtctgcaccatggtgaccacatcatggtgcttgacggaaatcttgaaatcgtggaagccgacgtcttcgaacatgcgcgcttccttcatcgcggacgccaccagcgcctccggtgtcgggccgccgtatttggcgtacagctctttatcgagcgaaccggcgttcacgccgatgcgcagggaaatgcccgcatccgtggcggccttgcagatcgaagggccgacctcgtcgaatttgcgaatgttgccggggttcacgcgcacggccgcgcagccggcgtcaatggcctggaacacgtacttgctttggaagtggatgtcggcaatcaccggaatcggcgattttttgacgatttccggcaatgcgtcggcatcatcctggcttggcacggccacacgcacgatatcgcagccggccgcggtcagttccgcgatctgctgcagggtggccggtacgtcagccgtcagcgtattggtcatggattgcactgaaatcggcgctcccccgccgaccggcaccgggccgaccatgatgcggcgggacttgcggcgcggatgcagcgggctttcgctgatggccgcgtcaccggttttgcggaacggtttttcgatttctggcatacgtgatccttgcatgtgcgaggcgcgttatgcgccccgcgatggttcttacggcttgtgctctttacttgtttatcagcttgtcggcgcgggcgcgagcctcctgctcgagtcggctcatttcctccacggaagcgaacagcgggttgccgcgcagttcggcgtccatctcgtcaagcacttcgcgcacggtgtcgacgatgccgaggtatggcagacggtgttcgaggaacgcgtggacggcctgctcgttggccgcgttgagcacggccgtatgcttttcggacgattcgaggcagtgccgggccaggttcaccgcggggaacgcctcgttgtcgagcggctcgaacgtccacgtggccgccttcgtccaatcgcatgcggcggcgacgtttccgagacgttccggcgcggacaggccgagagcgatcggcaggcgcatgtccggcggcgaagcctgcgcgatggtggcgccgtcgcggaattccaccatggaatgcacgatggattgcggatgcacggtcacgtcgatgcggctcggtggcacatcgaacagtcggcttgcttcgatgacttcaagacctttgttcatcagcgtggacgagttgatggtcacgaccggccccatgttccatgtggggtggttcaaggcctgttccggcgtgatgtcggtcatttggtcgcgcttccagccgcggaacggaccgccggacgcggtgacgacgagcttggacacttcgccgtgtgtgccggaacgcaacgactgccagatggcggaatgttcggaatcgaccggattgatctgcttgtcgcgtacctgcgcgctaaacagcaggtgtccgccggccaccacggattccttgttggccaatgccagctgggagcctgcctgcagtgccgcgatggacggttcgaggccgatggagccggtgatgccgttaagcaccacgtcggcgccggagcctgccatggcgatcaccgcgtcagggccggctgtgatgttgacgttgcctgcgccggcctgttccaacgcctcacgtagcgcggggacagcttccttgtagaagatcgcgacggttggcacatggaatttcgccgcctgctgcgcaagcagttcgacatgtgctccgcccgcggcgagacccgtcacggtgaagcggtcgagatgacgtgagatgacgtcaaggccttgggtgccgatggatccggtggagcccagaattactacggttgatggttgcatgggttatgcgctgctctccgtatgatatgccgatgttccggtattggtttggactatgtaagttgggactgtgtagtcgaggctgtgtagttgggattgtgtaaacgcgagaacaggctgacgattccgccagcctgtttattaccgttggttcactcgaaggacgggaacgacagatccggaatatcgagattgtcgtcgttgcccgacgccgggaaaatcgacctgaaagccgggcttggttccggctttttgtcctcctgctgcttgtccgcatcggattcggcggacggttcagttgccgggccaactgccggttctacggcaggttcagccggagcggccggctcggccggagcctgttcaacaaccggagccggaatgacagttgggttcgaatccggaaccggagtggccggagcggccggttcaggcgtgaaggatggcggcaccgaggctgcgagggagctcaggctcgtcgaaccggtggtgacctgaggcaagtcggacgcggacaggctcggaacctgcggcgtgaacgtgttttccgtctggttcgtctcattgatggtgtgggccagatgcgccaacgcggccaaagacggatcctgctgcggctcgggttcaaccggagccggcgggaatgccggagcggctggagcctgcgaatcggtcgcggtcggagccggagcctttggcgcggcatcttccatcgcatcatcggcaagcggatcgaacgcctgggtctcttcaacggcgctcggcgcggaagaagcggaatcggtctgcggctggaacaccggcggaaccaccggaaccgcaggcggagtgttcgtcggcgtggcaggcacgctcaccggggaggtgaccgcggacgtgaagatctcatgctcggccttgttcagcgcgtcgaaggaatcctcttcgctcggcgtgacggttggcacagtaggaggaaccggagcagccggaaccgtggcggaaggagctgcgaacagcggtgcgatcatctgggtttcgccagctgcggaatcactggaagccggggcaacggacggtgcggccgcggccatcgcctcttcggagggttcaccgacgaaatccgcgacgcgcgcatacgattcgagtcgggtcagcaactgcgcgcaggcggccagatagtaatccacctgacgttcgtcatatcccctcttgcctttgcgctgagtgaagatcacgttgctcaaggtctgggaattcgtgtcggcgatcgccttggcgtccgcttcactgacttcctcgacacccagctcgccggcggctttcgtcaggcacttgtcgatcacgctgtcgacctgcttgcggtcgtagctcggattcttgccctcgcccggcttgaaccgttggccatgctcgcgttcggcatgcgcgtcgagcttcttgaacaggtcctcggtctgcgccttccatgccacacggccatgctgggagatttcccacgtggtctgcttgtcgaccacggcacgttccagacgggcaagcgcggcatccacttgggcgatcacatagccgcccttgaccagttcgaaggagacgttctgaatatcatgctgggtgagttgcgcgccctcaccttcatacagcatgtgcgcacgttcaaggaaagcatccacctgttccgcatcgtagccccactttcgcttcgcggcatgagcgattcccgatgcgttcttctcggtttcaggttcctgtgccattggcgttcgacctcctgctacacgtattaacgtcactactttacgtgattgattcgacgcagacgccgcaaaagatgaaaattcagtgaatcgacacgtgcggctcatcgctcgcacggcggtttcgtaccgatcaagcggcatcatatccgccatgccgacacacgagtgcggctcatcgcgcggatacggtacagtagttcgttgcgggcgattagctcagttggttagagcgccacctttacacggtggatgtcgggggttcgaatccctcatcgcccacttttcgcaacgccgtgaaaaatcaaggaatcgcatatcatcccgcgtaatatcaacgcgcgcacccgtgttttgcccacattccgcccacgttttgtttgtgttttgccggaaagtccacgtaatagcgaaatcccccaaacccaatgggcccgggggattttcgtatacgcgagaaaatcgcgaaaagtcttggtttacttgcccttgccgaacgcgcgcaggtgaataccgttccaatcggagctgacggtcagcggagtggcggcgttcatgccggcggtcttggccgcggactgcacggtgctggagcttgcggcacccggacgtcccggcttcggggtgagcacccacagcgggccgtcatcgccgagaaccgcataggcgtcgacaatggtgtcggccagttcgtcctcgtcatcgccatcacgccaccagatgatcacaccatcgactgcggagtcataatcctcgtcgaccagctcctcaccggtcagttcctcgatcttggcgcggatcgagtcatccacatcatcgtcccacagccattcctgtaccaggtcgccggcgtggaaaccgaattcttcagcgttatcagatgccgtttgattcacgttcgtcaatataccaacactgctcgaacatatacgttacgaacgccggaatcgcccacttttcgagatgaaacggcgatttccgcctgtatcacgcctatccccttccgccgcacgctcattgcttgacggtgcattgcggcagtgaaccgcctttaccatcgcggatggcgaccagcgcgtcgtacgcctcatccaacgtgcccaccttcaccacgtggaggccctgtggcacatgaccgaccacgtcagagcagttggattccggggcaaggaaccacgtggccccgtcgcgcttcgcgccgatcatcttcaaccggatgccgccgatcgcgccaaccttgcctttggcgttcatcgtgccggtacccgcgatggtcttcccgccggaaagctgctctccggtcaccttgtcgatcagaccgagcgtgtacatcatgcccgcggacgggccgccgatgtcatcgacgtgcatggacaccttcataccggacacgtcataaccgtgcgccttgaggaaccgcttcgcggccgtggccgcggcgttctgcgatgaggacatctccttgttgctttccttcgcatagtccttggcgctttgtccgacggggaacacggcctcctgcggaatcaccgtggccttcggattggcccatgccagcaacgcctgcgcgttggtcacaggatatccgggaacgcctgaggcgttgacggtgacgagcagtagtttgccggagtccttatgcgtcttcacgccggacacgtcgatgacctgcttgccttcgacttttccgagcacgtcctgggtcggtcccggctcctgcaccacgtacgcgctgggcgcaataagcaccagcacgcaaagcacggccacgatcggtccggcgagatatcgccaagggcgaacatcgaaccaccgtccgacctgacgccaacgtcgtctgatacgtggcagaaggccttgagacgacccgttacgtgtacttttggcgtgaactcgctgtgtttcctgcatatcggccatgcctcccatactatggaaggcaacgaacttaacaatcgcgtggaacaaaggcaggaaacggtatggatgagaatgcgatccgccagtggcttatcgattgcttcggaccgattcagggcgagatggcatggaaccagctttccaacatgccggaagccgtacgcgaccagctgatgagtcaggatccgagcacgctgcccaagcccgaagaggtcaagtccatgatgcaggcgttcaccgccggcggactcaacaccatgggagatatgcagcaggccgtggaacaggggccgatcaacatcaaactggcgaaatcgctcgcgttgcagcaggcgaatggtgccggatcggacagcagcgtgaacgccgaaaccggcgaaatcgcaagacgtgccatcagcgaggcgaacctgtggcttgataccgcttgcgaattcaacccggcgcaaggcgagacgcagctgctcacccgcgccggctgggtggaggacacaatcgacgcgtgggcgcagttcgcctcccccgtggccgaatcgatgaacgacgctctggcttcgattctgtcgcagcgtttcggcgacggcgaaatccagaccgagatttccggggttttcgcaggccccatcgaaattccgattccggacgaaatgaaaaatccggcgaagctgatgcgattcgtcggcaacacgtcgttcgccatgcagttggggcgtgccgccggcgacctgtcccatgaggtgcgcggcagcttcgatcagggcatcgcgctgctgaagaatcccgccggcggactgatcgtgcagaacgtgaccgaatacgcgaagtcgctggacatcgacgtgaacgaagtgatgggctatcttgcgctgcaggagcttgcgcatgccaggctgttcgcctccgtgccgtggctgatgccccgcttcgaggcgctgctgggcaaatacgcgcgtggcatcaccatcgacatggatgccatggaggagcagatccgtgaggcggagtccatcgatccggattccatggccagcgcggtgaacatcaccaaggtggcgttcccggacactccggagcagaagcaggccatgaaggcgttggagaatctgcttgccttggtggagggctgggtggatgccgtcgtgtggcgtgcgggcatggcgcatattccgcatatcgaacagcttcgtgagatgttgcgccgcgaacgcgccatcggaggccctgcggaacgcacgttcgaaagcctgatgggcatgcaattgcgccccaagcgcatgcgtgaggcggccgcgctgtgggaaagcatcggcgcgcaggaaggccccgaggcgcgcgacgcgaaatggtcgcatccggatctgctgccgcaactgccggacgaacagtccgaggatagctccaacgaagagaacggcgccgcatccgccactaccggtacggaacagaccacggcgcaacaggatattccggacagcatcgattgggatgccgaactgtccaagctgctcgacgaggaagagcacaagggcgatgacgccgatggcacgaacgacgccgacggtacagatgacgccggcgatacgaacgcttccggcgacccgcagtcaccggaagaagcgtgatttcctgcgcccgcgatcggacccatcgtcttcgcgggcgcgcgcataggacacgtcgagtgtgtcttcggcacgcgtgaccgccacgtacatcaatcgccgttcctcttccagaaggtcgccttcgggcggtgaaccgtatggaatcagcccttcggagcacccgatcaggaacacgtgtttgaattccaggcccttggaggcatggatggtggagatggtcacgcctttaacgtcgccgcctgcgccaagtgcttccaacatggccaagcgggtctgagcgtcatccgcgagcgcggagttctgccatccgctgtctcgtttgacgcggtagcgcaggtgttgttcgcccagtgcccggcagaggattttctgctgcgcgttgactcgggtgaggatggcgcagtcgcccggagatgctccctcgtccacgagtctgcggatgcgtgcagccacgccccgggcttcttcgagatcgctgttgtagacggtttgcgcgactcggcggccttggtctcgcttggagttgagtttgagatagtcggcgcgttgcggtgaggcttcgagcacgcggttggcgtagttgacgatctgcggtgtggaacggtagtcgttgttgagtctgacgtcggcggtgagggggccgaattcggaggcgaagttgagcaggttgtagctgctggctccggcgaacgagtagatggtctgtgccgggtcgccgaccacgcagatgttgcggttgtcaccgagccatcgggtgagcagccgatgctgcaggggcgagacgtcttggtattcgtcgacggtgagccatgtgatgccggagcggatgctggccgccacgtcttcgtcgctttcgatgaggtggcaggtgatgagcaggatgtcgtcgaagtcgatttcgttgcgattggttttttcggtttcgtaggctttgtagacatccacgaattggcttggttccagtcctgccggcggctggtggtggatggccgcgcagacgcgttcatagtcttccggcgcgatgagcgagattttgcaccagttgatttcggcttgcaggttgcgcacggtgtcgtcgtccacctgctgggtggtgactcggcgtagggaatgttccacgatttcgcgcggattgcgtgagatgaacggcatgggcccttcgcatacgtctggccagatccgacggagttggtgtagtgccgcggagtggaaggtggcggctttgacgtcggatgcgacgtcgagttgggatagtctgttgcgcatttccgcggccgctttgacggagaaggtcacggcgagcgtggcgtgcggatcccatgccttgatggcgcatgcgtaggcgattcttcgggtgacggtccgcgttttgccggcacctgcgccggcgatgatacggacgggaccgcgcacggcggtcgccgccatgcgctgcgcatcgtccagtccgtcgagaatcgcttccgctgttgcatccatatgctccattgtggcagattgcgtgacgatacggacgccatcggcgcgattaaccgtgaattcgtggcaagtcgcgcccttattagccttcagtgtgtattaaggttggaattgtgaccgaacgaagcagatttatgatggccgccttggcgagcgcggcgatgccgaacgccaccatcgctggcacgcgtgacagcgagcaggtcaacgccaccgacaaggggtatggcattgatcatgccgtggtgcaggacgccgcgggcaagttgtatgacacgttcgcttcgaacacgccgaagggacgcaagcgtctcgctggtcgcgtgcgtgccgcgcagacgttgatgggcaaccgcgagttgggcggattgggattcgacgtcgatcgcgttctggcgttctccaacggcgaacaggagaggtccgtcacaggagacgtttccgtgatgatcgccacgcatcatgatggtcaggcgcgtccgctgacgctgctgacgttggacgactgtgccagcgtgggcaccgcgttgggcgcgatacaccgtctccgtccggattttctgcaggaggccggctatccggtattctccacggggcagattcgcgcgcagctgaccgcatggatcaagcgtttgcgtcaggctggccatgtgccgcaggagatcacgacgagctggtccgacgttcttgaaacggacggcctgtggtcgttcgccacttgtccggtgcatggtggcctgtccgacggcgatgtgctgttctcgggctcgtcgatcaccgccatcacgaactggcaggatatgcaggtcaatgatccggcacgtgatttggcgtggattttctccaaacttgacgaaaaccaccgtaatgcgctgctcagcgcgtatggacgcatgctgggcaatcgtctggatgatctgatcatgctgcgcgccaacctgtggctgcagatggaacaggtgggcgatttcatcagcgcgttgaatcaggccgatagcgtcaagatcatgcagttcaaggcacaggtggagcgtttggctcaccagttgggtatgctcaccgcgaagaaccacaggccgagcgagacgcgtcaggacgagcagaaggccggcaaccgtccgccgagcaccatcaccgtgggcacgttgctggacgaatcggaacgtcgcaggcaggcggcggcgcagcagaataacgatgccgacgcgaccggcgaacgtcatatcgacgcgaccgatatggatgatgacaggaccggcgatttcgacgtcaccggctcccagcccgtccgtaagacgaagcagatcgtcgatgacgccacggaagcgttcgatgtgaccgccgccgaacatatcgcctctgccggcatggtttccggcaatgccgattcggacgatacgagcgaacgtgaggaatcccccgtcagcacgttcgttccggagcagtccgcgagggagcgtcacgagtcgttgccgtccagttcgaccattgtgatcagcacgttgcagaccgccgatggcagtgacgacacgaacgaggaggaaattcctcaagcccatagcgaagcggcgaccatgctcattccgctgctcgaacgcgatgaggccactatgcagaaggccaaagcggaggtcgaccggctgcaggccgaggacgccaccgatgagaaaccgcgcgtagaataagcgcatacattgcaaacgactttgcacacgaacacccttacaaggagcatcatggatatcgaactgggcattcagaacgtggcgcgcaccgtcaccttcagcaccgagcagagcgccgacgaggtgaacaacgtcatcgccgaggccgtggagaatggcaagaccatcaacctgaccgacgacaagggccgtcgcatcgtggtgccggccggttctctcggctatgccatcatcggctccgaaaccaagcacgccgtcggcttcggcaatctctgatcgtcgcctgcaaacgcgttggacacgttccatatgaaaaaggcgtcggaccatatcaggttcgacgcctttttcatattcgattcatgtatccggttcacgcttggaaattccatatccggatttcatgcggcatgtgagctgccgacgcgaccgatcaaatccacaccccggcacaagatttcgcgtacggtgtcgtcgtcggtaaggttctcgcccagaccgttcggcttgcctttgccatgccagtccgagccgccggtcaccagcagatcgtgccgtgcggcaatcgtcagcaatcgttcgcgctgttccggaggattgccgcgatgccatacttccaagccgtccaagccgtcggcgatcatcgcgtcaagctgctcgtcggacagcagccggcggttgcgttgcggatcgcccgcatgcgcggcgaccaccacaccgcccgcccccttgacggcggcgatgacctcgtgcgtcgacggcgacggcgtgggaatgtaatacttggatttggcgctcaccgcgtcggcgaacgcgtcggaacgcgtctcgtacacgcccgccgcgaccagcgcgtcggcgatgtgcggacggccgattgtggtgcgctccccttccttcacttgggcgagcacatcgtcccacgtaatcggaaaatcctgcgacagccgctcaaccatgcgtttcgtacgccgcaatcgcgccgcacgcgtgttggcgaacatgctggaaatatgctcgttggacggatcgtattggaaggcgagcatgtgcacggacacatcttcgtcgacggcggtgatttccgtgcccagcagtaacggcaaaccgatttcctccgaggcttccgtcgcctcgtcccagccggcggtggtgtcatggtcggcaatcgccacaccatgcaagccaagcttccttgcctgctccaccagcgtgcgcggcgtctccgtaccgtcggaaaagacggtatggcaatgaatatcccaaccttgtgcgggtggttccgcgtaactcacgtgactcatatgactatcgtaagctcgaatccgcggtttttcgcgtagactgagacatgacaacgtttgtattttgattttccaaggattgacgatgagcgattttgaaggccaggccgctgtggacgcagccgatgacgaaacgagcgtcggcacagccgtcgccatggacgacgactacacgaagccgcgcggatggcgtcacggcgcaacgtggacgtatctgatcatgctgctcgcttcggcggtggcattgctcgtatcgttcattctgtcggcggacacgctgaaaatggcacgcaatcccgggcagaagctcaactgcgatgtgaacgccgtgctgtcctgttccacggtggccgaatcctggcaggcggaaatcgtgaagttcgccggattgagcttcccgaacgcgttcttcggcattgccgccgaatcggtgttcgtgacgatcgcggtgatcggattgtccaaggtggccgtgccgcgttggttcgcgctgtgcacgtggctgggcggccttgccgcgttggcgtattcgtattggctgaccacgcagtcgctgttcgtcatcaacgcgatgtgtccgtggtgtctggtgctgatgttctccaccaccgtgcagttcatggcgttgtcgcatgccacggtggccgtgcaggatatgccgtccggtcatgctggattgcgcaagtattaccggctgaatttcgatctgatggtcgatgtggtgtggattgtggcgttgatcgtggtcattctcgtcaaggatggcccgatgctgttcgcctgatacggtttgcatcgagccttttgcgatgaaggccgaccctgcggggccggccttttgcctatccgcttttcgtttgctgccgcagcggttacagcagttcgattttgcctacgatggtggcgctgccggtaagcttcacgtcttcgtcggtcacgtcgacgcgcaaggtgccgccacgtacggtgatggtccaatggtcgatgccggttttggcgcgcaacgtgatggcggtggcgcataggcccgtgccgcacgacagggtttcgccgcaaccgcgttcgttgacgcgcatggtggcctcgcccgcatcgtcgccttcgctttgctcgtcgatgcgcacgaactccacgttctggtccgacggaatctcgggcgcgacgaccggcttggtgaccagatcaaggtcttcgacgttcggcaggctggcgaacgcgtcctcgagcacggccacgacgtgcggattgcccatgtccacgaacgtgccacgcgcggaaccggacgtgcccggaatggtcacttcgtaaccgtcgacgtcgccacgcttccatgcgcccatctccacctggaacacgtccttgccgaggcccggcacatcgccgagcgaagtcaggaccttcacgccggcgcgggtgccgagatggaacggcttgccgcccggctggtcggcgatgccctgccgctgcgcgaacagcgtgatcgcacgtgtgccgttgccgcacatctcagccagcgagccgtcagcgttgcggtagtccatgaaccagtccgcatcgcccgccgcgcaatcggcgatctgcctttcgttcacatcggacaccgcctgcggatgcgccagacggatcaggccgtcgccgccgatgccgaaatgtcggtcgcacaggaatcgcacttcatcggcggtcggctcgtgcgtaccgtcttcgtcgagatacaccacgaaatcgttgccggtggcgtgcgctttgtaaacaatgcttggaatgctcataccagttcactctacacgcggtaggctattgaaagcgtttggcgtatgcgcctgcgggcatgcgcgcgatggcaaaggaggacgtatggcttcaacggcacctatcggcgttttcgattccggtttggggggtatttccgtagcgcgtgagatccgccgcgacatgccgaacgagcatgtgctgtatttcggcgactccgcgaacgctccgtacggcacgaaatcgcccgaacaggtgcgcgaactgtccgacgtcattgtgaaacgattcgtggaacaaggcgtgaaagcggtcgtgatcgcctgcaataccgccacttccgccgcagccaacgaactgcgcgacacatacgacattccgatcatcggcatggagccggcattgaaggtggcttgcgaccgtggtcacggcaagcgtcagcgcgtcatcgtggccgccactcccctgacgttgcgtgaacgcaagttcgccgtgctgatggaccgtttcaaggccgaccatacgatttttccggagccctgccccggtctggtggagatcgtggagcatgggcagcttgacgaccatgatgtggtgatgcgcacgctgcaccagtatttcgaccaatacgatctgtccacgatcgactccgttgtgctcggctgcacgcatttcgtgttctaccgcgattatttccgcgaactgctgcctgatacggcggcgatcatcgacggcaatgaaggcaccgtgcgtcaccttggcgtggtgctcgaatcgttgggcaagctcgctccggaagacgcggaaggcagcatcgatctggccaattccgacacttccgcacgaatcgcgcagttggcgcagtcgctgcttgatcgctgagcgcgaatgtcccgacagaccgcgtaaagtcgaatgaaaacccggcaaaagggacggacttgcgaaaggacgggcgcatatggccaacaggacagcgatgatcgacgtcggcggcggtttccgcgcgatttacggcgcgggtgtgatggaccgcatgctggaggacggcatacatgtcgaccattgctatggtgtttccgccggcagcgccaatatggtttcctacatttccggacagcacgggcgaaaccacacgttctacacgcagtacgcgttccgtaaggaatacgcgagcttcgacagctatgtgaagaaccacaattacgcgaacctcgactacgtgtacagcacgctgagcaaccacgatggcgagaatccggtggattacgaggcgtttgcggcgaatccgaccgaattcaccgtggtggcctgcaatgcggacgatggttccacgaagtatttcgacaagtcggacgtcggctacgacaattacgacatcatgaaggcgtcatcggcggtgccggtggcgtgcgaaccgtatgtgatcgacggcgtcccgtattacgacgggggcatcgctgatccgattccggtgcagaaggccatcgatgacggctatgaccgcatcgtggtgattctcacccgtccgaaagacaccgtacgcgaacagaagaaggacatcggcccggccacgatcctgaagcgcacgcacccggaggccgcggaaaagctgatgaaccgctatcagacgtacaacgacgagatggcgttggccaaggaatacgagaaggatggccgtgtgctcatcctcgcgccggaaagcatgtacggcttgaacacgctgagcaagtcgttcgaaggtctggaacgcatgtaccgcgccggatatgcggcggctgccgcgattccagcgttcttggaaagctgaaatccgttcttccgcagcgctgtcatgcgtttccaacggccctaacggcaaccgtatgacagtgatcgcatgacagcaatcgtacatacgacgattacatggcagccgtcgtatgtacgttacggcatcgcaacacgcgtaaccgggcggcggctatgctggaacgcatggaaaagcagaatcgtattttttccggctttgatgccgatgccatcgatcgcactaccgccgcagatctggccgaagtcggttccgacaagtggacccgctaccccggctgtatcggcgcgttcatcgcggaaatggactacggcctggcgccgtgcatccagcaggccatcgacagcgcctgcgaccattgcaaactcggttacattcccgaaccgtggaagcgccgcgtggccgaggcgtgcgccggctggcagaaaagccactacggctgggacgtggatccggacatcatccgcgtggtgccggacgtgttggaagcgtacgagatcttcctgcgcgagctggtcggcgccggcaatgccgtggtcgtgccgacgcccgcgtacatgccgttcctgagcgtgccgaagctgtacgacgtcgacgtgatcgaaatcgaaatgcttcagggaaccgacgaaacgaccggcgagcgcgaatggctgttcgatttcaacgccatcgaacgcgcgttcgcggctggctgccatgcgttcgtgctgtgcaatccgcacaatccgatcggcaaggtgcttacgttggccgaggagcagcggctgtgcgagctggcggaacggtacgacgtgcgtattttcaatgatgagattcacgcgccgttcgtgttcgaggggcgtcatattccgtatccgaccatcagcaaggcggccgcgcggcagtctatgaccgctaccagcgcgtcgaagtcgttcaacattccgggtacgaagtgcgcgcaggtgctgctgacgaatccggcggaccgtgagatgtgggcggaacgtgcggagtggagcgagcatcagaccgccacgatcggtgcgatcgccaccaccactgcctacaacgagggcgatccgtggttccaggacgcgctttcctacgtgcgacgcaatcttgggttgttcgacaagcagatgcgcacgcggttctcgggcgttggctatattcgcccgcgcggcacgtatatcgcatggctggatttcggcccgcttggcattgacgatccggccgcgtatttccttgagaaggcgaaggtggcgctgaccgacggccgttcgtgcggccgcgcgggagccggctgcgtgcgcgtgaacatggcgatgccgtatccgctgctggtggattgcctcaaccgtatgcatgacgcgttgcaggcggacggtttgctttaaagttttccgtctttcgtgtgtgaccgacgctatgggcggccacacacgccatattgcgggaaaatccgccgaatcattgcgattgcaacggttgcgctatgggcgaatagcagcatgttacgatggccgcacaccaccgtcggtggacgcgcgacgcgaatccagcgtatgcgtttcattgagaagaaggctttacgaatatgcgattcccctacagcggcaacggcacatggacgcccgactaccactgcggtttcattgatgccgtcaaacgttttttcatcggctacatggagtttcgggggcgttccagcagacgcgagttctggctcgccatgctgttcttcattccggtcagcgtgctgatattccttattccggctgccggaacggtgtccggaatactgtggatgctggccaccatggtaccgatcatggccatctccttcagaaggctgcatgatgccaaccgcaccggctggtggtttctgcttgggcacgtcggcaccattctggcccttgcgatgctggtcgtcattgcgttcggcctggtcatcatcgaaatcggcatgatcatggtcatcccccacgagccaccgaaactcgactttcatgacccgaacagcttcccgggaatgctgctcacgctgttctatgtcagcctcggcatggccggcatctcgctgatcatccaagcattcctgtactcgctgcccagcaagcccgagggcgtccgcttcgactgatgttctcagcggcatcccgcccctcttccctccctgcattaccctcttagcccttttgtatggaaacgttccatctcacattgagacagagcagtgagctcggttaacaaaactcctataatcacgtctattgtctttccgccgtcataagcgacggaatgtcaacatcagaggagaaaacaatgaagagaaacatgctccaccgcctggtcgccatggccgcggcgggaaccgtgctgatgtcggtcgccgcgtgccgctcgtcatccgatgacaacgccgccaccagcaattccagcgacacctcgctgatttccgtgaacaacagcgagccgcagaacggtctgattccgagcgacaccaacgaaatgggcggcggcaaggtcatccgctacctgttcgaaggtctggtgagcttcgacgcgaagggcaagcaacatctcgaagtcgccgagagtatcaccccgaacgaggatgccaccaagtacacgatcaaactgaagaagggttggaagttcaccaacggcgaggcagtaaccgcccattccttcgccgacacctggagtttcgccgccaatgtgaagaacgcgcagaagacctcgagccgcttctccaccatcaagggctatgacgagctgcaggatccgaacgtcgatccgaaggccacactttccggtctttccactccggacgactacacgctggtcgtcgagctgaacaagcctgattccgtgttcccgaccaagctcgcgcaccaatccatgttcccgctgccgagcgtggcatttaaggacatcaagaagttcggtcaggctccgattggcaatggtccgtacaagttcaagtcctggtcgcatgacaagaacatcatcatcgtgccgaacaaggattataagggcagtcgcaaggtatccaacaacggcatcgaataccgcgtctatacgaatgaggattccgcttactccgacgtgctgtccggcaacctcgacgtgatggatcagattccgcagtccgcggtgaagaccttccgtcaggattccagcgtgatcgcctacagccaggcaggatcctcattccagtccttcgtcattccggaacgtcttgagcatttcggcaacgacgaagaaggccaattgcgtcgtcaggccatttccatggccatcaaccgcgaccagatcgtcaagaaggtttacaacaacacgaagaccccggccaccgatttcacttcaccgctcgtccccgaatatgtgaagaagctggagaagaacggcgacaacctgaagtacaacgcttccaaggccaaggaactgtggaagaaagccaatgccatcaagccatggtccggcaacttccgaatcgcctataatgccgatggcggccataaggaatgggtcgacgccgtgtgcaaccagatcaagaacacactcgacatcgacgccgccggcgaaccgtacgccacgttcagcgacgtgcgcaaccaggtgaccaaccgcaccatcaagaccgcgttccgttccggctggatgctggactacccgtccgccgaggattacctcaacccgctgtacgcatccagctccgccgacggccatggttcgaacgatggcgattacaagagcgaagaattcgacaagctcctgaacgccgcgctcgcccagaccgacgtgaagaagcgcaccgaggacttcaccaaggcccaggaagtgctggccaacgacctgccggtgattccgctgtggaacgacaacgtcgcggccgtgtccgcaacgaacgtgaagaacgtgtcgttcgactacaccaacctgcctacctacaacaccatcaccaagtgacggcttcgttgtgacgtttcgctgccaatcggcaacgaaaaatgagtgggggttcgaatccttaatggattcgaacccccactcggcgttttacagccgtttcgtttatttgcttacggcgtcaaacctatggcgtcagctctgcacgtagctgcccttcggggacttccaaccgcagttcatcatctcgctgttgaacaccatcgcaccgtcgccatgggcggggacgacgatcatgccaccgtcgccgtggtgacgggccacaccgtccagcgcggccttcgcagcctcgaccggatcttccttggcatacagcacacggtcggaaacctggtgtgcggcgacttccttgacgaacgcctcaccgatgccggtgcaggagattgcaacggaatcgttgttggcgtaagtgccgcaacccggcagcggcgaatcgccaacacggcccggcatctggttggtgatgccgccagtggaggtgccggctgcgatattgccggacgcgtcacgtgcgacggcgccgatggtgccatgcttctcccattcgtcgccattggactgcgcctcacgcagggattcctgacgggccggggtgatgaagtactcgctgtcgcacagttcgatgccccactccttgagcaggttatcgcccggcttggcgaacatgacgtgcttggtcttctccttgatggcgcgcgccacattgatcgggttcttggacgtggtcagaccgcatgcggagccgacttcgccgtcaacgccggtcatcaggcaggaatccatggacacgatgccttcgctcgtcaacgcggcaccacggccagcattgaattcgggagcatcctccatgacacgaatggccgcgcagacggcatcctcggccggagcgccctgttccagcagcgcatagccggcttcaagggccctgttcagatcctgctccacctgggcgcgacgttccggcgtgtccttcttgccgcgattgccagcgcctgcgtggatcaccagaaggattccatccggatcagcctgggcaacccggaccgtcgactgcggcaatgctgcttcgtttgttgacatcttctctccttcagatatctcgcttatgtttgacattcgcagatatcttacgccggttgcggcaacgaagcgcccgacatgcgcaaaagcgatgccgtcgcgccgttacgcaatcaaaaacatatcgaagcgcgactgcgtcctttcttacgtttcatacttttgcaaatcgcaatctcgtatttcatggtgctcctccgttggtagtgccagtatgtgtcaagcgcatcgttccccggacaaaatcacgttcttaagcaaagccacgcttgtaaatcggaaacacaagtcgttgtggcccctacggattcatgtatatcgaaatggctgaataattatccatcgcaaaaactctcgtaagcaacacctatcgagataaatgtagcttattttaacgttagctacacttatgcggataagtgtagctaacgcacatgcgatgcgactgatagattgacaataaatggatattcgtatacttattcgtatacttttttatgcgttttcaaatctcgcagaggagaaacatgtcagccgcatcgatccttgacagcatggtctccgtcaccagccttaaccacggcggagcaagcaaagcattaagtcaggtgggcgacaaccatccagtcgtcgtactcaaaaacaatcagcccagcgcggtcataatcacgcccgccgactatcgccggctcactcaggctgaagaaaatttcgcgctataccgcaaagccgtggaacgcctacgcaacgatgacagcacactgctaaccgatgcagacgtattcggcgaagattatgagccgattgatgacggttttgaaccagaattcgaataaggtccatcaacaaccggcaagtggacaattttgtatattttgatatggcgatgcaggttgtatgaaatcaagaaatcgacgtcttgcacagccagattgaatatagtggatggcattgcgatacgtacaggtttcacttttggtcggagcagtatccatgcacaaaggcgatttatcaatcacacgaggagctgactgaaatggcagcgttcggcaggccggaatatgaccgttatgtacgtcttgcggaaatgatgatttcatttctaagagaccatggatacaactacgacgccaatctcgatcaagacatccttgaccatgatggaccgggagtgccagtcgaaaatggcgttgacgccatcatcgagttcaacctcactcctccgaaggatatgatcaccttgtttggacaagttcatgatgaaaatccttggtgcgacgaggaatacgaacaatttcgcgattacctgcgagaacgcgaagatgagcaccaatcgggtaaattgattccgccatccgcagattagaacgccccccacacacacaagtaataatcgtttgcactgttcatcgtagcgggcgcggaactcattctcacttcccgcagtgacaccgtatgccagataaaaaaccgggaacggacgcgacgtttgaattacgacgaacccgactcccggcatcgcgactgcttctcaaaagatgtgtgcttgactcacatggatggtactgagaaccattcgcttgcgatctgcttccgcacacatgctggcgcgatgtaaatacaacgcaggcacacggcagatacaaatcaagtctgtgcaaaacttccagccagcaaagaagccgaccggaaagccacaggccactctagtcgtatggtcgaatattcacaaattaactgaccaaaccgacatatgtcatgtgaagtgagcgataaatcaaaaaacggcagttcaaaagcggaccatctcaatacacgtatcccatatgggatacgaccggtagtgaaggtccggtcgtacacgcttatcgtatttcaatccacacatcccgtatgggatgcgacgcaccgcgtctacgaatttccgtgatcgtagaaatttcaatccacgcatcccgtatgggatgcgacttgccacgattaaacatacatcctcctttcgtgttttgcttcaatttttcttaagcaatttctgcactgtttttccgcagtatggggccgctggtttccatcaggaactgcaccatatgaccgcccagacgaaaacaggcaccagcccgccgtgcctgtatattcccgagacgcagcccaaaaacgaatccgccggctgcaaccggcggcgctcgggaaggaaaggacgatggcgataccgatgcccaaacagcaagatatcaggagactggaccgtcagggagtgtccaggtcggagatcgcgaggaggccggacgtggaccgcgccacggtcgcgaaatacgccgacatggacgacatgacgccgaaaccgcccacggacaggcgccgcggctccaagatcgacccgtacgcggcgttggtcgacggatggctcgaggccgaccgcaggccgccacgcaagcagcgccacaccgccaaacgcgtgcacgacaggctccgcgcggagaccgagtacgacggcgagtacacgacgacgccggagtacgtgagacgctggcgcgaggcgaaccggagaggttccgacggatacggcgagctcgtctgggcgcccggcgtcgcgcagatcgatttcggcgtggcgaaggcccgcatcgccggcgagctcgtggacgaccactgcctggtcgtcacgttcccccattcgaacatgcggtacgtgacgagcctgcccggggagaacgcggaatgcctgtgccacgggctggtcgaggtgttcgagcacatcggcggagtcccgccagtgatcgtcatggacaacgccaccggcgcgggacgcaggaacgcgaggggcgaggtgacgcccgccgcggtgctcgacgtgttcgacatcaaaaaatcgctgtcacacaagggcaacccctacgacaacgccgtggtcgaatcgacgaacaggccgctgaagaaggagctcgtgtaccggaaccactgcaccacgatcgagcgactgaggcatgaccccgacgactacgtgtggtggtccgacaaccagcggctccgctccgccctcggataccggagcccgaaggaattcaccgaacagggactcgtcctctaagaaaccgtccaacacgctgttgccaatccactcgtgctctacgagcccgtcggcaccggcaagacgcatctcgcggtcgcgttgggcaggctcgcgtacatgcgcgcgatacctgtcaggttcttcaccgcgaccgggctgcttatgatgctgcgccgcgcgaaacgggaagaccggctcgacacggagctccggcagatcgccagggcgaggctcctgatcatcgacgagttcggctacatgccgatcgacaaggagggctccaggttcctgttccaggtcatatcggattcctacgagacccggagcatggcccatatcatgaacatcgagttctccggctgggggcgcgtgctcggcgacaagaacatggccgccgcgttgatcgaccgcaccgtgcaccacggaaggctcgtcagattcgagggaggctcctaccgtagcgagcacgccctcatgaccagatagctaggaagaaaagggtggcggattccgacgtcgcagtttctgttggagaccagctgcctatgctgctgaaaaatagtgcctatactgtggatgccaacttgcagaaacacaccagagcgccgccgcgcacccgctccggtcgatttcaatccatgctctccgtaaggagagcgacccctctactggtaaggagactgattatggtcgatatttcaatccacgctctccgtaaggaaagcgacccgaccgcgaggtagtcggatgattgcatggcgatatttcaatccacgctctccgtaaggagagcgaccaccgcgccatgcagtatttcagtactaccccgttatttcaatccacactctccgtaaggagagcgacatagcgaggccgtcagatacgagcttcccaaactcatttcaatccacgctctccgtaagaagagcgacactccaaaaaccactgcatacactgttacacctaatttcaatccacgctctccgtaaggagagcgacatggaaaccccgcgcaattccgataattacgatatttcaatccacgctctccgtaaggagagtgacttaccgtgacgggcaccgccacgtacgtcaacccatttcaatccacgatctccgtaaggagagcgacaccggagagcgtcggcaaatggcgaaactattattatttcaatccacgctctccgtaaggagagcgacaatatcagaggcgcatgccaagcgcaactcagatatttcaatccacgctctccgtaaggagagcgacctctagtgtcctaagttataggcgagacttgtgatttcaatccacgctctccgtaaggagagcgacgattctctatggtgatactcatgattcgtccttaatttcaatccacgctctccgtaaggagagcgacatatcctgcgtgaccagctcgtcacgctgcggcagatttcaatccacgctctccgtaaggagagcgactgcccgtgacgcgaatcgcgtagccggtcaaaccatttcaatccacgctctccgtaaggagagcgacgcctgggcgtgatggacgtgggcgactcgaccgtgatttcaatccacgctctccgtaaggagagcgacgcgtggaagcagcttttcgtcagctatggcgcaaatttcaatccacgctctccgtaaggagagcgaccgtatcctccctgatcgtccgcggccaggtcggaatttcaatccacgttctccgtaaggagagcgacggccaccgtcattcggatatgcggcaggcttggaatttcaatccacgctctccgtaaggagagcgaccattgagagcgtggagtcgcgggaaactcacgatatttcaatccacgctctccgcaaggagagcgacctggcgtccattgacgatggaacagtccgaagcgatttcaatccacgctctccgtaaggagagcgacttcgggttccgggggagtgtggccgggaagcacatttcaatccacgctctccgtaaggagagcgacacgcgactaagactgcccacccaccattaaaggaatttcaatccacgctctccgtaaggagagcgacgtcatcgatcatcatgccgtggcgaacttcaccgatttcaatccacgctctccgtaaggagagcgaccgggttcagctgcgccttggtcaggtcggcgctatttcaatccacgctctccgtaaggagagcgacgtttcgggaaatgcagccgcacatgacgcaataagcaatttcaatccacgctctccgtaaggagagcgacgcgtattgcgggcgaatcatgtcgccatgctcggcatttcaatccacgctctccgtaaggagagcgacgcagagtattatggcccgcttcggtgccttcgatatttcaatccacgctctccgtaaggagagcgacccaggcacaggacggcaccaaccgcaccgtcatgatttcaatccacgctctccgtaaggagagcgaccaggccgccgaccatgtcggacaccaactgcatatttcaatccacgctctccgtaaggagagcgacgcatgccgactggcagggaatggctccgttctgatttcaatccacgctctccgtaaggagagcgacttgacaacgacggtatcctgcgctgcggtcttgacatttcaatccacgctctccgtaaggagagcgacatacaggcgcgggaaagcgccataaccgcgtacgaatttcaatccacgctctccgtaaggagagcgaccccgcgttctattggaacgccaaaagtcaagagatttcaatccacgctctccgtaaggagagcgacaagagtgtctgagagatttccagagtgtcgtaatttcaatccacgctctccgtaaggagagcgacttcgcatgtgctgggattcttcctcttcatccatatttcaatccacgctctccgtaaggagagcgactcgcttgatgcttatggcgtggctcaggcttgatatttcaatccacgctctccgtaaggagagcgactgtccgcccctgcctcattgtagttggggatataatttcaatccacgctctccgtaaggagagcgacgtgcaatgagcgttgacgtattcaacgcgctgaatatttcaatccacgctctccgtaaggagagcgactagcacgaactgggaagaggcggatgccagcaaatttcaatccacgctctccgtaaggagagcgactcgaatatgaagaacgcacctcgtacatcgacatttcaatccacgctctccgtaaggagagcgaccggcagacaccaccggccgccatgcgctccattggcattttaatccacgctctccgtaaggagagcgacctgctgcgcgaacgtcggaatgccggacacgttatttcaatccacgctctccgtaaggagagcgactttggagcacggctggatcggagagaaccccattatttcaatccacgctctccgtaaggagagcgacgccacaccgagcgcaacgggtcgctgctgaccctatttcaatccacgctctccgtaaggagagcgacgtgcgcctcttctgggaagaggtcgtagacgaagccatttcaatccacgctctccgtaaggagagcgaccaaccaagtggccgaagcgctgctcggagccggcaaatttcaatccacgctctccgtaaggagagcgaccgttcctcgcgggaattgtagaggcgagtgtcggaatttcaatccacgctctccgtaaggagagcgacccttccacgatgcgatcacctcgggcgtgaagacatttcaatccacgctctccgtaaggagagcgactggatgtctgcacgacgtacctgcaccggtataaatttcaatccacgctctccgtaaggaaagcgaccatgcaagcgcaagaaaaacttcgtcaacagacgatttcaatccacgctctccgtaaggagagcgacaaatacgcaaagtcaagatgctggtgctgcgagaatttcaatccacgctctccgtaaggagagcgacccgctccccacgcatcggcgtccatcttgcgcttatttcaatccacgctctccgtaaggagagcgacggtggcgcatgaggttgtggtggcggcgggagatatttcaatccacgctctccgtaaggagagcgactctgccagaaagtgaatctgaaagctcaatggcgatttcaatccacgctctccgtaaggagagcgacgcggcgctggtgaaccgtatcggcggtacttatgtatttcaatccacgctctccgtaaggagagcgacgcggcgctggtgaaccgtatcggcggtacttatgtatttcaatccacgctctccgtaaggagagcgactctccctctacgccgcaatatttgcgattgccgaatttcaatccacgctctccgtaaggagagcgacgcgcattcaaaaacggcttgtccccaacggttagatttcaatccacgctctccgtaaggagagcgaccacctggaagtaattgctggtgcattccggattatttcaatccacgctctccgtaaggagagcgaccaggcgcgtggctatcgcgccatttgcgagacatttcaatccacgctctccgtaaggagagcgacccaataaacagcgtaaaaatgacgggacatggtaatttcaatccacgctctccgtaaggagagcgaccatccgccatgattcaacgccatccttcatctcatttcaatccacgctctccgtaaggagagcgaccaacttccagcaggaatacgttccaagataaggaatttcaatccacgctctctgtaaggagagcgactcttggggaggctgactgacatgacgcgcagtagatttcaatccacgctctccgtaaggagagcgaccgacgctcctgcgggtaacgctcgtaatcaggctatttcaatccacgctctccgtaaggagagcgaccgccacgtccgaccatcacgccgacctcgtcgcgatttcaatccacgctctccgtaaggagagcgaccatcgccgcgcagcagtcgcgcatcgttgaactcatttcaatccacgctctccgtaaggagagcgaccaactacagcctcccgctcaacctgagtgacctgatttcaatccacgctctccgtaaggagagcgacctggtatcaccaattttccaaccttcatgacggtatttcaatccacgctctccgtaaggagagcgaccggcctcgtacgcgacgtggtcgtcgccattgcaaatttcaatccacgctctccgtaaggagagcgaccacacgccacattcatcaacgccatcaagggagaatttcaatccacgctctccgtaaggagagcgaccacggacggctggtatacggcggccgaggtacggatttcaatccacgctctccgtaaggagagcgacctcgccgaccggctcaccgacctgaccaacctcgaatttcaatccacgctctccgtaaggagagcgaccctcttcggtcaggctaaacgcctcgtccaaggtatttcaatccacgctctccgtaaggagagcgaccttgactggttcgaattgcatgtgcgcgtatggtagatttcaatccacgctctccgtaaggagagcgacccaaaagcgtctgagagacttccaaggtgtcataatttcaatccacgctctccgtaaggagagcgaccccacggctcaacacatggctccgcgaccaatgggatttcaatccacgctctccgtaaggagagcgaccatgtactccgcccatcgtcccatggagtctcgatttcaatccacgctctccgtaaggagagcgaccggactggcatgattcggctgacgtcacttatggaatttcaatccacgctctccgtaaggagagcgaccgtcggttggtgccgcatcaagatgcaccttgtaatttcaatccacgctctccgtaaggagagcgaccaccgcacagccaacgatgtcgccaatacgaaagcatttcaatccacgctctccgtaaggagagcgacctatcggataactaagggatgtaaccgtttgtaccatttcaatccacgctctccgtaaggagagcgaccctgtacggtgctgccccaatacagattttcctttttatttcaatccacgctctccgtaaggagagcgaccttccaaatcatcgagacgttgcgcgatctcgtgagatttcaatccacgctctccgtaaggagagcgacctggacgctccccaagccgagggggtggcttcatatttcaatccacgctctccgtaaggagagcgacccgtgcagctggacatttttgtccactttctgagacgcaagccagctgcttggctttaagcatatcaaacaacaccaccggtacgacgaacaacatgcctaaaacgagcagctgtctttctgtctcattttaatgtccactatttagttttcaaacgcccacgaaaatcacaattcggatttcgacagtttttcaggtgcgaaaggcacccctcatcatgagcgcttccacttcgcacaaacaccatttcaagaccggccaccttgccgaaaccacaataccgccggctagagaacacgctccagatgccggacgtcacacgtcacactcaaacactcaacccggcataccccacaccatatcgttatgacaccatgccattttaccctgtgctatatcatcatcacatcattaaccggcaaactccgttcatgcccataacgctcaatcctatccgcatatcgagcgccaagtttataaaagcgcagactgtcctcatcaatattggcaatcttcaacaaatcgtgcaccaacaccagataatcggaaggactcaccgagcattcgaaaacactgttctgtacacgctgtccgtatttcatgcatgtcttcgccaccaaacgaagacgacgcttcccctcaggggtttccgtactcacatcgtacgcaaccacaaccatcatggtttttcacctccaataacacatcaccacgaatcatcgcataccgccacacacagctacgcaccttttacttccacataaatggcgggtaatcatcaagatcaccccgcaacgatcgagctagcagcagcgcttgcacatacggaaccaatccccacgaaattttttcttgcaggaacggatgaagaatctgatcactcttctttttctgccacgccgtaagcactttcttccgcccgaaatcagacagcagcaccccgccattctcccgtatttcaaaatcccccggcttaacagcgcctgtattaaccaatgtcagaacgaagcggtcagccaacaccgggcgaaactcttcaactagatccaatgccagagaggctctccccggccgatccgtatgcataaaaccaacatacggatccaaccccacaccttgcaaagccgcaatgcaatcattcgtcaatatggagtagcaaaaagacaataatgcattcagcctgtccagcggaggtctcctcgacctactggtgaaaaagaaatcatctttattcttcagaaccaaatcgtcaaaagcgtagaaataatctttggcagcaagcccttcgacacccctcaactcatcaatcgtcaagctttttcgagcttttgacaatgccgccgacaatttgccgctctgctcggcaagtcggtcgatgttcacccgcaaagcatgatcacgtttcgtgcgttcgagcacccatttcgcattgtaaagcttgccaacaatgaaagatttcgcataacgcaaagatttttgttcgtcatccgcgactcgaaattgttcacggcgaagtagcacattacgattctcctcccctaacacggaacagtaataatgacctctcggtgaatagaatgccatagaaacgcccagtttgccgcagcgccccataagagcaggcgaagcacccttatacgagaaacacatgattccttcaattgaccgtaatggcactttcgccaaggtttggtcattctgataaatcacaacattatcgttctccaaggcaagataggcatcttctgtcatcacaaacaacgtgtttaacagctgcttcatcactccccgctttccttgagccgttcttcgatatatgcttttgccgatttcatcttccgtaattcaggcaggcacaaatcccgtagagaacatgccgaacacgatctggtctgtttcactttgggagtccatccacgggagaaaagatcatgcatttgcaagaagtcagcttcgaccatgttgcgaagatcttcgtcaaattttacccgctcacgacgttttgtctgctgatagaacaaagcaccttcaggaatatcacacgcgagcatttcttccaagcacatcgcttccgcgcatagctgtaaacgatcagcatcaatcgttttggatttgccgtgtttgtattcaatcggatacggcaaccacaatccatctcttccgtgaagcggaacaccatcattagacttatggaattccacaacatcacaggctccagttatgccgagcgctcgcgaatagactctcaaatcccgcatgatcagcatatcgccgcgagattcagaagccgcataatcgtgggcgcgttcatgttccagatgccccgctgtggtcagataattttctgaccacagctgctcgatatgaataagcgcccattgacgcttgcagaatgagaaatgctgaatacccgaaagggccagccaatctgcttctgaataaccatctggccctttcatataagcacctctcatctaggcttggacgctgtaatcagcggccttcgattacttcgtagcgaaggcctggaatggaagcgtcatctacattcacggttccatccgcgtcaacggaaacggaacgatgaactttggccgaagaatactggccccccttgcagttatgtgcaaaccagacgacatccagcacttccatcgatcccgacggacgtgccgaactctcatcattctcgaacagcgtgaccagagcttccttgattttctctgcatcctctgcgctgaaacctgttctttccgccagctgggggctaatgcttccataagttacatatacggcacgtccagagacacgatacttcatgcccatggtgtcggatgattttttaccggaatccgtagtctcgctgttgaccgatttagtgatttgcacatcgtcaattgcgatgggattaatggagaatgccggctgaatcgagaccggtccgcgtacgccaatcgaaacctcatcggtatccttggccttcttaaaggcgaaaacctgaccaaaggaccgcacatcaagccaacgctcgcacaccttaccgaagactacattcttctgcttctgctcatccttcggcaaggtcttcagatatgtattgaacctgtccgacagcgatttggcaccatcatcggaacgatcatcagactgcacaaagactgattctcctgcatcctgcagacggttgcggatcttcctcttcaaggcgacgtcggaaacctcacccagcccttctgacgtcgttctcggacgattaccattcaacggatcaccattgggatttgcgttattcaccgcaaaggcaatcgcaaaatcaatcttattttccaaagctgccataatcacatactccttacttataggcgatgaatcgactctgataattacaaaagtcagttgttgctattatttttttgagaaatctcttgcgctttacgcttagatgctctccgctgacatgaatatcccagaagaaacattggcgaaagcgccttattatcttcaaaatccccttccttaaacaaagccataacatcgtcgacttcattacggaaccaggacccaccgtttgccgatttaaggtatggcgtaagctgcttccacaatgtgccccacgtcgtatagggcttcgccgtgaaattgctcatcaatttgattgcattggttggacggtccttgactccctgcttacgcaagacgctttcctcgaaattgtcggcaagcgccaacaaccttccatacagataatcacgatcatctcgattcggttcaagatacatggttattacgtcctcctgtctatgctgttttcttgtttcatcgatatagtgttttttccataggctgcaagcgatttcaaaatcacgacgccagaccctgatattgtcgtatcccataggcttggtgaccttatgacatgcggcattcaaaatcgacatgggaaattgcgctccgccaaacatacattcaataagccgttccttcacatctttcgcgaagcgtttatagctcttgctgctcctatcagacgtgccacaagcacagttgataatgtcagtgaacgatggagccccttcatactgaacgacattaacccgctcagctccctccacgatgctttttttgaaaaatgtaagaggccaagctgcatcgacatgccattgcagtatgcgcttaatgtattcgtccttctgaagctcgcagtagaacgttacgcctaaacgccccgttgtagcagcatccaagatgacgacaaccatcggatcattgtgcgtcttcagatcctccgcaccctcatatcctctcagaacccttgagaaaatttttgcatactgaacatttgtcgcatttagcgcatcgctgatgtcgtcatgaagcgctttggattcgtcagctattggcgagaggaaatcatcaaaatcaaaagatcctgactgcggattcaatacgggcttttcctcaggtctttttattgcccagacaacgatagcctgattgcctgtcaacgttccatgattattcaccaaccaccgcaaagtggagttgattttctgagaggacgcactatcaaccagcaaagcttgttccttactggaaaaacgtccacgaaaagtaaaattcgtagaatcattagcagacaatagcttggcattggcatcggagctaactacctttttagggaaattagtggttggcgtataaagatcctcgccaaaaacatccttccccagcctgtgttgagaacgctgcagatacgcaatccaacgattccgaatatcaacgtcattcgataaatcagaatcttcgagtccgatttgaacctcgaaacaaacaccggctttatcgtccttatccgttagctccacgccataatgcgcagcagcctcgctgatgctatgctccgacacacacttgaaaacagcttcaagcttggcgtcatcacctttccattttgcaagctgctgcaagtacatgctcgtcttctcaggactgcgcccactatcgacgtactgtaactgatcaaacagcggatgcggtactggcttaatggtccttcccatcgattcctctgtacaaggaatgatgatggtgctctttctcttggcaacacctctgatacaaccattcgcgtccacaagcactgtcagcgaaaccggaagagtcgtatgcccgtacggaatcagcgccctcttcgcagcgtcagcgtcaccatctttctctgcactatgaggagtctgaccagacgccccctgtatcatttcgtaggtagtaagcaaattaccaaacagactcatcgttcactcctcctctactgatgtaacgttcttgcctaagttgaattctttaacgttcaaaccatgcctaacgatgtgccgatcgagaagcggcgaatccggtgattcgaatctgataacgccatccttcataatcggcatccagaagcgcgaaatcagattatggtcaggattctcatccggatacgagaatccatgaaacatatatcccatgttccattctccataagagtcgtagaacccttctccccctccgaattcacacggttcgacataagcttggcattccctagcacccagaaaaatatcgcgacggcctccttgacgcacggacctcatcgcaatgttgtgatgtttgttttcatcacgatcatcagcaagttcctccctcaggtcgttccattcaaaatgcgcaagaacttgatacctcacatcctttaaatatgtgtagtatgaaagatcatttttaacattttttttcttgggctggtacacaatagtgcgaacacctctgctctccgtctgaatcttattcatgactcgcacagcatcaatgacccacttaaacgtgggcttccaatagatgctctccgtaatccccttcaatgcttgatacgttggcacctgatacgagtacttctctccaccaacacgcgtggcgacttccgagaacaatgcgtatctaccccaaacttcatattcgattgaattccgatgccgttccatataactcctttgtaaacggtcttccaaagctattggttaatagcgtaccacaaaaaatttcttatgccatatatagaatctaataggcgtttcgcggcatacgctttatcgactatccttgtgcctgtgggattcccactgtcatcgcgccaagagcgatgtggattgaaaatatatttggcatatgtgttgccccccccaaaaaaaaaactacggctctctcgcatactccttggagcttgcgagagagcactcatccttcctacatcagcaggagaggcatctccgcctcccgtactacgccgtacttgtcgttgtagtattcctcattcagcaagaaaactccaaaatcctcatttgctaacgagattgcatgcttcctggccaaaccacgatagtcatcatcgaacagggaaaccgtatattcctgcaaccgccttagcactgagattttctcgggtaattctcccctgtggagcatatcaagtaactcagtcgcctgaccatacgggaccacaacattgtgcgtgacatccggaattacatggaagttatcgctaaccgtctgaaaagcctgagcaaagcacaaaccgtactttcctcccgtagtattcgtgaattgagatcgatcacattcgttgaaggacaacagatcataagcagtcgtcgctccctccgcccttccccgaattgggcaatccgtatagcctcctttaccattaccgtccttcttacggagaagcatgtcatagtactgttccagaatattcgaagacagcaaatcctttcctgggtagttctccataatctgtaaagtgagctgcttacccattgcgatatccggcagatacctttccatgctgtcttcagctttcaatggatagacatacacattctttggttctaccgattcaccattcctattgcagcgcccagcggcctgcataatactgtccagaccagccatcgccctgaccacgcaagcaaacgaaatgtcaacacctgcctcaataagctgtgtgctcacacaaatcacaggtttcggattgcctggatcaagcagcgcaccgattctgttcagacaatccgttctatgccttccacacatggcagtactgagatgaatcagctcaaactcatgattcacatcaagtcgttccaagcattggaaaatctcacgcgcttcctttttcaggttgacgattgccaagcaattgccgttctcccgcgcctgctgataaataatctgccctagttcatcgcagcttttattttcagttgaagcaacgattcttgtacgtcgaagcttgtcttcatagctttccgtttcagcaataagatcaggcttttccgaaaggagcagattctctcgtttggttttttcaagtaacggctgcgtcgcagagcacaaaagaatcgttgaattggtaatcttcgataggaagctgacgatctcattgaacagattgattgtgttcatcggcaacgactgtatttcatcaaaaatgatgacactgtcggccatattatggaatttccggagtttggttccgcgagcagacatgacagtctcaaggaattccaccatagtggtaacaattatcggattgtcccaacgctctgccgccaacttgcgctgatgctccccggcatcctcaaactcactcgacgcattatccgctacatcagcggaacgttgcatacctgcagtggagtaatgctccaatagaacatcgctatcggcgctcagaccaagtacatctcggaaagtctttgccgtctgagttgtgatagacaaatatggaatcacgtaaatgatccggtgctttcctgtcttcagcgcatgatgcaacgcaaaatttagcgacgccaacgttttaccgccgccagtcggaatcgacaaacgataaatcccggtttcccgcgcccccgccaaacaacactgttcattaatctgatgtcttatcctgtttatttccgaactcgaatcaaaagatctcatgcttttatcgagtcgactaatcagattctgccaatcaaccgcattaggccgatactgttttcgggtctcgaaacaagcagcatccgtcctatccgcatccaccagtcgcgaataaatcagtttaacgagcaaacctagatagaagtatatgctatctttcgacagcctcagcgatttaattttcttcaggaaacaagcgatatcttccgctgaacctcggaaattcgattgcagatcgagcgccaaaccgttaagcccccgcttgatttcttgatacgcatacttctcgttgcttttgtccgactccgtgaacccaagaagaaaagctctattcccggactcgtcaatgcaatcaggaagacctccgtgatgtttagaaatggcaagctcaagaatttcctttgctatctcttcaatttcccctttcgactcgaaaaaatcattgacgacaaacgccccttgacgggcatgctgcacatctcccctatgcccatcatccgataacagatatgtttggaactgctgagcaaccttcccgacatcatgcaagacggctgccgtacgtgaaatatcagcgaattcatcctcgaaaccactagccaatcttcctgtaccatgaagatggtcatacaaagtctgagtattgccttcctcatctttacgagctaatagaaccataacctgctcctttacagataccccctgaatagtctttactctaccgcattccagcaaaagataaaaacgaaatgattgattcgaagattaccgtatgattgattcgaagattatcgtcgccaaatacctgtgcatacgtagtacgccccaacacaaatagcagtagggggtgtgtttctcctgccaaactcgacaggagaaacacacccccacatactatcgtcagtcagccacccagccaaccacctcagaccttagcaacctccacgcccagctcggcgccggcttcgacgcttacactgtcggacgaggtgtcatgcgccacgaggtccttgaactgttcgaccttggccacatcgtccgcgggcacggtcaccttcagcgtgatgcggtcggaaatttccaggccagcggccttacgggcctcctgcacggcgcggatcacgtcgcgggcgtagccttcggccagcaggtcgtcgttcagttcggtgtcgaggatcacgaagccaccggtcggcagcgcggcggacacggagttcgcagcctcctgcgcgttctcctcctccacacggttgatcagctcgtattcgccttcctcaagcgcaatctcgccgttcggagtctcacacacaggcacgccggcggcgtccacatgccaggcaccgctcttggacgccttgatggcgaactgcacgtccttacgcaggcgcttgccggccacacgcgcgttcacgcgcagctcgttcacgatcttcagaccctgggagccggcgtcctccagcgtgcagaactcgatatccttcacgttgagctcgcccttcaacacgtcgctgtaggcggcgaccgcatccgggttctcgaccaccacggtcagcttggcgagcggctggcgcacgcgaatctgcttggccttacgcatggaaagcgtgccggaaacaacctcacgcaccttctccatcgcgtccactagcttggcatcgtcctgcagcacggcacccagctcggtggtctcgccggtcttctcgtcggcaaggaacggccagtcggccagatgcacggattcgccgccagtcaggccgcgccacacggcttcagcctccatcggagccagcggagccagcacgcgcatgaaggtttccagcacggtgtacagcgtgttgaacgcgttctcatcaccggcaccgaaacgttcgcggttgttgcggatgtaccagttggtcagcacgtcgatgaaatcgctcgccgcatcgcacgcgtcggaaatgtagaagttgtccagcgcatgctgggtcttctccactaggcggcgcagacgggccagcaggtagcggtccatctccggcagcttcgccacttcgtcggcacgcagcttgcgcgcgtcgtacccggccgcgttggcgtacagcgtgaagaagtagtaggagctccacaccggcagcatgacctggcgcacggtgtcgcggatgccatcagcggtgacgatcaggttgccgccgcgcaggatcggcgagctcatgaggaaccaacgcatggcgtcggagccgaagtcgttgaacacgccgttcacgtccgggtagttgcgcaggtgcttcgacatcttctgtccgtcggagccgagcacgataccgtggcagatcacgttcttgaacgccggcctgtcgaacagggcggtcgccatgacgtgctgcacgtagaaccagccacgggtctggccgatgtattccacgatgtagtcgcacgggaagtgctgttcgaaggtttccttgttctcgaacgggtaatggtactgggcgaagctcatcgaaccggattcgaaccagcagtccatcacgtcgctgatgcggtgcatgtggctcttgccagtcgggtcgtccgggttgacgcgggtcagctcgtcgatgtacggacggtgcatgttgatattgccgtccttgtcgcgcgggtaatcgccgaaatcggccttcagctcgtcaagcgagccgtacacgtccacgcgcgggtacttcggatcgtcggagacccacaccggaatcggggaaccccagaaacggttgcgggaaatcgaccaatcgcgtgcgttcgccagccacttgccgaactggccgtccttcacgttgttcggaatccagttgatctgctggttgagttcgagcaggcggtccttgatcttggtgacggccacgaaccaggagctcaccggcttgtagatcagcggggtggcgcaacgccagcagtgcgggtaggagtgcacgtagctcttctcctggaagaggatggcgcgctgctcctccggaatgcgggccagcgggccgtcaccggcgcgcaggttgcgcaggatcggcttgttggcgtcgaacacgtacaggccttcgtaatccgggcacagcgacgtgaacttgcagcccgcgtcgagcacgtcgatgctcttgatgcccttggcgttgagcgtgttcatatcgtcttcgccgtacggtgcctggtgcacgaggccggtaccttcaacggtgtcgacgtagtcggcggtgaagatctggtagccttccggccccggcaccttgccttcgacggcgttctcgtcgcccgcgaagtacgggaagaccggatagtagcgccagccttccatttcggcgcccttgagctcgcgcacgatctcgtagttctcgccgagttccttctcgtaggagccgagcagcggcttgccgaggtagaacttcttgccggcgaacttgccttcggtcggacgcacctcgacatagtcgatgtcggcaccgaccacgatggcgaagttggtcggcacggtccacggagtggtggtccagaagacggcgtaggcatcctcctcgtcgcgcagcttcacggccacggacacagtggtgtcctgacgatcctggtacacgtccgcatccatgcgcagctcgtgcgcgctcagcggggtctggtccttcgggcagtacggcagcacgcggtagccctggtatgccagtcccttgtcgtacagctgcttgaaggcccacatcacggactccatgtacgtgatgttcagggtcttgtagccgtgctcgaaatcgacccagcgggcctgacggtgcacgtagtccttccactcgttcgtgtacttgagcacggacgcgcggcaggcgtcgttgaacttgtcgatgcccagttccttgatctggtcgacggagtcgatgcccagttccttctgggcctcaagctcggccggcagaccgtgcgtgtcccagccgaacacgcggttgacgcggtggcccttcatggtctggtaacgcgggatgacgtccttcgcgtaaccggtcagcaggtggccgtagtgcggcaggccgttggcgaacggcgggccgtcgaagaagacgaattcgttctggctgtggtcgccggaaggacggcgttcgatggacttctggaaggtgtcgtccttatcccagtagtcgagcacggactcctccagcttggggaagctggggttcggcgcgacgttggcgctctgctcgccggcagcagccttcggatacacatgattggtggattcgctcaccgtatgctcctcgtttggcggtttcattacttaccttacgaggacgatggcttccgtgcgatcgcgcacgtccggcaccgcggtaccacctcgcttgccgcacttccctgttgttcccacgcaggttgtccgcctgcgcaggtctcgtacgaccgcttgacattcggctgttcgggccgaccccgccggttctactaagcctcgccagaaagcgtcggccgttcttccggaaactccccgctgatgacggatcatcgcttttcgtttcaaatcgtcagcctagcacgccgtacgaacgtagaaacgcgaaaagccgcacggtgtccaccatgcggctttcgtaatcgcaaaacaatcgaaatacaatcggcaggccgaccacgaatcgaccgaagacgatcgcgctcggcggcgaatcagccttcgttcagctgagcctcgagctgcctgacgataccgtcgtgcatcttctcggtgatcttcaccttgagcaggaacacgaccgcgctcaggatgatgaccgcgagcggcacatagaaggcgcagatctcgaagatccggatgttcgcggcggtcatgtcggctgcggtggcgttgccgatcatgccggcggcgatggccacggctccgacgatgccgttcgagcacgcgcccgcgatcttgtcgagcatcggacggacagacagggtgacggcctcgttgcgcttgccgttcttcagctggccgtactcgatggaatcggtcagggaaaggatggccgtcatctggataaaggtctgcggcagatagaagaagacaagaccgacggtgacgaccggcaggctggtggggttgatgatgaacagcagatagccgatgaccataagcaccatgccgccgaggtacaggtagcggcgcggaatgcgcttgttcagaatcgggtacagcggagccataacgatgcccgcgacgacggagacgacgccgacgatggaataggctgcagagttgttcagaatgaacttgaacagatacatgagcacgccggtggtggccacgttggcgatggcgtacagcaggtaggacagggccacccacaacagctggtcgttctgtgcgagagccttgaacgcggcgagcgggccgccgttgtcctcggccttggtgcgcagggtgctggagctttccttggtgccgaacgcgacggagcacacggtgaggacgccgagaatagccacgatgatggcgaagcaggtccagccgctctggctctcctgatgcttgccggtgaagatgtagctgaagtaagtgacgatcggaatgaccacgatggtcaggccgttgtagccgatggagccgccgaaggaaccgagggcggtgtaggtggagcgctcatgggagtcggaggacagcgccgggatcatgccccaataggagatgtcgcgcagggagtagaacacgtcgagcacgatgaaggtgatgacgaacagcacgatgaacagcgtggtgttgacgttcaccaagccgaacaggccggtgtagaccagcacgagcagaacggcggaaacggtgccgccgatgagctgccacggcttgaagcgcccccatttggtattggtgttgtcgacgatgttgcccagcagcggatcgatgaagatctccgcgatgcggatgacaaccacaaggccggtgatgacgccgatgagcttggtggcgagcgccttgtcgaccccggagaacagcgagctggtgacgtagacgatgaagtaggtgctcagcgcgttgtagaaggcggattggccgacgttgccgaacgaataggccacgcgggacagcagactgcctttcctggttggcttcgcagactgctgcgtctccttcggtgcggctgcgacattggattctgccatcgtacttctccttagaagttgtgattgaagctgtaatcggaaatcatcatttaatttcgcatgagttaagtatatccctttacccctgtttagtaaaatttaacatctgcgttgtgcactgttgggcgtgtcgcattttgtgcgattctgcacatatacatatcatattgtgtgcgattcgcggtatttcgccgacagtagacaaacaaaaggcgattgatgacgcagcatcatcaatcgcctttcatatttttccgcacatacgtacgctaggcagcccgtttcgaccgggcagatcgcttcgatcgggtctgcaattttggccgcgattcacgtttcggctgcgccggcacgaaactatctcgcacttccagcgtcgtcgacaggtacgcatgctgccgtactgtgcgcttgctggcaatcgcatcggccaaggtgagaatcgcaacgcgcgcaagctcgttctggtcgattgagaacgtgctcaacggtggcgacgtaagctgtgcgatcgcctggttgttgatgctgatgacgctgatgtcgcggggcacgatcacaccaaccgcgttgaacgcctgcagcacgccgaccgcgatgatgtccgccgaaacaataactgcgtcaggcagtgcgccgttgtggtcacggataaactgctcccccagcttgcgaccattctccacggtgaacaagccgtcagaatacaccagtccacgcaggtcgagaccataacggcccatttcacgccgaaaatatgtggcacgcccctcttcgtccacctcataaaaattcgtcagcctccccttgccgccgatgaatccgacacgcttcatgccagccttcgcacatgcttcgaccgcgtcatgcatggtctgctgtaggtcgggctgcacggaatcaaacaggttcggtgcgggattcacatcgatgaacacaccgtatggcatgacctcatgcaacttctcaaggtcgctttcggctatgacattggcgccgatagccatgaaaccatcgaatttccccttctgattcaacatctcgtcaagactgtggaaaacagtgagctccatacgctgctgtttggcgttatgttccagcgccgaacgcaaatcggcaaaatacgaatcacgcagcgtttcgtcggactcctcgttgtccaacaaggctacttcatgcggaatgacgatacgcttggcctgggcgctgtatcccaaatcctcgctggcgcggatgatcgcgcgacgcgtctcctcacgcacggacagcgtcggatcgccattcaacagacgcgacaccgtggcctgcgagaatcccgtacgtttcgcaatctccttgatggtcgccatcgctccctcgccctcccatggatgcctcatcagattttagtaaaagcattactaaatccatcatactacattaccgaacgtattcttatagccatgacacagccagagcaatcacggaaaccgcgaatcgcgcatcagtccacggaacggatgaacgaactgcgtgcacaacaaaaatcctttgccctgcagaacatgcggagcaaaggactcggcaacgccggtctgcctttcaaagcgaccggtcataaaggtggcatcagtcggcagggttccaaacgcggctgacaccgtggagaaacgcggtcaccgtcagccccacgggcctgcggctggaagcgcccgcccttctgcgtggccgacttgccatgtgagccacccctcgatgacgccacgctccgcatcggttctaccggacgcgtatacatcaggcctctccccggtgatgccgcggatagaaccatgcacatatccacatttttcacggagacggttgcggggctgccggctttccatataccgtcagcgcatggaaagctttggacacaatacatttttcacattagagcaggcacgggaggaggcggcgagacggcatcttgaatgcaggcaggtgttgtcgcggataaggtcacgctcctcggttccactctatgtaagccacggcacagcgctggagctgcatggcatgatcgccaccatgaattatttacccggatatggttcggagctcgttcacgtttcggtgtgccggcaacgcgacttacggaaaatacagggaatgaaattccattacgcaagacatggcatagacggggtgcacgccgacgaattagtgtcaagcgtctccgcgatgcaagcagtctgtcagattgcgccctatgtcgacgaacgaagtctggtgatcgccatggattggctcacttgcgccaatcccgatttacgcgtctgcactcacgatgagctctccgactacatccggagtgcgccgcgattcattgggagcgccaaatgcagaaaggccttgcgcctgtccaaaccaggtaccgattccccgcaggaaacggtgcttcgtttggagagcgatgcctacgggctgcctgaggcacatgtcaactatgagatcattgaccacatacgcggctcgggcacgatgaaggtggatatcgcctacccggatgaccgcgtctgcatagaatacgacggaaattaccactacacccacggccgctggatgtatgacctcgataagcggaaccgactgagggatctcggtttcactccttttgtcgccacccgcgagcatctggcttccaagcagaagctgaacgagctgttcggcatggtcgcccgagcgatagccagtcaccgttacggcttggactagttccgtaggtggtttttcgcttccgtaggtggttggtcagagtatcggggttggagaaaggctttattctggccgttttcatgccgggtattcagacccaaccacctacggaacacccaaaccgcctacggaaccgcatgagtagtccccgcaatggatttttcgccattgattcggggaatccatgaaaagccacagcgggcgcaccctgcgtaaaaggtcatgcccgccgattcatgggagccatatgcgcaagggccgtgcggaagccacatatgtggcttccgcacggcccttgcattcgttgaacactaccgttcagcctgtccaattcaccaagaacgggacaggaacgaagcagaaggagccttactccagttccacggcgcccgtgtacagctggtagtactcgcccttctgcgcgatgagctcgtcatgcgaaccgcgctcgatgatgcggccatggtcgagcaccatgatcacgtcggagttgcgcacggtggacaggcggtgcgcgatcacgaacacggtacggcccttcatgagattgtccataccggcctgcaccacttcctcagtacgggtgtcgatggacgaggtggcctcatcaaggatcatggccggcgggtctgccactgcggcgcgtgcgatggagatcagctggcgctggccttgggacagaccggagccgtcgccttcgagcacggtctggtagccgttgggcagcatgcggatgaagctgtccgcgttggtgagcttagcggcggcgatgcactcctcgtcggtggcgtcgagcttgccatagcggatgttgtccatcacggtgccggtgaacagattcacgtcctgcagcacgatgccgagcgacttgcgcaggtcgggcttgcggatgcccttgacggagatgccgtcatacagaatcataccttcctggatgtcgtagaaacggttgatcaggttggtcaccgtggtcttgccggcaccggtggcgccgacgagcgcgaccttctggccgggcttggcgaaccaggtgatgtcgtgcagcacgggcttgtccgggttgtagccgaaggtcacgtcggtgaaacgcacgtcgccctgcagcagggtcaggcgcccgtccggcgaggtgatcgcgttctcgcgcgccttcctcgccacttccgcggccttcgggctcagcgactgcgcggccttcagggaacggctgccgtcgtcgccttcctcacgcttccaggcccaatggccggtttcgtggtccacttcggtcatggtgcggccgtcttcgccgagctcgacgttgacgagtgtgacggagccgccgtcgtcctcgggcttctcatccatcagctggaagatgcgggacgcgccggcgagcgccatcatcaccatgttgaactgcatggagacctggccgagcgggttgacgaaggagcgagacagtgtcagcagggagatgagggcgccgagggtgagcttgcccgcgccggcgagaccgaagttgcccatgccggagagcgccatgaatccgccgacgatggcgagcaggatgtagaggatgtaacccatgttgcctacgacgggcatggtcacgttgccccaggtgttcgcttcggcggaggccttgtacagttcctcgttcttctcgtcgaaggtcttctgggtggcgtcctcatgattgaagaccttgatgaccttctgaccgttgacggattcctcgacaaaggcgttcacgtcgccgatccacatctgctgcttgacgaagtagcggccggagcgggagacgatggcgcgcacgaccacgaacaggatcgcggcgaacacgagtacgaagatcgtgaccggcaccgacagccacagcatggagaccagtgcggccagtgcggagatcgcggaggagaacatctgcgggaaggactggctgatggcctggcgcagggtgtcggtgtcgttggtgtaacggctcatgatgtcgccgtgctcgttggtgtcgaagtagcggactggcagggtctgctggtgggcgaacatgtcgtcgcggatcttcttcagcgtgccttgttcgacggtgacgatgagccactgccacaaccagctgcagaacgtgccagccgcatacagacagcccatcagcgtcagcgcgcgcaacagcggtccccaatcaggatccgttgcgccgaccatcggcaggatgtagctgtcgatcagcgattgcagaaacagagcggagccggcttgggcggccgcgccgaccagaatgcataccacgattgcgatgacatgccatttgtattggaagatgtagtcgaagatacgtttggtggtgccgggagcggctttctgcattggcggcttagcgcccggcttcacgtccggattcatatccggcttggattgcatggtttttccagtgttcttttcagcggttttcccagtcatgtccatccctcctttcacttcagcccctcaggctgtgcctggtttttggtttgagattcgtagatggatctatattcgtcgcaggttgcgagcagttcgtcgtgcgtgccggcggccatgattcggccgtcttccatgacaaggatcatgtcggattcctgcacggatgcgatgcgttgcgcgatgatgattttcgtggtgtcgggaatctcgttgtggaacgcttcgcggatcagcttgtccgtcttggtgtcgaccgcggaggtggagtcatcgaggatgaggatcttcggtttcttcagcaacgctcgagcgatgcacagacgctggcgttgtccaccggacacgttggttccgccttgttcgatataggtgtcgtatttgtcggggaattcctggatgaaaccgtcagcctgggccagttggcatgcgcggcggatttcctcgtcggtggcgttcgggttgccccagcgcaggttgtccgcaatggtgccggagaacagcacgttcttctgtaaaaccatggccacttggtcgcgcaggatttccagatcgtacttgcgcacatccacaccgccgactttaagcgaaccgtcggtcacatcgtacagtcgcggcacgagctgcacgagactggacttggccgagccagtgccgccgacaatgccaacggtcatgccggaacgaatcttgagggtgatgtcgtccagcaccggtttttcggaattgtcggaatagcggaaggtgacatggtcgaaatcgatcgaaccgtcggcaaccgtcttgactggttcggcggggttggtgacggtgctttcctcgttgagcacctggcagatacgttccgcggaagcctgcgaaatgatgcacatgacgaagatcatggacagcatcatcatagccatgaggatctgcatggcgtatgtgaccaatgccgtcagatcgccggtggtcaatcccaatgcggcgttgttgccggacgagacgatctgccgcgcgcccatccaagcaatcagaatcatcgaaacgtacacacagaccatcatgagcggaccgttgaagctcatcacacggtcggccttgctgaaatccttgtagatgcgctgcgaaatacggccgaacttcgcgatctcatgggattcgcgggtataggacttcaccacacggatgccctgcagattctcgtccaccacattgttgagcttgtcatacgcgtggaacacacgctcgaacaccggatgcacgtacaccgccagaccacacagaccgaaagcgagaacagggatgcacgccaggaacaccaaggaaatggacgggctgatgcggaacgagaagatccacgccacgatcatcatgatcggggctcgcacacccagacgaatgatcatggaataggcgttctgcaggttggtcacatcggtggtgagcctggtgatgatcgagccggtggagaacttgtcaatattggtgaagctgaagccctgcaccttctcgaattcgtcatgacgcaggttcttggcgaatccagcgccggcgatcgcggcgaatttaccggcaaggaagccagccgcgagcgaacatagcgagcacgccagaagaatcagaccgaatttgacgatggcgggcatgcttttgccggtgatgccttcatcaatcaacgacgccatcaccgtggggatgaggatttccagaacaccttcgaccaccacaaatatcggggtgagaatgctgggcttcctatattcacgcagcgatttgccaagcgtgcgtacgagatgccgcttttgttttggctgcgattgcaccgcagccgttgtcacgtttgttccgctcacttactcttcctttcctgtttcgtcttcctgtgatgttttccgtacagttggttgcgattcgcattcccgcgattgccgttcccacgattccgcctcgcacaatgccaggctggaatagcgactttcgtcaccgatcagcccagtggagaccagattggtctgcatcacgtcgagcacgtgcatgaattcgcggatctcgtcatcgctcaaaccctgaagaagaatgccttccatagcgatggcgttggctcgcagcgcctcggctatatcgcgcgatttgtcagtgagcacgattttcttcaaccgcgcgtccctcggcacggattcgcgcacgataagccctttgcgttccatcaatgcgagcaccctgctcgacgtcgaccgggtgatgccgaagcggcgttccacatcctgcgggaagatctcccgttccgaatggcgcgcgaggaaggtgatgatgtcgatgttgccaccgctcagactctccacttccataggacgcgtcaccgtaagataccggttgatgacgttgtgcagcgatcggatggcgacgcttggaggcttgcatgcgccccgctcccatgcttcggcgaacgcggggttcaccgaagccgttccatcgttctgtatatcgttcacggaacataagataacacgttgtacatgcaacagttgcatatgcaacattcagcgtgtcgtgtgtgacggaaccggatcgcagcacaccgagcgcaatattgtaatcgcaaaatcgcttaaaaatagccaaaaataagctcggaacaagccgaaaccaagtatgaaaaagccgaggatgtggtccgcaccggttcattcgcgggccacatcctcggtctaaatccttgaaactccttttgcttacgtcttgtttacgtcaatccgtcttattcggcggtttcggcgattttggcgtattcgtcgagcatgaaggcggtgatggccttgccgccgtcgctcatcagcatcggcatggagttgatcggcatggacttgaggaacatgcgcatcatgtcgttgtcgggcagctgcggcagattgccggcctcgccttccgcatacacggatgcgacgattttggagccgaccggatcgtcggcccattcgccgaacgtggaccattcgtcgagcggcagggccttgccgtcgccgtcgagcgtgacgacggccacggcggcgatgtcgcggctggacgtgccgacttcgacggtgtattcgccggcttcgacatgccagtcgttgaacttctcggaccagtaggcgaaggcgcgctcgtccagatcgaaggtaatctcagccgattcgccggccttgaggaacacctttcggaagcccttgagctcatgcttcgggcgggctacggcggccttgcctggagctacgtagacctgcacggtttcggcggcgtccacgtcggacgtgttggtgacggtcgcggtgacgtgtgcggtgttggcgccggtcttggcgacgttcacgccgtcgatcgcaaaggtcgcgtagctcaggccgaagccgaacgggtagtcgacggccttgtcgtacgtgtcgtagtagcggtagccgacgaacacgccctcaccatagtcgacgtgcccctcctcacccggccagttgatcatgctcggatcgtcgttgatgttcatcggaatggtctgtgccagcttgccggacgggctgaccttgccgaagatcacgtcggcgagcgccggaccgcccgcctggccaagcagccaggattcgaggatgcccttggcgttgcccgcccatggtgccacggagacgacggatccgttggacagcaccacgacgatgttcttgttttcggcggcgacggctttgagcagttcgacctgcttggctggaatgtcgagggtttcacggtcgaagccttcggattcggcggcttccggaaggccgaggaacatgaggacgacgtcggcgtttttggcggtttcgacggcttcggcttcgagcgtgcgatcggccggttcgaggtcgagggtgaagcccggtgcgaacgcgacgtcgacgccccgcgcggcgagggtgtcgaggaagctggtcatcttggtcggggtgatgtgggacgaaccgccgccctggtagcgcggagtgcgggcgaattcgccgatgacggcgattttcgcgtttgcagcgaccggcaggatgtcgtcgtcgtttttgagcagcaccatggattcgatggcggcctgatgggccacctcgtcgtgggcgtccacgtcgaaatggtaatcgtcgatgctcatggcggagcgcgtcttgttcacgaggtcgaccatgccttgggccatgcggtcgagctgttcgggctggatgcggccgtcacgtgcggcgtagacgatctggtcgtccgtgtagctcggcggcatttcaaggttgaggccggcgttgagggaggcgacgcggtcgtggtcggcgccccaatcgctcatgacgatgccttcatacccccattcgtcgcggagcacgtcggtgagcagccagcggttttgtgcggaatgcacgccgttgatgcggttgtaggagcacatgatggtccatggctgggcggttttgacgatgtgctcgaaggccgggaagtagatctcgcgcagcgcccgctgggagatgttggcggatacgcgcagacggtcggtctcctggttgttggcggcgaagtgcttgagcgaggtgcccacgcccttggactgcacgccggcgacgatgccgactgcctcatggccggccagatacgggtcttcggaccaatattcgaagcagcggccgccgagcggattgcgcttgatgttgacgccgggaccgaggatgacggcgaccttctcctggatgcattcctccgccatggcctcgccgacctggtggatgagttccggattccacgagctggacaggcccgcggccggcgggaagcaggtggcgggcacggagttgttcagatcgacttcgccggtggtggccgagttggacttgcgcagaccgtggggtccgtcggtgatcatatagccgggaatgcccttggcttcaacgccctgcagatgccaagcgtcgccgccggaagttagggatgctttctcttcaagcgtcaggtcattgacggaaggataggtgttttcgctcatacgttcctctttcgcatcgttttcttgagttcgtatcggttaaccggcttgtggaatctcaaccccgaaatctttactaaccggtcggtaggtactttatcaaaatcaacatcgcaacacgccaatcttctttgaaaaatcagttaaccgaccgtaaagtaactgcaagtatttaccacttgagagaaatggcgattcataagcattgcagcgcacatgaatcgccattcatggaaggcaggagagggaatcatcatggccaacgaagaagtcgaccgaagagcggagattctcaatgcggccgtcgaactgtttggaatgctcggctattacggcacttccctgcagaaaatcgccgatcgcgtaggactcaccaaggctggcgtgctgcattatgtcggcagtaaggaaggactgctcacagccgcgctggacgaagtctacgattccgaaacggaagatattcttaccgacatagtacgtgagccacgcccgttgatcgccgacatgtggcgcagaatcgtggcggtgaacgcacgcagaccgattcaggtgcacatgttttccacgttgagcgccgaagcgatcgacccgaaccaccccgcacacgagtacttcgccaaccgtgagctgcataatgccgacaccgcactcaacatccgttggcaagtgcccgaaggtgttgatacgcgtcggctgcttaatgcgggattcgccatgatggatggcgtgcagctgcgttggctgcgcacgcccggtcaggatctgaacgccatgtgggcggaatgcgaagacgccctgttccccctgcccatgtgggaggactaccgctaagcctctgccccggcactgcattaatgtatggatgcagacgtaaaaggagacatgtatgcggattctgctggcaccggactcgttcaaggaagccgcttcggctgaagcaatcgcacaggcgatggctcgcggcattaagcgtggcaatccgcaggcggaatgccggctcatgcctctttccgatggcggcgaaggattgacgcaagccttggttcatgccaccgccggcacgttgcacaatgttgagacagttgatgcgatcggccgcccgattaccgctcagtttggctttcttggcaataatcatgcttcttgtattctccacaccgccgtagtcgagttggcttcggcaagcggacttgaacgggtctcccccgccgaccgcaatgcgttgtccgcttccacgttcggcaccggcttgctgattcgtgctgcgattgacgctggcgcggatcgtattgtgcttggtttgggcggcagtgccactacggatggcggcacgggattggctcgcgcgcttggatttcgttttcttgatacggcaggtcatgatattccgcttggtggcggttctcttgttgatttggagaggattgacgattcggaagttcccgattttgtaaaaaatgttccgattgttctcgcctgcgatgtcgccaatcctttgaccggaccagaaggtactgcgcatgtgttcgctccgcaaaaaggcgcgaacacagcacaggtcgaactcctcgatcagggactcgcgaatctcgcacacgcgatcatgcaatacaatggccgcgatattgagcgcattcccggtacaggcgccgcgggcggtaccggcggcgggatgctcggcctgttcaatacaacagtgcggccgggaatcgaacttgtgctcgatcttgcgcatggtcgagaagcatgcgcatgggccgacgtcatcatcaccggcgaaggttccatcgacagtcagacaccgtacggcaaagtgccgaatggcattgcgaaactggcgcaatcgcaaggaaaaccaactattgccattggcggaacggtaacccgcgatccacacaccatcgaagcgttgaacgagaccggcatcgtcgcaacgttcggcattgcgcccgggtcggcggatcttgcgacgctgatcgccaatacggaacgcaatgtcgagattacgtgtgccgcaatcgccggcacactgcgcgttgcttcggctactgcagtagctgcagctacttcaccttgcgaatcagcatgatgaacaccgtgcccagcagcaccgcaaccacagcgatcgggaacaaagccgtataaccgccagtggcaagcacaatcgcgacggcaagctgctgtatggcgttcatcaccgcggaacagtcggcgttcattgacgatggcaactggttcaacgcatgcgtctgatcaggcaccagtacgaatccggaagcggccataaacagtgcgtatgccacaacgatgacccattcatgtgagccgcccacgatcggcatttcgtaggcggctcatatcagactagcgtgtcgattattaggttctgcgacacggcttatttcgtttcgcttttacgcgacggtgaaggtggtgcgcttcaagtgttcgcgacggctggaatgaccgataagcacttcgaattcgcccggttcgacgatccggttagcttccgaatcgacgatggtgcaatcggaaaccggaatgtcgaaggcaacggtcttacttttgcctggttcgagttccacgcgctggaatgctttaagttcacgatcagtccagctgtaggaggtcacgatgtcgccgatgtagagctgtactacttccgtgcccttgcgatcgcccgtattggtgagggtgatttcggcatgcacagtgtcggtttcggcgaatatgccggattccggaacgttggtgatggtcggatctccgtattcgaacgtggtgtagctcagaccctcgccgaatgcgaatgccggattctgcgtgaggtcggcgtaacggttgccgtgctggcctcgaatctggttgtagtagaccggcagctgtcctgcgtgacgcgggaaggtgatcggcaggcgtccgctcggttcggtttcgccgagaatgatttcggcgatggcctggccgcccttcatgcccgggcttggagcccacagcagagccgaagtgccttcggctggagtttcgtcaacaatcacgccattggtaccgatcacggatgccggcagcacttgcggcttggagctgacgagcaccaccacgaacggcttgccggtttcgcgagccacgttcgacagtgcatcgatcagtgcattctgtccgccgagcagttcaagcgtggcggtggagcagccttcgccaatggcctggatcacatcgcccaccacggccacgatcaggtcgcttttacgtgcgttttccacggcttcgccaagcagtgcgcgatcaatcttggcggaaacgccgatcttcgggcgaggctgtccatccgggtagaactcgccttccggatcgggcaccaaatccacgatgttggcaccgcgagagtacacgacctcgcaaccttccggagcgagctgcttgaaaccatcaagcacggtggtgatcatttcacgcgggtggccgtcaggcatccagttgatctggccggagctgcctgcccagtcgcccagctgggtctggacgtcatcggcgagcgggccaacgaccgcgatacgcttcgcaccggccacgttgaacggcagtgaaccgtcgttcttcagcaatgccacggcttcgcgagccacttcaaggttgagctgctgatgctcttcggaaccgatcactgcatcgatacgcttctggtcgggcaagcgtggatcttcgaacagtccaagacggaacttcagtgcgagaatacgagccacggcggcatcgatcaacgattcgtcaagcagaccggtcttcacggcttcgatcgcaccctcgtagaactttggcgtggtcatcaccaagtcgttgccggacttgaccgcatcggcagcagcctgcacataatcaggcttgaccttctgctcccacacggaacggccgacgttgtcccagtcggtgatgagcgtgccctgatagttccaagcgccacgcagtttgtcggaaagcagccacttgttgaaggtgaccggcacaccttcgatggattcgtagccgagcatgaaggtgccacagccttccttggctacgcgttcgaatggcggcaggaaccaggattccagcttgcggtggctcaggtcggcttcggaagcgtcacgccctccctgtgtttcggaatagcctgcgaaatgcttggcgcatgcgaggatcgcgtctttggcgagcggctcgcccgccttggctccaccttgatagcccttgacaatggacgatgccatttcgccaatcaggtacggatcttcgccaaaggtttcgcctacgcggccccaacgggtgtctcgcgcgatgcacagcaccggggagaacgtccaatgcacgccggtggctgacacttcctcggcggtggcacggcccgcggcctgtaccttttcggaatcccacgtggttgccatgcccagctgttccgggaaaatggtggctcccggccagaaggaatagccgtgaatgcagtcgtcgccgatcaccagcggaatgccgagacgggttttggcgttcaccgtttccacggctttcggcagatcggacggcgaggtgtgcagaatggaaccaacgtgcttgttgacgatcagatcgtccaaatcgccgcttcgcgcgtcaagctgcatcatctgtccgactttttcctcaagggtcattcgaccaagcagatcggcgatgcgttcctcagtaggaagtttcggattcctatagggcagatttacagtattttcagtggtttcggtcatggattgctcactttcctcattgaagcgatttcctttaattaccaattggtattttagtatatcatatgcacatccgcaactcgacataaacccgtcaacgcaaaaggcgagggaccatcagaccctcgccttttcgcacgcgcatgcaatgccaatctcaacaagtattcaaaatcaacgatatgcatcccacaacggggatggaaacagcatgttttccatctgagcccactctttgcataaatcaacttcaggctcgcgcaaccaccataattgcacaccatccatgatttccatggccttacgcaccaccggtcgtatactcgacttccatgaacccaattgcggaggaatcagccaaggatattgcgaatagttctcccaaatatcgtccatacgagcagtgaattcatcatgcaacggatgttcaggattcaacgattccgcagaaagcacggtaaactttgaaacagacacccccaagtatgccaaaaccaagcgtcactatatgtggacgcagcaatgaacaattcccctatgacaactagcatggggagacattatttgtaaagcataaaagaaggtccattcaaatggagaagccgaacgatattaaaagagactccatatcagtgaattactttttgaatactgctgcgtacagcggtctcttctcccttctttcggttattctcaccggccaagtttctgcggcgtcatcgctatatgttgggctggcgctcggaattttatctcttttttctagaggcagtactgtttttataggtagcctgattgagcgtttctcaacggtatccctcaccgaggccggtttcggattcatggttttttcacttttgctgctacaaccggcaatgggtggttttatcggcttcctttttgcggatttggctttgctgggactcggtctttcattggttaattttgccctacgagggcatatcatcgctacagtaaaggataaaaaaattcaggcttctttgtttgctttagtgactatggcagccaatcttggatccgcgattggacctctgggctcgaattacatatataaagctttcggacaaacgctctttattgcaatcatcgtcggactctatgctttttctgctttactagctccaatagcgctgactcatcatgtcttcatacgcaatgagaaaagcggcgaggaaaacacttcctccatcgtgaagaccattacagactcgctgaaaagtcccggtacggttcttgccatcctggcggtgttcgtgggcagtataatgaatggtcagctttttgccggaatggcattggaattccactcgttatccgatagtccagtcataagaggattgttctattccattgatgccatatcggtcatagcactgcaaatgccggtaagtaagatcatctcgcgcaatatgaccaaagaacataatgccacctcattcatagtcaaaagcctggggatttatggaatttccttcgcactattcgcctgcggagtctcgtcgtactggtggatatgcatcatttccttggttgtgttctccattgcagaatgcatctatgcgccattaatcaatattgctctggtagaggcacagccagataagcctttggtggacattctgaactatcggctgataattgcagccattggtgaatcggcaggctcattccttggcggttggatcgttccggcactacgtcctgcaggattgacggcttggtattggtgtgcactggcgttagtgggaataatgcctgcagtcgtcactaatcaaattagaaaacgtggacaaagaatcattcgtcattgaaagaaaaagtcttggtgagtacaccggaaggggaatgacatgaaagtattattgctgcaacagcccaaatctttctcaaattatcctaaatggattgaggaaatccaagaacgtttcgattgtttagaagttatggtcttcacctcgaacgatcgagccgcacaccatagttggccgagctccgtcatcaaggaaatcgaggtttccgattattcctctgatagcgctaccgcaaaattctttgatattgtcaggaaatttaaaccagataggatagtttccagctcagaggaagacgtactgagggttgcagaggcgagaagtttatttggaattcccggtttacagcatgaactggcgttaagctgtcgagataaagtcacgatgaaacaatcggcccttgatgccggattaaagattattccctataccacctgccaaggctttggagatattatttcggcgttcgatcgttgggagacggttgttctcaaacctcgatggggcgcagggtctgcaggcattacgatattgcattcgaaagatgacctgcctgctttagctaccaagccggaattcatacgaaacgtgcattcaaaccagtattacttagaggaatattgttccggttccgtctaccatgtggatgtagtctatatcaattccggttcgattctgatctcaccatcacggtaccttgtcccgccactggatttcgagaaacaaaacaccggttccgtgatgttggatgagaacggtgccgactattccgagctgctccgactgacaaagcaattaattgcatctttcaacgatcagacgattccgaatgtgatgcatatcgaattctataagaatgaaaccggtgatttcgtattcggggaaatggcggcacgcagaggaggcggtctcatcaagcaggagctggcagccgcctatggcatagaccaaagcaaggccaacttcctattggaacttggtcttgtcgatgcggatgcgaatattacgcgatcatctcagtatggcatactgctggaaaccgctggattgaactggccaaaggaaaaagaaatcccggattgggcggttttggaatctgtgggcaagaaaaaaggtatcgctcataactctgttgattctgacaggaaatttcttatttccggcaagaatgaatctgagattattcaacgttctaattatcttataaatagtcaatataatgagtaaaattaactttttacagagggacaattgtaactaattctgcagcaggttctatatatgacgaattattatgtagaattggtaattctactgaatctagactcttccgtaaaataatgatactagtatcgctagggatgttgggaaccagcattggcgtctatacgggaagcgcagcaggtagtctgactgcatcaaaatggtcgacatctcaagaaaccagcatgtctctttcagcaaacttttcaggcactaccacaatagaagataagcaaaatgagggtggccgtcaggtcacccccgaacgtatgcggaacacacataaaatcagcggcatgcatcccagaggggcgcgggaaacagcagattctccatttcggaccattcctcacacaagtccacttccggttcgcgcagccaccacagctgaatgccatccatgatttccatggctttgcgcaccactggccgcatgctgccggcccatgcgcccaattgcggcggaaccacccacgggtatttcgagtagtgttcccagatgtcctccatgcgtcccatgaattcgtcatgcaatgggtgatccgggttcagggattccaccgacagcacggtgaacagctgcaccatcatgcggcggcgcgagttgtgtttcaccaggtagcgcagatacgcgggaaaatgcggcgcggacgggtcgctgcccggcatgcccgaagagaagaagtcctccggcgtgccggtctgcccgtagtattcgtcatataccagcgccagcattttgtctttgttgtcgacgtatcgcaacacgccttgtttggagatgccgaccctgtcggccacgtcttggatggaaatgccattgaatccacgctcactgatcagctgaacagccgcatccagcacttccgctcgacgctcctgcggtgattttcggatacgtttcgaagtctcttcctctgccatgattccgagtctaatgcaccttgcgtcgattgccgttgattgactgcctatggcacgtcatcgtgagaggtatccgcccgaatccatccatgacgccatacgcgagtcagatcccacgcctcaagattgccgccgttgcgaggatcccgcggcggtttcccttcgccactacccggtttcgcggagcgcgcaagctggtagctccaatagatctgccccgccgacacgtcccatgccgcgcgttgcaatcgtgacacttggcggtatgcagccgatcggttttggctgtgtagggcccactgattctccacgcaccactcgcccaccagcacgggaatacgacgggccgccgaacggatggcgatgccactcgcgcccaccagcatccggtacagccatggcagtcgccgcgatcgcaggtacagccggcgtgccggtcccgaaaacagcggatcctccatcgcgatgagatactgatgggtgtcgagcatgacgttgcgcatgccagcacgacgaaaccaaccgccccagcggagtagtcggaaaccgtcatggaatacgatcacggtttccggacgtagcacggcgcgtaaccgggcgtaagcgtcgcggtagaagcgcttcagaaaccgcagtgagacatacatgctaccggaagcctcatgagagtctttcgccgtgttcgacgtgctatggaacaccgaccagctcactggttcgttgagtacttcgatgctgtgcagggccggttcgtcgcggtatcggcgagccaatcgctccagcacgttcagcgtgtactccaccaagtccgtattctgcgcccatttgcacacacccgtcagaccgccgttgtcgaaaccgttctgcgattcgggaacggtatgcaggtcaatcataatcttcaatcccgtctcccgcgcccagcggaacgcgcggtcgaggtacgtgatgcagcccggatgcccgggccagtcgccgaagatgaaatacggtatgggaatgcgtacgaggttgattccgtgaccgacgataatacggaaatcctccaaggtgatgtaggtttcgcggtgccggcgcagttcctcggcgagattccgttcggaccagagggatacgtgcgtgcggtgcatccagatttcatcgtcttcggcgctgcgggtgaacggtttcggatccatccatttctccagcaccagccagttgccgaggttcacgccgtcgattcgctcgtcgatgcctagcaccatgcgtctcaccgcccttacgttcgggggttgcccgacttttcgcttccgcccatcacaacccatggcaaaacccattcggcccaatgggccaaggaaccgcgcgtcattcgcaacgttccttggtccattgtatgcgccccgcgagcggccacgcggccgctcggaatcggatcacagccggatcagggtcgttgaatgatcgtggtggccggccgggcgggatcagtcgacgggcttcgtctcgtccgcctcgtagtcgaagaagtcgaagtcggcggtcttctcgtgcagagcggcgtcggtgatggcgatgccgaccatagtgccggtgaattcgccgtacttgcagtattcgtcagagaaggtggtagtgtcgaaatccgggccaatcttggtccagttctcgccatcataaccccactcgaaccaagtacgacgaccttcgatattcaaacggaaatagatcggcttgtcttccacagcaacgcgagtgtcaagcatttccgtcttttcaccgttttcgagacgcacaatcgaaatcgcgctgccgccaagcgtctgtgaataatacttgcgcaggaaaatattattcatgttgtcgtagtagatggtcaagccagcgctgtgctggtagacttccggctcgaactccatcttcgtggtgacggtggcgtacacgctggtgagtttgcgtgcgatcaggctcgtgcggttgagcgatgccaacgattcctcgccgcggatgcgcagccaaccggggcgttccgtcacgttggcgaaggtggtcggcatctgccgcggcgaataataccagttgccgatcgcgccgccgtcgaagtcgtcgtgcccgggaatctccggcatcggcgcatccggcagatccggctcttcgacttcgagtttggccagattggagccgtccgccatgcgcagccagccgtcattcgtccatgtcatcttctgaatggcggtttcacggccaagcgtacaacgtaattccggcacaaacggacggctggtcaggtgcacaagatatgtctcgccgttcggcagatccacgtaggagccgtgcccggacttctgcagcacggaatccgggttgaaatagcgcggcttcaaatgatcgtcatcagcacgctcgtttgactccttcggctgcgaagtgacgagcggaccattcggatccggctcatacggaccccacacattgcgggaacggcccatggtcacggcatggttgtagccagtgccaccctcggcgcacataatgtaataccagccgtcacgcttggtcagatgcggagcctcaatgcagccacgatcagtagcgccacgccatatacgcttcggatagccaaccacatgcttggtttccggatcatattccacacagcagatcacgcccggcttctcatagccttcacgggtctcccactccaagctgacgatgtacttcttgccattgtcatcatgtaaaatggacgcgtcgaaaccagaagatgtcagatataccggctcgctccacggaccttcaatgctctttgacttaatcagataattattcacgtcgaaatagcgtgcattcatggagttcataacgccgtaaatcacgtaaaacatgtcctcttcctcacaatacgtgagacatggagcccaaatgcccttagcgctcggcagcttggtgaggttcggcttcgtatcatcagtaagcacgtgggtgagcagctcccaatgcttcatatccttcgaatggtaaatcggaatacccgggaaccattcgaatgtagagacagcaacatagtagtcgtcgcctttacggcagatggccggatcaggattgaagcctttgaagatcggattatgcagcattgtcgttccttaatgttcttgatatcacgcgttgctttgtacgattcttgcgtccgacggaatcacttttggacggggaaccagttttgggcgatgcagcgtccaaggtcccatgcgtcccagccgatccagccgggagtgttgacagtgtcagtgagcagcttgtagttccagtagtagaagccgctgcccttgctccatgcggcgagctgggattcggctaggccccggtacagcgagcgcttctgttcggcggtcagggtttcgacctgagccccttcctcgccgttgagcacgctttggccgccgtgggtgtccacaccgcagccgacggagttgaacaggcaccactcccccacaatcaccgggaagtattcgctcatctcggcgatcatcggcgcataggtattcctcacgaagtcgtcgtagccctccgctgtctgcgggcaacccatcgtttcggcggtcatgaggtattggtgggtatcgaggaccacgttcttaaactcgggcgcgagcttgccgtcggggccgcgcatgaagtccttccactgttcgatgtcgaaaccgtcgtggaacaccacgactttgtcggtcggcaacgcgcccttgtcagcgtcgcgcagacggtggtaggcggtgatgtagaagttcttgagccagtcgaatgcgatcgggccggtgccttcggcgagttccggatcgaccgccttgtagcgttcggtcacgttcgccatcggccagcaggtggcggtgttcggctcgttgatgatttcgatgcccatcagcgcccgacgatggccgtaccgcttggagaggcgttcgagcacggacagcacgaattcgacttcgtcgggcagctgcgcccacttgcacacgccggagatgccgccgttgtcgaagccgttttggctcatcggtgcggtgtgcagatcgataaggatggtcaggccgtatttctcggcccagttgaaggccttgtcgagttcgtcgatgcagccgatgaacggcgcgcggtcgccgaagatgaagtacggcacggggatgcgcacggagttcagtccccacgatttgatggtggcgaagtcgcgctcgttgatgtattcggcgcggtgggtcctgatacgggcctcgtagacggccggatcaagttgcgtcggcagatagtattcgtcatcggcagtggttccatcgaataatgccgggttcatccacttttccagaaccagccagttacccaggttcacgcccttgatgtaattaaggtccatatgcactccttcgtacgctttcaatcatattttttattacttagtaattactaagttagatgatagtacatttttctcctccccgcaactcgtctcggacatctctccgaaccgctgtcgcactatttcgcataaagcaccctttgcgaaaatcgtgggaccgacaatcaaaatcgtgcagcaatttcacagaatcatgcgattaatcataagaaaaaagcctctttcttgcgggaagaaagaggcaacctgcagccggagagacgattactgcttatcgctggcgaatcgttacgtgcaaggcactcaccgaggcagcgggcaacgttaccgtcagctcggcaccgccggcagattcgtgcacgctcacggcactatccacgtccacggcatgagtgcgcaccagatccgaatgctccactgtgttgcaatcatgcggatcttcggaagcaagcgtttccatcgaatcaacctgagcgccgcacggcaaatgcagccgcacttcggcaccatcgttcatatgcgcattggtgagattaatcagcagctgcgtgccatcctcattacgtgacgcaaacgtatacacggcagaatcctcggaatcgttacgcgccacatcaagtgcggtcatgccacgatgcgccttatacatcatgaacacatcgtagttaggcgtaaggatggtccgatcgccttcagtcaagatcagtgagttaagcacattgatggtctgcgcgttacacgccatggtcaccttgtcgcaattacgctgcagcagatccaacgtaagcgcggtggtgatggcgtcacgcatggtcacctgctgcttgagcgcagggcgtgcgaagaatgcggtcttgtgccaattgccccattcgccgatgattagatcgacatgcgcgagcttggaatccatagccacctccggctcatgaataagcgccaggccgtcattcatcaaacgccactgatcacgcagaatatcttcaagttcgaggcatccctcaatcaccgcattccagccgtcttcatcgaaccgggtgggagtgtcggcatcgttatccacgttccaattgtagaagtgcagatcatagccgtcgatattcggctgacgatattcggcaagaccgcggaagaaatcctgggtccactgcacgcgttcgcgcggcttgttgccgtcgggaccgctcgcaatagcatacattggggtcggcgcgaacacatcggtggtgaagctcggcatggcggatgcgaacctgcggtattcattgaggtaggtccgcggagtcatggtaccgccgccagcccacacttcgttgccgatcccccaatatttcaccccgtaaggtgccttatggccgttagcctcacgttccttggcaagatcagtgggctgcgcacgattgcagtactccatccaatccttcatttcggcgaccgtgccggaaagcatgttgatattgatccacggttcagcgccgagcatttcacacaaacgcaggaattcgtcggtgccgaagctgtgatcgtccagctcataggtggcgaaattctcgttgaaagtggttttacgttcgctttgcgggcccacaccgtcacgccaatggtaggtatccgcatagcatccgcccggccagcgaataaccggcggcctcaatgcacgcaaagcatccaatgtggccttgcggtagccacgctcgttttcgatcggggaatcctctcccacccatagaccttcatcaatgcattcgccaaggaattcaatgaattggccatgcagtttcggatcgatacgaccaatcgtactgttcgggtcaatgcagacaaccatggtttgctccttttgccgtagtgctcacatctgcaacgttcgtaattcgtatggttcttgtagttattgtgccgcacaatatatgcgaaatggccgaagattccaggagagatgatgaaagaatctccggccaagttatttcgaaaagcgccgacgctacttcacctttttaatcatcagaatgaagatgcaggcgagcgccaccataacgattgccgtcgggaacaccagtccgtacgagccggtagctaccacaatggcggaggtgacaatcgggccgaccatctgaccgagagtagtggcaatgttcaaaatgcccaaatccttcccggcctcttcttcattcggcagaacgtcaacattgagcgcctgatcgacggaaccgtacatgccgtagccgaagccaccgatggcggagaagagaatcatgcccaacgcgttgtgcatgagccatggcagagcataaccgatggcgagcagcacgcttgcggccacaaccggaatcttacggcgaccgattttgtcggaaatcggacctgcggaaagcgcggaaatcagggagacaaccatcagcaccaagctcatggtggaaatggtggccgcggaatcttcaacactttgaccaatgtagtcctgcagaatatacagctggtagttgagaatcatgtagtagctgaacagcaacagggaacggccgataaatgccagccagaagtcgcgagcgcctttggtcggcggacggaagctcatgataatacccttgaaatcaaccttttccttaggcatatccttgctggacttttccttcggccagaagaccacggcaagcacaccggaaagacccatagccacaccggacgcgatgaagcccgggagctgcagggtgatgaactgcgcaccaacaatctgaccaagagcagaaccgaacaacgtacctgcagagataaatgcggacatggtgccgcgcatatcttcaggaatacggtcagacaaagatgcgatgaccggtgcgatcatcatgttcagaccgaccatggaaatgcagtagctgatgccaatgctcacaccgtccggcagaatgccgatgaggaacagcgaaatgcccgcaacaatgccgcccgatgcgatccatggcgtacgacgtccgaagatcgagcgcgtacggtcagacatgttgccaaccacgaggttggaaatcagcgaggccaatgccgtggctgaattcagcacgccgaaaatggcgtctttgctgtcgggcgcgatatcagccaaacgctgcggcagcagcactgcagcaacgatccgcaacgccagcatccatgcgaatgagaacacgaagaacgctacgcagaaacgcgttttgtcgattttggaaagctcgttggcatgttccgcaggccgtgcgtcagtcatgcttgtctccttatctttatctttctttttcaaagtcagccctctacgtttttgccgaatcttcaatgatcatgcaaacaacaggcaagagaggcgttgtgttgaagtcaactctcatcggcttcgtcagttatcttatatcttaaagatataagataacaaatcggcgtgtcgaacaacgacctactttcaagcacagcaatcaaccgcataaccgcaatatcgaaaccacatgaaaacgcatgtggacagcggcaatagtattcttcaaatcagtatggaatcacaggaaaacacatcagcaaacagcatcaagagccgtccaatcaaccaaagaaaacgactctccccagcgcagcgacgcaaacaaatcacacaagaagcggtaaccctaatcacgcaatacgggtcatacggcttccccatgcaagcattagccgatgcagttggcatgaccctgcccggactcaaccattacgtcaaaaaccgagaagaattactctcattggtcatcgaaacgttctacgactccgaagaagaaggcaatgcccacacggcattgggcgcagccatcagccactgcgaccaaacagattcagcaaccaaagaacgccgacatctgcccggcgcattgcacgaaaccgtgcgcctcaacgccaaacgtcccgaacttgtcgcactgttcatgcgcctcgccatcgaagcgtccgatccagaacacccagcccacaagttctaccagaacagacacagttcgattttgatcgacatgaccagcgtggactgggaactaccggaagaataccgcgatccagaacgcctgcatgacctcatcgtcaccgcgttctttgccatggacggcgtgcaaatccagtcgttaaccaatcccagcgaatccatgatgcaactatgggaacgcgcagaacacatcctattcccctcccccacatgggacggctaccgctgaacagagcgcaaacaagcaaagacaccgcaaacgcaaaaaggcgtttgcctgcggcgaccggtaaccgatcaccataggcaaacgccccgcaacacaacaccggcttgcgaagatggcaggaagagaagggaaacttgccatccggcattcaacaaacctctgccacaaccaagccgacgcgttacgcacacattcgcatcagccaggcagctcccgtcagtccagcacaaacgtgttgaacgaacgcggagcaagcgtcaccttgataccgcgatcggcattgcaaggatcggcaaattcaaacggacgctcctcttcgagagcgttctgggccaccaccacaatggtgccatccggattacggaacgcaatagccatcgaattgaaatgacccgtagtgccaagcacatgcgcacccggcttgacgaaatgcgagaaatgacgcatcacataatattccggattacggcgaacctcatgcgtatccgcagtaatggtgaacagtgaattctgccaccacccccacgtagaatcctgatcgtcaagaatcatattccaataagtgtaagcagtcgcgccattacgcaaataatggttgatcaagtggaaaatatactccgcatattcccacgtattatcacccataccgcattcggattcagactgaatcagctcgatttcaggccaggattcatgcgtacgcgcaatacagttctggccggcccactggtaagcgatgcccttgatgtacttgcgagcgccatcgtcgaacagaatattgtcgacaaaacggttgtaattattcagcttcatgccgtagccgccggtccacgccatatcttccggaccattcagcgtacccagccaaatatcggtgtcaagaccagcttcgccaaaagcaggtccaagataatcgcggatgaacaccttgagcgcttcggaatcccacaatgcactcgggaacttctgatcggcaaacacctcattctgcacatgcagctgattcacggtaatgccatgctcggcataagcttgaatgtacttgacgaaatacttcgcatatgccttaagattctcaggagtctgcaccaaacgaccatagttataagccttcggacgcttcatccatgtcggcgggctccacgggctggagaacagttgcatgttcggctgccattcctgcgcgcgatgaatatacggaatcagcgtccgctcatcatgctcgacggagaaatgctccatctcataatcgccgtcggtctcgttatagctataccaatgatcggcgaaatcattggcaccgaccggcgcacgattgaaggtgaagttcatctcatccgggctgaacagttccttgatgatctgatcacgttcctcttcagtaaccgtctgcagaggaagccagccaagctcgttgaagcagccgccgaagccacgcaatgcctgatattcattgccatcaagctgcagatcggaagcggaagtggcatgcgtggattcaatttcggatgatttgtcggcaagcttgttgtcttgcgttgtcgcgatccaagtagtcatggaaagtccttagtattgtcgctgattctttggatttatatttattcgttttttgagttgtttttatttgattattgggatttagttatcgatatttagtttttgagattgaattattgagattgaattatcggcaacgcaatttcatttcagtaagtgcaaaaaccgcaggatgccgcgataatctattcacaacacgctccaggccgctctagccaagtctttacggtcttaaacagattatcgcggcatcctgctcgtaacgctatgacgttacgtttgcactgttatttagttttgcattgttgttcagttttggaaaaacttcctattccctctctccctctcctctctcgaaattgaggggagggggaggaggtggggttacttgaccttcttgatggccatgatgaagaagcagccgatgatggccaaggcgatggcggtcgggaaggcgaagttgtagccgagggacaccacgatggtggacatgatgaccgggccgcacatctgaccaagggtggtgcccatgttcagaatgcccagatccttgccagcctcttccttgttcggcagcacatcaacgagcagagcctgatcgaccgcggagtagacagcgtagccgaggccagcgatgccagcgaacagatacatgcccagggtggacgggatcagccacggcatggcaataccgatagcgaagagcacggaagccacgacaaccggaaccttacgacggccgatgaaatcggaaaccgggccggagatgaaggagccgaccagagacatgaccatcatgatcatggaaacgacggacacggtgacagcggattccttgacggactgaccaatgtagttctggatgatgtagagctggtagacgttgatcatctggtagctcatgatcatgcagaaacggccggcgaaagccttgtagaagtcgtgggcgccagcgaacttcggcggacggaaggatacgaggacgtccttgaaggagccctcttccttcggcaggaagtcagcggactgttccttcggcaggatgatcacggcgacgatgccgccgaggaacatgagcacgcccgcgacagcgaagccggcagtcaggttttcgatgaagaatgcgccgatcatggtaccgatcggagcaccgatggtggagcctgcgccatagaaggcggacatggtgccgcggatgccagacggcacgcggtcagacagcacggcgaccagcggggcgatcatgcagttgaggccgaacatgcaggcgcagtagaagatggtgagcagcacggcgttatgcgtggtgccggtcaggaacagggtgacgccaccgagcaccgcgccgaaaacgatccacggagtacgacgaccgaacctggagcgggaacgatcggagaagttgccgaacatcaggttggcaaccaaggatgccaccgcggtgaacgcattgacgatgccaacgagagcatccggatcagcgccttcgatggtcttgtagtgcatcggcagcagcacggcggagacgatgccgagacccgacatccacaacacgccgaacagcaggaagcccgcaccgaaacggatggtgttgaccttgctcagtggcttgccggtttcaggagacagctgcggatccttgtctgcagcggcgatgttggcgttataacacaccaaacgctcctctttgtttgcgattgcttcactcatgaaaccctctccttcgattcatgtttcagtagtgttttctgtgatattcctgttttccgatagggcttctctgcccagccagctaactaccatttggtaactagccggttttcgtcatagatgccctttcgaaagaacgcaagtcagacgcgaatttttccgacggcagcgttttcaaatagcaatccacaacgattcgccccatacagcaacttcagtttttattacttagtaactgcttagttaaagcatattacaatctcttgtatctgtcatttgccggcgtgtcccaacgtttccaacacacttcctctcccccttcttgtaacttagtaagcacaagagaggagaacgcatgcgtcgccacatcgaaagcaaaaccaagaaacgaatgagcgcagaagaccgcaagaaagcgattctcgaaaccacggtctctttcatctcacaattcggattctggggatttaccattcgcgacgtggcacaagctcagaacatcaccgaagcaggactcctttactacttcaaatccaaagaacaactccttgaagcgacactcaaatacgccgatcgcactaaccaaatcgccattgcagagcatcttggcgtcgaaggcgtgaccggcgaagtcttgcaagacggcatcgcataccattgcgatctcggactcaaggccatctccacgggaaccgtggaaaccaacgcaggccgacccgaaatggttcgcctctacaccctgctcgaaagcgaggccctaagcaaagaccatccggtgcacgagtatttcgaacagcgcgaaatcaatctgctgaaggaatacacgttcgcagccaaacgagatggcgtcgccgatccggaacgcaccgcactgcaggtgctatccgccatggaaggcttgcaattgcggtggctcaacggatctcacgatatcgatttcgttggagaatggaaggccctgatcgaccttctcattccctaaacgttctcttctcgagttctcttatcgcagatttcagccggcgatcaccgcaacattccagcggccaatcgtcaacggatcaccctgcttaacggctgcaccttccttcagcacgacttcagcatttgcaacctcatcaatactgccgtcggtggcgatgacgaccggagcgaccactacttcacccgcaatcgggcttgcaacagtaacttcgtcggcggaatagttgagcaaatacgtcacgttctcgccgagggcattcacaccctggcgaaccgcgacctgtcccgcgagcgcggttccagcgccctcgacgccggcatgctccacagcctctcgcataaccgcacgaatggaatcggcgtcaagcagtgtggcgacccactcggcatcgcccttgccgaatgcgtgacgggtgactgcggcgtaatccttccaagcgtagtgtccataagatgcgagcacctcagtatcggcgtcggcgttcaacagttcgatcagcgactgagcatcggtggacgcggtttcggcgagcgcacctgcgaattccacggaaacgtggccgtttgggcgggtgaactggttgtacgtcatgccgaacacgtcggtgagattgtgcggcgcgcggtcgtgccatacggtcacctcgtcgtcggtcacgaaggagcgcatggtggagacgaggtgtccgccgttggagacgaattcacgcaggcgatcggtcgtttcctgcggagcacagtacagcgccggggtcacaatcatctcgtatgaggccaaacgctcggcgggagcgtcggaggggatgaaatcgcattccacgttgagctcgaacagcgcgtcgtagacattgcgcaccacgtcgttgtatttgagggtgccgccgaatgggaagccggcttcgatgaggaaccagtcgagcgcggtcagcgattcgttgctgaccatgatagctaccttgttgtgcttcttcaggtggacgagccgctcccccacttccggtttggcaatctcgcgaccgaatacgccggcttcgcggtacgtggggttcggttcgaggtcgtggctcagcaggcccttccaatatgtttcaaaggaattatggatggagtgccagtgccagtattccaccatgtcggcgccggaggcgagatgggagtaggcctgcaggcgcagctggccggggaatggcacccagccgtgctggccttgggcctcggtttcgagcaccaggtagttctggccgttcttggtggagcgggtcatgtcgccgccgaaggcgatctccttgccggtcaggtcgtcttcggtcgggtggtagatgtccacgccggtgatgtccaccgcggtcgcggccttgaagtggtcgacggccggctgcacgccgtaggagtatccgcgccattcgaaatcgaagttgtgggtgatgaactggtcgtcatgcgcgtattcgcgcacgatgtcggcctgccactgcaggaaggcgcgcacctgatcgcggcggaacttgtcgaattcgccgcccagggactcgttgatggtggcggtcacgtccgggaagtcctcccaggagtcgatgcggttggaccagtagtcgaggccgaagtggtggttgagctcgttcagatcgccgtggaacttctcgcgcagatacttgacgaacaggcgctgcatgtcctcggagacggaatcgtagtatttcgtctcgttgtccacctggtagccgatgacggccggatggtcggcgacgtgggagatgagcttgcggatcacacgttcgccgtagaagcggtaggtggcgttgacgatgtccatgatctggcgcgcgccatacttgccctgtccgttcggcgtgaccgcgagcacgctcgggtcgagcttgacgagccagctgggcaccgcgtaggtcggcgtgccgacgatgacatcgatgccggcacgctgcgcggcgtcgagcgcacggtccacataggtgaagtcgaatacacccggttgcggttcgcaggtgctccacgtggattcggcgatgcggatgacgttcagccccgcgtccttcatcattttcatatcctcatcgatgcggtcgatgcctttcatcatgaggtattcgtcatagtatgctgcgccaaaaaggatgtggtccacttcgttgcgactcatggttttcttgttccttacgtcttcgctgactacggtcgagatttttatctaacaagtattagatataagaaatatattatctgcccgcacatatgtcaagaggcttggaaataaggcgtgtcttacctaataaacattagatatacgaccagccgctactttttaccggtatccgtcccataccggagagggaaaaatcaaccgttcgaaggcgagccattcgtcatacaggtcgatcggcggtttgcgcatccaccgcagctggataccgtccatcgcctcgatgcattgccgtacgatcggccgcatattatcccatccgccgacttccggaggcagtttccatgcgaactttgagtaatgctcccacgtcagatccggtcggttttcgaaatactcgtgcagtggatggtccgcgttgaacgattcggtttccaaaaccatgtacagctgcagcagactgcggcgttgcgcattgtagcggaccagaaaccgcagatatgcgggaaacagcatgccgtcagaatcgctgccgggcaatcccgacttggcgaagtcggcgggtgtgccctgctggtcgtagctatcggtgaccagcagcgacaacaaccgctccttgttgccgatgtagtgcagcagtccgggctggctcatgccgatggcgtcggcgatgtccttgagcgacgtgccgtagtaccccttctcgccaatcagcttacccgccgccgcgatgatttcgcgtttgcgctcttcgggcgatttacgaacccgctttttcccctcggtaaccatatggaacagcgtaccatcggacgggccctcggccggtcacgcctggaagacgtccggatgcttcgggtcgcccggttcgtcggcgagcacaccctcaaggccgagaaactcctgccagaattccaacgaattgccgtatgggatggcctggcttccgcgcgcctgcaggttcgccttggcctcgaacacgtcctcctcgcggatgccgtcgaagtagctttccagtcggtcgagattcgtcggatcgtagaacagcgagccgatgatttcagtaagccgctcggcgcgggccaccggcagcgaatcccagtggcggaattcgatgaagttcttcaaacgcacgtcgttgaagtgcgtggagatcacatggttgatctcgtacgcgttgagctcgcggtccgggtacacgtcgttcgcgttctcgtagaacgccggatggtgcagatcggtgccgggcaccgccagcgcttcgggcgtgtgcgtcaggtcggcgaacatcatcggcgtggacagcacgtccaccgcgtaatcctcccaaccgaaacgcggatcgaacaggccaggaatgacgttcgtgcgctggaaatcgagataatcccacatgcgctggcgtagcggcggataaggattctccccaccttcgaaatacggagtgttacggaagaaccatgccagaatcgggccgatcaccgtgcccaaccgcagtttggcgatcgcgtcctgttccgaaacgtagtcgatgctgacctgtgtcgaagcggagcaacgcatcatgcacggaccgaactgtccgacacgtcccaggtaggcggtcatcgccttgtatcggtccttcggattgacgggaatgtcggcgtaactggatttcggttggtaaccatagttgacgagtcggaaaccaagttcttcgaggatggggtcgacttcgcggcggaacgcgccgtacaatgtggcgagctcctccggcttgtgcaggatgccgatggacgtttccaactgtccgcccggttccaaagatacggagatgccgtcacgggcgagtccgaccagtcgcccgttttcccagtattccttgttttcgtcgtaatacgggcggatgcggttgaacaacgcttcaatgccgttgctttcgtagtaggtcaccgcggtatcgtcgctgttatgtaccggcaggtgttcgatttccacgccaaaaccgccggtgccgcgctgttggcagccggattcgaagaatttgataaggctttccacatgcttcggattcggctcggtcagcaggtgcgcgtacgtgatctttggcgttgtcatagtggccatcctaacgaaaagcgccattcgcaacgcaggctacgctatacggaaaatcgataaccgaccatcattccccatcgatttggctggcgatttgaatgccgattcgacgaccatcgattttacgatcgccgaatcagccgtcgatttggcggctcagataccgtcgaaccgacgtcggaaagtttcccaacgtcggttcgacggaaataagaatggcgattcaagcggccttctcgctgttgcgcgcctcttcggctgcgcggtgcgccttcttggccgcggagatcatcagtttgatgcggttgagctggttggcttccgaagcgcccggatcgtaatcgatggacacgatgttggcttccggatgcagtcggcggatcttgccgaacatgcctcggcctgtcacgtggttcggcaggcaggcgaacggctgcgcgcacaccacgttcggacatcccgattcgatgagttccaggatttccgcggtcagcagccagccttcgccggcctgcacgcccacggacgtgacctcgtcggccttcttgaccagttcaggcatcggcagatcctgcgaaaacttgccgtgagccagatcgatcgcctcgcgtaccggagcgttgtacaggtcgaggcccttgcgcatcagcgcatagccgatcttgctgccgcccatgccgaggtaatgctcgttccagtcggaaatgtacggtcgggtggtcatgaattccatgatgcccggcaccacggcctcgcaatcctgcgattcgatgacatcgaccacatggttgttggcgtccggctggtacttgacgaggatctcgccgaccacgccgacgcgcaccttgcgcggctcgtccttcaacggcaacgagtcgaacgacttgacgatttccttgacgagcgtcggatacggcaggtatcccttgccgatgaacttgcgcgccgtcttggaacgaccgtggttttcgagcgtctcgcgcacgatggtgtcccacgtttcgtacagcttgttcgcgctgccgggggtcacttcgtacgggcgcacgcggtacaggcatttcatcagcaggtcgccgatgataagcgccttgactgcacggtgcagcagcgccggcgttgcggtgaagcccgggttgtcctcgatgccctgcgtggagatggcgatcaccggaatctgcggataaccggcgtccaccagcgccttgcggatcaggccgaagtagttggtggcacggcacatgccgccggtctgcgtgatcgcaagcgcggtgtggtccggatcgtatttgccttccagaatcgcgtccacgagctggccgatgaccatgatggccggatagcaggcgtcgttgttgacgtatttgaggccagtttccacgtcctcacggctggcgtgctccagaatgtcgaacttgtagccgccggagcggatgacggattccaccagagagaagtggatcgggctcatctgcggggccacgatggtgtagtccttcatgttcttgccgaacgggatgcggttcgcatacttggacagggtcgccgagttgtgtgcggacgcgcccttgccatttgtctgcgttttggcggtttcttgcgattcgcccttgccgttttccgccgcgcgcttggatgcggccgtgacggcttcggtgagtttcggattggctttcatgacggtgtcgagcatgacctggcgaccgggggtcggcgcttcggtgccggtcttgcggaatccgtcgttcttcttgttgcgttcacgctcttcgacggcggccttgagcgagcgcagacggattttcgccgcgcccaggttggagacctcgtcgattttcagcatggtgtacacgtcggccttgtccgccaggatctcggacacctggtcggtggtgatggcgtcgaggccgcagccgaaggagttgagctgcacgagctcgagtcccggataggaggccacgaaatgggccgccgcgtacagacgcgcatggtaggcccactggttggtgacgcgcaatggcatcttggtgaccttgcggtcgtcgacgtggcggaagccgttcgcgttcttcttgcggggatcctcttcgccttcggcgaggaattcgctcaggttgagcttctcccccggctgcagttcgcagatggagtcttcggacagcaccaccatgccgagcgcgcagatggtttccggaatgccgtggttgatttccgggtcgacgtggtatgggcggccggcgagcacgatgcccttgcagtcgtgttccttcatgtaggcgagggccttgaggccttccatctgcacgtcgtgcttgaacacttcgttttcggcgtaggcggccttgaccgcggtttcggcttcctcgcgggtcacgttggcccaggcgaattcctcgacgatgcggtccaccatgagctcatggttggccatgttgaagtacgggcgcatgtagcgcacgccttcctcgcgcagttcgggcatgttcgcgccgatgaccaccggatagttggccacgaccgggcagttgtagtggttgtcggtgttgggaacgaagttctcctcatagctcacgcacgggtagaagatcgtcttgatgcccttgttgagcagccacttgatgtggccgtgcacgagtttggccgggtagcagatgttttcggaggcgatcgattcgatgccggtttcgaacagttcgtgcgagctgcggccggagatcatcaccttgaagccgagcgaggtgagcagcgtgaaccagaacgggtagttctcgtacatgttgagcacgcgtggaatgccgatttcgccgcgggtggccttcttgtcggtcagacgacggtaggcgaagcaacgcttgtatttgtagtcgtacaggttgggcctgtcggaacgctgcttcttggaatcgccgccgcgttcgcaacggttgccggtcacgtagcgggagccatcctggaacgtggtgatggtgagcttgcagtggttctggcatagcttgcacacgtcgcgttcggtggtcatggacaggttgtcgaggtcgctgccggacacgatgctggatgcggtgtgcgtgacgccgtcgatgtcgacggtcttgcctccgtcggcgtccgcgtcaccatcgtcgagtccgtcggcgatgtcggtgtaatgcatgcgcgcggtcagcgcggcaccgtatgcgcccatcaggccggcgatgttcggtcgggtcacctcacgttcggtgagcagctcgaaggcgcgcagcacggcgtcgttgaggaacgtaccgccctgcaccaccacggtgtcgcccagctcgccggaatcgcgcagcttgatcaccttatacagcgcgttgcgcaccacggaatagcacaggccggccgcgatgtcctccatcgaggcgccttccttctgcgcctgcttgacggaggagttcatgaacacggtgcagcgcgagcccaggtcgaccggatgcgtggagttgagcgcggcctgcgtgaattcctcaatcgtcagtcccatggactgcgcgaacgtctgcaggaacgagccgcagccggacgagcatgcctcgttgacggcgatcgaatcgatcacgccgtcggaaatcgccaagtatttcatgtcctggccgccgatgtcgatgacggcggtaacgcccggcgagaccatttccgcgccacgatagtgcgccatggtctccaccacgccctcgtccaggtgcaggccggtggtgatgaggccttcgccgtatccggtggcgcaggagcgtgctatccacgcgccttccggcagctggctttgaatctgcttgacgatgttgacagcggccgtcagcgggctgccttcgttggtggcgtacgacgaccatacgatttcgcggtcgtcgttgacgagcgtcgctttgatggtggtcgatccggcgtcgatgccgaggaagtgcggaccttgcgcgccttccagcgtgccgatgtgcacatgctcgcggtggtggcgcttgttgaacgcctcacggtccgcttcggtcgggaacagcggaggcatggtgggggtgttggccggcagattcttcaggtcttcaaggcttttcagaatatcggcgcaggtgcgtgcttcgaaatgctggccctcctcaagctggtccggttcgccggcgagcagcgcggagccgaacgccacgtacaggtgcgcgtcggtcggcacgatgaattcgtcgactttgtcttcgagcgcgcggtggaacgcctcgcgcagttcggacatgaagaacagcggaccgcccaggaagatgacggtgccgtggattggtcggccggacgccagacctgcgatggtctgcgtggcgaccgccgtgaagatggatgcggccagatcgggcttggccgcgccgtcgttgatgagcggctgaagatcggttttggcgaacacgccgcaacgggaggcgatcggatagagcgtctcgtaatgcttggccatgtcgttgaggccagccgcgtcggtgtcgagcagggtggccatctggtcgatgaacgcgccggtgccgcctgcgcaggaaccgttcatgcgctgttcgggagtcggcttcagatatgtgatcttggcgtcctcaccgccaagttcgataatgacgtcggcttgcggatattcctcgtcgatggcgcgggtctcggcgatgacctcctgcacgaacggcacatggagattatcggccaaggcaaggccgccggaaccggtgatggccagacgaatcggctcgtcgccgcggccacgggcctcaagttctttgtggatgtcctccagcaggcccgccacggtggcacgcacgttggcgtggtggcgacggtaatcggagaagagcaccgcgtcgagcgaatcggtctgatcgagcaccacggccttcaccgtggtggaaccgatgtcaagacctacgcgcaacggcttcgtatcgcaggtgttgtctgcggtaactgctgcttcgaccatgtactgtacctctatcgttctcatccgccgggttgcgtccgtgccgacacgaacgccctgccccggttatccaagtatgtaatggtagtctgtgcccctgcctaattcggcacggtatcgcataaagcgcacgacacgacgcataattagacaacgaatatagtcagcttgcctaattccaaccgtccgtacacgaaccgttcaaaaccattcaggaagccgccccctcccccgcagcgcggtccttgccgtagatttcgggaatgaaccgcgtctgatcgtgtagttccgaccacagcaccacctgcccgctttccaacgacttgggcacatcgatgatgcgctggttggagctgccgcgaaactgcagcagcgaatcgtgcagatccttgatataccggccatccacgagaatatcgatctgttcgagcagttcacgcttgtcggggctttcgccttcgcgcatgagctcctcccacgtgtagcccgtccagcaccagatgtccttggtgcggccgaaccgctcccggatcttgcgtgaaagcggcagcagcacgccggtgttgagcagcggctcgcccccgaggaaggtgatgccccgcacgtacggcaggctcagatcggccatgatctgagcttcgagccggtcgttgtattcgtggccggcgcggaaatcccagatcgacgagttgtagcagccttcgcagtggaatgggcagccggagacgtacagcgagcagcggattccctcgccgtcggtcatgaggaaccgcttgtagtcggcgatcatgttgtggctcatcgcgttcgtccattgtccggcgcgcgggttgctggcgcggtttgtcggaatgaacggcccgcggccggtttcgccggccgcgaaatcacggcgagacacagcgggatcggcgctgcttaccatacgttgctcctgaattgcctgttgttttgcgattattgcgattgattacttggcttcctcgaaccattcgcgttcggaaccgtcgtcaagggtgacatggccggtttcgccgctcatgtgcttgacgcggtgcgcgatttcctcatgtcggccgtgcaccatcgggcgctgcaccggattgccgaggtagccgcaggtgcgcttggtcacgttgcagcggtccgggtcggagttgccgcattcggggcacttgaagccttcttcggtcggttcgaagtcaccttcgaaaccgcattcgtagcaacggtcgattggcgtgttcgtgccgagatagccgatgccgatggtgtaggcgtagtcccacaccgcttcgagcgccttcggattggcctgcaggcacgggaattcgcagtagttgatgaagccgccggacgcgtagtacgggaagtccttctcgtagtcgagcttctccatcggcgtgggctgcagccacaccgggtagtggaaggagttggtgtagaagtcgtggtcggtgacgccgtccacttcgccgaacttctcgcggtccatgcggttgaagcggtcggtgagcgattcggccggcgtggagtacacggagtaatggtagccttccgcggtgctccaatccttgcacagctcgttcatgcgcttgacgatggacagggcgaattccttgccttccggatcccagtcgtggtcgcgcatccagtccttgccatagaacacgctggtcgcctcatacaggccgatgtagccgagggacacggtggcgcgttcgttgcggaacagctgatcaacgctgtcgttggcgccgagacggccgaatgcgccgaagcggaacagggtcggggcgttgaccggagtggcctgcttgcaacgcatgatgcggaactgcaatgcctgatgggcgacggtcatgcgctcgtcgaagatcttccagaagcggtccttgtctccgtgggattccaatgcgatgcgcggaatgttcacggtgaccacgccgaggttcatgcggccgtcctcgacatccttgccggtcttcgggtcgatccagccctgcaggaaggaacggcagcccatcggcgctttgaaggagccggtgatcttcacgatgttctcgtagaagatgacgtccgggtacatgcgcttggtggcgcattcgagggccaactgcttcaggtcgtagttcgggtcgcccggatcggcgttcacaccgtgcttgatggtgaagacgagcttcgggaagatggcggtgtgatgctcggaaccaaggccgcggatgcggttgaggaagatggcgcgctggatttcgcgcgcgaaccagtcggtgccgagaccgaagccgacggtcacgaacggggtctggccgttggacacacggttggagttgatctggtattccatggtctgcatggcgtcgtagatggccttgcgggtctggatcttcgcccagatttcacgcagctgctgcagacggtcggacgtcttgtcgaacggctcgtccatcggcagtgccggacgatccttttcgaagtgcaggcgcttcggctcgacggccttggccatgcgcacctgacgttcggcgatctcaatcggcagatcgtcgggcatgatctcgtgggcctgctcaaggaacttgtcgtagtccttcttggcgtattcggcgaaatgctcgtcggcgcggttggcggtctggccaccgtactggctggaggccacgtccttcatgatctgggtgatctgcgtggcggcgatggagatactgttcggcgaacccatcggggcgttgccgagggtgaagccgttggcgagcatatcccagtagttcggcagcgagcagttggactgcgcggtgaacggcgagtaatcggcgtcgtggaagtggatgtcgcccttcatgtgggcgttggacaccgcgtccggcagcatggagaaggcggatgccttggacaccgcgccggccagcaggtcacgctgggtggagtagacgttggagtccttgttggcgttctcacgcaccagcgcctcgtcgcggtccaccaagcggcgcacggcctcgttgatgtccgtggccttggcgcgctcgatgtccttgttcagacggtagttggtgtaggtgcgggccacgtcgtacagatggtcctcgatgagcccatgctccacgaggttctggatgtcctcgatcttcgccggaccgttgtaacggtccttgatttcggcctcgacctgattggcgatgtcgcgaatcagccgttcctcctgaggaccgattttcttgtcgaggtcggcgaaagccgatttcaccgcgctgatgatgttgatcggatcgaaatcgaccacacgcccgtcgcgcttctcgacaagcaccttgaccatttccggcgcgttctcggttttggtcgcaacgccttccagagtctgggtttccatgtatatttcctttccgggccggacccatccggccaggtttcatgcttcgtccgcatgcccgttcgtacctacagatgcacactctacgccaaggttggcactaaatgtagtgtcaccacgccgctagagaaactatatattctacttttggcgagatttcgccattttttgccttgtgtgacaaaagtaacgatttcatctcggagtgtcgttttgacacagccccacacaccgtactatcttcacgcacggagcattcgcaacactcgaacatatgttccatttgtccgcaagatgatggaatcttgacttatgacttggaacccggattacaacccaccgacggcgcagcggacgtcgaagccgctgccccgtctggcgtcggaaaccaccgccgacaatccttggccggtgagcctgctcagcgagaagttctacacggcggtcgaacgttggccctccgtatgggtggccgggcagatcacgcagatcaacacgcgtcgtcagggaagcgcctacatcacgcttcgcgacgaccagcaggacatcgctatggaagtcaacggcttcggacggttcgccgcggcggcggcgccgtttgtgcagggcgaccgtgtcatcatccacggcaagccgaacgtgtggatgaagcgcacgtcgctgtcgttgcgcggcgacgcgatcatcgcggccggcgcgggcggcagcctgaaggccatgatcgacgagctacgcaagaagcttaagggagaaggtctgttcgacgccgatcgcaagaagccgttgccagaatttccgcattgcatcggcttgatctgcgcgccgcaggcacgtgcggaaggcgacgtcatcaccaacgtgcgtctgcgttggcccgtcgtcggcttcaaggtgacgcatgtgcacgtgcagggcgagcagtgcccgtcggacgtggtggcggccatccggcagctggatgccgatccagatgtggatgtgatcatcgtggcgcgtggcggcggcgctttcgaagatctgattggcttttccgatgagaacgtggtgcgcgccgcggcggcggcccacactcccctgatttccgccatcgggcatgaggacgattggaccctgctggatttggtggccgacctcagggcctccacgccgaccgacgcagcgaagaaggtcgtgccggacgtgcatgatctgctgcagctgattcaggtgaacctggaccgcatgcgcgtgcgcatcgacgccaccgtctccaacgagaccaggcttatcgaaggctacgcgaaccgtccaagcctcacccagccgctcaccatgttggaaccgcatcagcgtttccttgatgacgcacgcacaagaatgcggatcggtctgacccgtattcttgacgacgcgagcctgaccatcgagaaagcgcacgcgtcgctgaccgcgctgagtccgcaatccacgcttgaccgcgggtacgcggtggtgcaatgcgccgacgggcatgtgcttgacgacgcggacaaggtgaagacgggcgaccagctgaccatgaccttgaagcacggcatcgtcgtgtctgaagtgaaaaccgtaacgaaggagtagcacatgagcaacgaagcagcaccggcatccagcctgaccgacaaggaacgcgaagcaatcgcgcagatgccatacgaggaggcgcgcgacaagctcatccaggccgtgcaggcgttggaggcgggcggcctgaacctcgaccagtccatgcggcagtgggagatcggcgaggcgttggccaagcgcgcgcagagcctgcttggcgaggtccgagccaagctcgacgccgcgcaggccgagcaggccaccgcggccaacaccgcaggaacgcaagacaatctggcctgagcatccgtcgcggcacagccgctcccctcacctacggacgttccaccggaacgtccgtcaaacggcttgagcccgaacaatcaggtccgattacccgtcatgtcgagtccatattgtgtgtacaatggtgactcgttgcctcagtagctcagtggatagagcacttctctcctaaagaaggtgtcgtaggttcgattcctatctggggcactttttcatatccccgtacattgtcggcgcgcaccgccatcggcagcatccaagatcaatcgcacgtccgcaatccggacaacaccatctcaccgccaccctccagcacaggcacaatgagcatccctctgttatagtggcaaacggatacttaagcggttgagtgaatgtatccaaaaggttcccccttctgctatggaagcatcggaaagcaaccgcacaacccatacatcacctttggaagaccaagggatcagcatgcaagacataccatattcctctattgtggaacggctggcgcacacgaatccggtaggacagttgcccggaccgctctcctacaagctgctcgaccagttcaccatgccgatgctgcccacagaaccgcaatgcacgaacgtcatcgcctgcatccgatattcgaataacatgccggtcgtcaccgtctagccgcggacttagccgacccgcacaatcgccagcagcgccttgtggtcgctgccgtccactttgactgtgcgcacctgtccggcctgcatgccggaatccagtacgatatggtcgattccggcgaacgacggcacgtaatcgacattcgcaggccatgagaatttcaatccctcgccggcctgacgggaggcgtcggagaaacggtttcccagaatgttgcggaacggcgtatggtcgtacgtcgcgttgaaatcacccatgaaaacgtaccgtcggctagtgtcgaaacgtagtttcgccagttcgtcgagcgaccgcttccactgctgccagtaatcgttcgtcggcgacgtggtatgcacggatacgaaacgcacctgcgtggctcccccattgaacgaaacggtgccgcccggcatgaacgacgcgctcgaatcgacatcgtcatcggaagggtcgtcaagcggactcgccgaccaaaggccgttgccgtacacgccgtccgaactcgacacctgcgcatagggcagatacgaggcgatgccggcacggttcagatcgtccacgaaagcgtcggtcgtctcctgcaacgcaagcacctcgacgtgttcgctgcgcaccagatccacgatctcacgcgcatcggcgcgccctttgtacacattgcacgtcatcagccgcgcgtagccgtcatccgtgttgacggtttcgccggacgccgccgcgactgcggcacgtggcagtttcgaaggctggtagaagaacggatactgccagaacgtctgcaacgcaatcgccagaacggccatcacgatggacaccgtacgtttggagatgatggcgcagacgagcgcgattacggcgagcagcgtgaaccatggcactagggagacgacgatcggcatatacggcaacgcctgcagttcttccggcagcatgtgcgtgacagtgcccagcagcgcggcgagcgcgaatatgaaggcaatcaccgcgcagatgaaattgcgtacgcgatgcgttttcgtcttattcagcgtgcgtagcggcttgaccggtctcgttgcggccggttttgctttagcccgattcgctttggccgacgcttgcgatttgcccgttgccggcccttgcggctggcgtgtttttgcctgagccataccattcccttgttttttcggaacgcacgtccgcgaccatccatgtccgcccgtgtccgtttatgtccgttccgttgatgttccgacggtttccttcacgccttcggcttagtcgtcgaggccgagctcgtggcggatgccgtcgatgatgatgcggctggcagtggtgccgcgttcacgcgcgttttcctgcagcatcattttcagatcggatggaattttgaaactcatgagcacacgttcgccgttgccgttgccattgccacggctgcgggtgtcctgcacgctggtcagcggagcggtggacgctgccttcgcaccaccgttcggttttctaatggccatcaggcgatcacctcctcaagttcgctgtagacatcctcatacccgttgagattgctggggaatgcatggccgattaccttctgcatgcccaccctcttgggtaccgaggcatcgaagacgctggcaccgcgttcgcggatgagattgaccgcgttgcccgccagtttgttgttctccactttgagcagcagcagcgcgtacggcttgccggccgcgtcgaggctttccgcggtttccagcgcgtggctgagttcgaatgggccctgcgtcgccggcacgatcacgaaatcagacacatcacaggccacgtccaccacgttgccggccggcgggcagtcgatgatgacgagttcgtcatccgccatggttttgcgcagtcgtttcagtttgccgatattggcggagtccacggtgaacggcagggtttcgccggcgtcttcggcgtcgcccgcccatgtggtggcgtcgccttgcggatcggtgtccagcacggacacgttgcggttgtgccgtgcggccgcggtggccaacgccatggcggtggtggttttgccgctgccgcctttgaggttgatgaccgagatgatcatgaaggttcctccgcttcgacaatcaatttatataagacgtatatactttttatatattggatagacgacagtcacgctgacggcgtaacggcattggcaatgtaaaaaatagcggcgacgcactcttgccagttgctttgacgggtaacgaaaaatcccgaggagctcagctcaactcgggattcgaaaagagtaaacgcggcgacttgctactctcccacaccctctcgagtgcagtaccatcgccgtgctaggccttagcttccgagttcggaatgggaccgggcgtctcacctaggctatgatcaccgcaagagaaaacaatacgcgaacatgcggcaatcggcaaacttcggcgtgtcgcgcactgcaatcgcattccccaatcgccaatgatcgccagtaatcgcgcgaatgccggcaatcgcaatgcatatgcgctacagtcgaagcaatgccgcaacaattgcggcgtgcttacgaaagaaggccagcaatgacgatcgcctcctgcggttccgtttccgcaaccactttgggtctgccgaattccactgcgattcccgccgagaaggcgaggctgccgaaaggcctgttcgtggcgaagattccggtttccgccaaaacaaagcagcgattggcgaacgacatcgaatcaatcaccatgctgtcgctgctgcaggcgcgcaacacgaagcttgccgccggtacgcgcgtgccggaaatactggtgatcggcctgcgtttgcacgaaccaaacgccgccgttccgacggatatcgtcgaattgattgcgatgcaacgcaagtcgggcatgctgttcgtttgcgtacgcgacgccgatttcgaaggtacgacgcgtcaggagtgcgcgttcgccgtccgtcgagcgctgccggcacgtgccgggcacacgaccacatccaaggtgttcgcttccgattggcagccggccggcgaggccacgctgaacgccacggatccggcggtcgattccatggacgccttgtgggagtcgctatgctcgcaggtgattctggacgacccctcccccatcgacgtgaacacgcgtcttgcccgacgcatgcagattgcacagctcaccgcgcaggtcgacaagctcacccgcgaccatcagcgtgccaagaatcccgaacagcgcaatgaaatctacgcgaaactgcacaagatgaagcgccagttggaggaactgcaagggcaataataccgccataatacaaagctcggctgtaatcgttgtgattgcatgcgattacagcaaccgcaacgcctatagccgagccgtaagcgaggtttggcaacgtgaccaaagcgcgctctcaacaacgcgccacagccgcgaagccgctagaaaccaagtctggtgcggccgaactggtcaagccagcgcagaatcgcgccttcacgcagcgcccacgggcagatttcgatttccttgacgtcaagcgccttcatgatctcatcgatcaccaggccgccgccgacgatctgatacgtgcgttccggcgtgacgcccggcaatgcggtgcgctggtccggggcgatggccgcaagacgcggtagccaatcctcgagctggtcgatcgtcatgatcgacgtgtccacacggcccggttggcgcatcaccgcaccggcgagacgggccagggagcgaatcgtcttcgacgtgcccacggcatgcatcggatgcttcgacttggggaacgccttgaccattggctcgaggatcttgcggatgttcttgcgggcagcttccagattgtcatcatccgcgacgccgctttccggcaggaactcgcgcgtcacgcggcctgcgccggcaggaacggacagtgcgactgtcggatcctcgtcggagcccatggccacttcgagcgagccgccgccgatgtcgatgacgagcaaacggccggcatcccagccataccaacggcgggcggccaggaaggtgagtcgggcctcatccacgccggacagcacggtgaccggctggccgatggcctcttcgatcttgcgtaggatcttgcctccgttcggcgcttcgcgtagtgcggaagtggccaggaccagcagctgggtgatttcgtattcttcggcgagtttcatcgccttttcaaccgcgctgagcaaggcttcgatgcctgcttttttgatgctgccgtcatctttgagatactgcatcaggcgaatggtgcttttggtgctggcctcgggctcggggcgcgcgcccggagccgcgtcgacgatgagcatgtggacggtgttcgaaccgatgtcaagcacgccaagtcgggtggcgtgcgaatgcaatgtaaccatggttcacagcttaataacttaagcgattaacctattgcacgacatgccttgataacctttgcaaatatgcccaccctcggaaaggagggtgggcacccaataatcacagtgcgggaaacgattgcatcggcgtgaaaaatcgcgcttcaggcatatgtttcagccgaatatctcaaccacgcacctcagccacgcactttggctacgaaatcaccgagtcgcttcaatccttcgcgcagggcttcgcgggaagccgcgtacgacaggcgcacgtgcgtatccgcggtggcctcgccgaaatcgcggccaggcgtcaacgcgatatgcgcttccttcagcgcacgttcgcagaacgtccacgcgtcgagaccggtgccggaaatgttgaaatacgcatagaacgcgccattcggctcaacctccagcggcagaccgatctcggccagaccgtccaccacaatgcggcggcgctccagcagttcctgacggcgttcctcgcacacggccagcgtttccggcgtgaagcaggcgagcgccgcatgctgggtcggcgtgtgcgcgcacaggaagaagttggtggcgaggtcgtccatggcttcgagcgcgtattcgggcacgaccatccagccgagcctccagccggtcatgccgaagaacttggagaagctggagcagacgatggcgtccggatcgcaggccagcacggatttcacgtcggatccgtccggttcgcggtcggccaggtcgaggtaggtctcgtcgacgatgcgccatgcgccacgctcacgggctaggtcgcacacggctttcagggtgtcgaaggcgatggtggtgccggtcgggttggacggcgaagtgatcatgacggccttggtgcggtccgtccagtattctttgcacagttccggcgtcaggtggaatcgggtggcggcggacgccggcacgtccacgactttgccgccgaacgcgcgtaccagctcgcggttgcacgggtaggacgggtctgcgatgagcacttcgtcgtcatcgttgaccgtcagcgcggcggacagcagcagtgccgtcgaaccgcctgcggtaatcgcgatgcgtttcgggtcgacgtcgacgtggtgacgttccttatagaaatcggaaatcgcctggcgcagttccggcaggcccatcgccgcggtgtacggcagcggacggccgtcatactgttcgcgcatggcgtcacgcacggccggcggcgcgccgaagtccggctcgccgaggctcagcttgaccacatcggtgccgttggcgatcatctcatcggccatggctccgaacaccatggcgcggaacggattggcaatctgcgcgcgcttcgacaactgcggctgcacgccattctcaacattttccatattcctgtttttaccacgtttcgtacaacgccgcctgccgactgtcattccccggaatcgtccgcctttccggaatcgtccacgatttcgcggtaaagccgttccaaccgttcgtcgcgcaccttcttaccgagctcgcattcccacaccacgatgactttccagccgtccgcttcgagttcggcgcgctgcctcgcgtctcgttcgtgattgcgcagcagtttcgcggtccagaattcgacgttcgatttgggcacgcgtgtggctttcggacagccttcgtgcatgtgccagaagcagccgttgacgaatatgatcgtacggtatttcggtagtaccacgtccgggtggcctgggtatcgcttgtcgtttttgcggaatcgcaagcctttggcaaacagaaagctacgtaccatccgttcgatggatgtgtctttgccgcggatgtgggacatggtgtagctgcgcgtgccccgctcgtatttttcgggtttgccggtttttctaggtttgccggttttcttgggtttgccggtttttccgggtttggctgtctgcctgcgatgctctgccgtcacggcttcccattatggcaaaagggccgatcaatcgttttcgcataacgcgtgccgccgtcgcatgtggcgtacgctggtcattgcaacgtagcaaacaggcagttcaaaacaaggagatttcatggcacagatcaatgtggcgattctcggcgcgggccgtatcgcgcagagcatggccgaaacgttggtgaaaatggcggcggatgaccggtaccgtgatctggtcgcaccgtacgcggtggcggcccgcgacggcgagcgcgcagcggcgttcgcggcgaaatacggttttccggtgtcgtacggatcgtatgaggagcttgtcgccgatccgaacgtgaatcttgtgtatatcgccactccgcataacttccatgccgagcaggcgattttgtgcatgcgcgccggcaagggcgtgctggtggagaaggcgttcggcgcgaacacgcagcaggcgcgtgagatattggacgtttcggatgagaccggcatgctgtgcacggaggcgatttggacgcggtatatgccgtcgcgtggcatgatcgacgatatcatcgcgtccggcgtgatcggcgaggtgcaggcgatcgacgcgaatctgtgctatccgaccacggcgaaggcgcgtatcaccgatcctgcgctggctggcggcgcgctgctggacgtcggcgtgtatccaatcaatttcatcgacatgatcatgcataatgcgccgatcgcacgtgttgaatcgtcgatgcaaccgtatgaaaccggcgtggacgcgcacaattcgatgacgttctattaccagaatggtgtgatggccaccgcgcaaagctcgattctgtgccattcggaccgtatgggcgcggtgtggggcacggaggggtatctcacgtgccagaacatcaacaatgtcgaggcgattgacatgttcgacggctcgcatgccgtcaccgcgcattatgacgttcccgaacagttgaccggctacgagtatgaggtggcatcgaccgcacaggccatgctggacgggcgtaccgaatgcgatgagatgccgcattccgacacgttgcgcatcatggaatgcatggattcgctgcgtgcggattggggtcttaagtacccgttcgaagcgtagcgatgcgatcgatgacgtgggcgtgacgcgctccgcccacgttataattgccccttgcggcggtttggaaacgcatggaaggagcgtcatggaattgctgaggatgctgaagtacgtgctgggcacggaagatgagacgcagcagccccggcaaacgcaatcctctgccaagaatgccaacaacgccaaacctgcgcggaccggacagaccaagcagacgggacaggttgcgcgacgagtcacgcaaccgcaactgcaaccgcatgccacgccgcaacgtcaatcgcaacgccgtcaatcgcagcaacaccaatcgcaacggcctgcaaagctcaccccgcaaccgctgttgccagccgaccgcatcgacaaagcgcgtgacatcatcggcaatatcgaaaagcacgaattgagcgacgagcagatcagcgcgatcgccggcgcaggtcacaacaccctcgtgcttgcgggcgcgggaaccggcaaaaccaccaccatcatcggatatatcgcatggctgctcgccacgaagcgcgccgcccccgaagagattctcgtattgtcgttcaccaaggcgtccgcgggcgacatgtcgcaacgcatcatggcaagcaccggcaaaacgatccgcgcatgcacgttccacagtctcggcctggaaatctgccgtgcggccaccatcgccaaccgtcccatcatcgacggccatgcgtcgaacgccgtggtacgagacacgtttgaccggctgctcgcacagaacatcccctaccgtctgctcgcattcaagctcatgtcgaaggagctgttcggcaagtatggcgccgccgcgaaacgtgaggatttccaactgccgacggatgattacgctttcaaccagtacaggcaaagccttgtcgaaaacgcgcagaccatcatccagcacatgcggcagaacaatatcggcatcgacggcatgcgcgagctcaatgagaggcgcggcggcaaacatatcggccgtaatcgtgagatgctgcagctcgtcgagccgctgtacaacgcgtatgtcggcaatttccgcgcgacccagggcatcgattttcccggtatgatcaccgacgccattcgctgcgtaaggcgcggcgcgtaccgtcacctgtacaaatacgtgctcatcgacgagtatcaggacatgtcgcggccacgttacgagctgatccgcgcattgcgtgagcagagcgatttcacgctgttctgcgtgggcgacgactggcagtcgatctaccgtttcgccggcagcgacattcatctgattctcgatttcgccgatatttggcgcgattgggggccgacacgcatgttccagatcacgacgacgcgacggttccggcagagtcttatcgatgcgagcggcgcgttcgtcatgcaggacaaaagcctgtacgccaagcaattgcgcaatccgagcgacaagaaggattattcgctgaaggcgcttggcggcgcaacgcaggaggagcgcttcgacgcgatcatcgagcagttacgcaagctgccgaaaaccgcgtcggtacttatgctgggacgttacaaaagcgatctgaatctgctgtcacgcaacgatcgcgacggattgttccagattgacgagcacactggtggcattgtgttccttgagaagccaaagatggatatcgagttcatgaccgcgcataaatccaagggtctgcaacgcgacttcgtttttctgctgtgctgttccggcggtttgaaaggcttcccgagcgcgattccggaagagccgctgctcggcctgctactgccggaagtggaacgcatgccgcacgcggaggaacgccggctgttttacgtggcgatgacgcgttgcaaaaagaagctgtttttcgtggtggaccagtcgcgtccgtcacgtttcatgtacgaattgcacgacaagatctgcccgaacatcttccgcggcgtgaagctgccaccgcagtgcccgaattgcggtgaggcattgcgattgcggcacaccggctccgacccgtcccgcacgttctacggttgcaccggcttcccgaattgccggttcacgcagcagtgcaagtgaaagagtgaacgaacaagacacatactccttttgtgtcgcacgattctatttttcggctcttttttggaatcgtgcgacaaacattcggcgacacatacccccaaaccacgttttccaagccaaaaacacatgaaagatacacttagaaggtatttgtggggttcaatttgtgtcacgattcaaaatttcaccccaaaatcggaatcgtgacacacgtatcacactccctgtcgcatatttcgccgcgcatctactcaaattgagcaagcaacgtttatcctggaatcaacaggatggtgagaatggcagaacggaataactggacgcgtgaacaaaccatgatggcgttcgcactgtaccgaatcctgccctctggaaaatgggaccagcataatctaactattcagaaactcgcagaccatatccatcgttcgccttcagcagttgttttcaagctcggcaatctagcctcccttgacgagaacaggatgaccaaaggcctaaccaaccacagcaaattagaccaaaaaatatgggacgagtacgcggaacgcggcgatgctccggtgttcgaatctgcccagctgctggcatcggcattgaacggcgcggacgaccatcccgacacgcacgccgattccgtcgtggaacaaatcgtcgcgccacgagtcggctacgaccgtccggctgtggtcacagaacgaatcaaccagcagtatttccgcaacacgcttgtccacaactaccgcgaccgttgctgcatcacaggaatcgcgatcgacccgctgctcatcgccagccacatcaaaccatggaaggattcgtctccaacggagaaagtggccgcatcgaacggcctgttgctgaacgcgttccacgacaaggctttcgaccagggtctgatcaccctcgacaacgatttcgcgattcatgtctcgccgcacgtcgagcacacggagatcaatgacgaatggctgtaccgttacgatggacggcgcatctccctacctgtcgtctgcagcccatcccgagaattcctcgaattccatcgagagcatatttatcaactttgattccgaagcacccctacaattagctatcacggtaatccccgacgaggaggaatatgtctaaaacagcgaaatcagtcaaagcgatttgcaggaaatacgataagttcctatgcgtcgaatccccggactcaaatgcactgcttttcccatcgattgcagtttccagctttcgcaagcccgatatagaacaggcgctggaaaagcttttggaaatcacaaataatgacgagctcgcaatcagcaggcagctcgccgaaggacaaagtacgaatccacgttattatctttgctattgcgattacgaaatcaacgtccttgccaacggacagcgtgccatctggctcactcagcaagaaatggcataccacaagtggattccggaagaccagaagatggcagaccttgtcatgtctccgcttttcgaaaaaagtccctatacaacgaagacagcagtccaactacgggccaacgatgcggttggcagaacattggaagaaatcgatttcaacaacaccgaaaaacaagggaataaaagctatccaggcaatgtaattgaacatgtctggttcgaccatcccgccgacaacatttctgcccccgatttccccgaggctgaagtcgagcttaaagtctccccaatcgatatcaagaaaagcaaggatggtccttcttgcattgcaggagaaaggctagtactcaataccatcaattacgctaaagaaagcactgccgatttcaggacaagttcgttttggaagaaaaacagattcattgaattaatgcagtatctgcgtcgaatcgcctcagaaaaagggcagtctgaagataagcgcaaatataagatcgaatatgcccaccttttagctatggactgttttgcagaacccaattttccgcaaaacagtctcctgcctctcagcgaagcgaccatgctcagaatcgaacaggattggaacacgattcatcagttcatagtcgaaaaccgggcggatgaactgaccgaaggtatgaccgatacccttgcagcatgcactaaaggagcgaataacaaacagaaaagcaggcagagcaatggtgcaagagcaaaatccagagcttactgtttcaaacaaagtttcatgacgtcacttttacaaaactatgcatctgatgtccacgaaacgacttctctcatcaaagatataaagcagctgcaaaacagaagctgcgatagcattattctggattatttcaacccttttaaaggaaaatcatttacggaaatcgcggaacaattccatttcaccatacctaaaaacgcatctcctaaacaaactaatttcatgctggttgagcatatgcttggttcaaataccagtatttccaaagaccccaatgatgattacgtatcgtttgacgccgaagagcttaaaggcattcgagtcaaaacgctgccgcttttccatggaaaaccttccgaacaatttaaggtccaatccattcccgatttcaacgatctaatcaatcaaaaatgggataccgataactgcgccctgcatcaacttctggaaaccacaaaattcctcgtctttgtttttgacagccaaaaccccaatgaaaaagacaagaatccagaaaacatctactttaaaggtgccgcattttggtatatgccggcatccgatatcgacatagtcgaacaagtctggaaggaagacgttgaaaaactcagaaacggagtgactcttcgatacaagggcaatcgagtttacaataacttcgtcaaaagctctgcacatcgcgtaattcacatgcgtccggatgcacgcaaagcacagtacaacaagccgacgctccgtgcgcaaaattcccgtaaactgcccgcaaaagcgcactggataaataggcctgccgaccatgaacgctatacggaagaatatatgaccaaacaggcttggtggattaacggagcttatctctatagccaaataaaagacagactataagcgtttgacggacactgcccttgcatggcaaagtccgccaaacacccgttcctaccgagaaccataagcccggaaaccttgggattccaatctttcattcgatttcgacattaaccgtctttgcatgggctttcgctatgctacgtcgctcattttcgataatagatcgaacgtccgcaagcaaatcatctgtcacctcaggcttcaggacatcaccatcgatggcttcacgcatccttcgttctttgtatttcaaacgtttgtatacccggctatcgataaaaccatattccgtcggatcattaatggtttccatgatgtgatagcgcgtatattgaccatccggtaaacccaaacgatggatacgatctctcgactgcaacatatacgtcagattgaaattaaattcaaaataaacggcatcatgcacaacatcttgcaacgaaaccgattcgcccaacgtctgaggattggatacaagcaccgcaggcccattcgggttacggaaatcagcaataaaatctttacggacatccactggagtctcgccataaatcaaacgattatctatatcggaatcatcgagacgcgaggaaatcttttgcaaagtattgacgaacaacccccaaacaataaccttcttaccctgatttacaagatctcgaatcagcttcagtccttcttcgaacttcggcgatttcatattatccaaatcaaaatcttcataacacttattcgaaagaatcggagtgacggccgtttcttcatgcattaatgcccgattgaaggtcttctcatctatttcttcagaatactctccattggattccaaacccagagttcggaaatcaatcttctctttcagtaaagaaggatttgttgatgcttgcataagcctaatcaactttgccaaactggatttttcctgcgtccaaatcgcgagcgccaactcaagttgtccagatgaagcgggagcttcaataatgtcatcagggtcagcgggcggtaccccaagttggcccttattcgttctccagaagaatgggtacagcttttcattaatccgatcgactaaatactgatttgctttcgataattcaggaacgtcccagccaaagaaaaccggatattcttttttgtacaaaagatgcaagaagttatagatatcacaatacgaattaggaataggcgtacctgtcaatacatatcggaaaaatgctttatcgcacaaatccatggcggcagttgctctagttgcattaacgcctttaatcctatggacctcgtcaaaaacaatcattgtttgcccatcaatcaaatcgataagctggtcatggtatttcgggagggattcataattgacaaggaccaaattcgaaaccgcccatcgtctacgtaaatcgccgtcaaaatttccatcctgaacatcaacgactcgcagctttttcttaggaccaaaggtcttttgaaattcgcttttccaggattcgaaggcgttgattggagaaaccaccaaaatcctgctaacgaattcaccaaacttagccttaccgctattgagataagcgaatacgcccaagaccattgccgttttaccggcgccgggaaccgaaaaattagctgctcgtgccatcttgtacatatagaaagccgactgcaaatgcaaagtcttcaatggacgacttactgattctgaaataacattacggaaaagtgcgaactcatcttcgaatcgattaacattttccttaagagcaacgcccatgtatcgatactgttcaattgaatatcgttgctgtttcaaatcttgttctatgcgcggatcaatccagaaggcaactttgccttccgctcttttccgagttttctctagacattgttcaaccacagcatagggaagatcatcaagcatttgatgcgaatgctctttaaaatatttccctccccaatctcctcctattctcaaatgtctgtctcgttcggatctctgctcttctgtggtatcaatgaaccagacgtctccgtccttatagataaaagcccatccctcaaaaccttcaggcaactgcgaatcttccttctgatcaaccatgccgggacaatcctccattccctgatattgagcgagttgttcatataccaaatcactcacgtcttcggtaatcaccccatcttcgcgagaagaccatagccgaccaaaccgatcaacctccgcttgcagacgctgcctgacacgactgctctcatcccaacttacatccacaataatcgactcataattcgaactgagtccgcctgtcgattcattcgcggatcccgaaaaaagaactttatttccttccgaatcctccagtaacccgaatttgtcgtggaagattcctttgccctccttcaaaaaggcaattttcacatccgctttttcttctgcaatcagttttgccaacaaccctaaatgcttttgatcaatatcatcggcatcctgacattgcagtttttccctaagacgattacgccactcatatccttgttttatttcatcaaaatcggtctcgctgatgtgactggatagcaacagctgataacgaccatcattacaagccaattgctccagcccggcggcaagtagctgaatccctttaagagaaaaatatgccgataccctgcaatatcgtttcgcctcagacaacgttggaatcagaaaagagtcaaccacctgttgatccgttgtctgatactgcgtatcaattttcagagacaagaagctcatagcagattacccgtctgagataaaacatcataatccttacgaacgatcattccgattttctccaaatccgcagccacgtccttggattgctccaccgtaaggttttccaaagtagcagtatcaatgctttcaagcgattccacacacgcacttacagtttcgactactttttgaagctcgcctctgtactcgttcatctttcccaaacgtcgactagaccgcataaaatcattcgacgcagccttaatcccttcgctcgaattcagaatctgcgaaatctgagatgcatcagagacaggtgtatcctggaaagcatcatatatcgtgtcaacattgtcttccgtaagacaaacccaatcatccttcttggaaaccatggattgaagctctttacgaataagacgtgtgatatctccaccctcattcgcatccgtcccagaataatgcatcgacagcaaagcgaaaaccgcactcttgacttccccatcgtcaagtagcttatttttgtcgagaacccttctcacctcattcatcggtccgtcaagccgaagctctttggcaatgtaataagcgtccctcggagcaccaataaattcaagatacgaagaaatcagcttcgcttccttaatatcgttgtttattccccttgctcgttctttgccgatacttttcgcatactcctgaggagtcattattttttcgacgtaaacggtgttatacacatcgaaaattcgatcgatcggatcatagtcctgtcggtcttcttttcccatctgcaaatcaagctcaagctgcttgattgtttttttatcaacagaattggtgatatcaaaatcaagaatcgcagcttcaaagtattgttctatgcctttgctcttttgaattcggcgcaatgccgtaaaccggcgattgccatcaatcacacggccgtcatccagcacgacaccaggctcctcttgacctctatctgaaatcgattcctgggtcgccttcatgcgctgttcattcgatttaaagataaaactctcaaacaaatcgttatactcaggattttcatcatccaaggcggggttcaagaccacctctggatgcccactaacgtatttttgaagagctgtactaattcgcccattttgattgttgtaataaaggtatttaaggggaatacgatatatggcctcaagccgctgcactccatctatcgtgtacttacgtctcgcgtcggtcaatttaatcagtccatcagcagcgagcttcttcaacgaaatcatcgcaggcctttccctttttccaatacttttttcctattgctttcgcaaagcaagccataaatattcaatcaaatatactatggccaagaatttgatagaggaatatcatcaaatactcgaatcatgactagcacgaatgtcttcaagacaatgcttcgcctgcttgcaccaatttcatttcacattgccgttcactttttgattctcacgaatcagttcggccacataatgtcgatcgagccagaagcattgcttggtaatcgattcgccattaggcagacgcgccacgtcatcgctgttctgccctttcggccttaaatggcagactccgttgaagctcgctccaggaagtaaattggttcctcgtccgtaatgtaccgacccaccgctcagcatcaattcatgcagccgctcccagaccggacggacatactgttcgatatccttttccggcatattccaaaggaatcctccaacaagacggtcattaccggccacatgttgcgaatacggtaccggagatttaaatgagacaataaagaacttgttctcttcgaaatactcgtacaggaacgagtcttcccatttcgcatcaaaggatgctagtccctgccactcttcctctgtaatctggcgaaaagacatgttttccttcgggagcccatccggatacaatacgacagtcttcagcttggtcacattggccttgcggaattgttcaatcgtatcgacgctacgcccttccgcaccaaccattttcatgacgagccggctcttgctggctttcgaatccgatttcgaaatacccaatcgaagagcgatgtcatcaacacttctcccgatgtacgggctcatttgttgccacaggaattcagaaagcgtctggttcgacggaatcggcaaactgtattcctcaatgcggcttaccaaagcacgttcggcaatcgacgtcatgaaagatgatttgaagctgaacgcacgctgtttcgcacgtatccgcgccttaccagagccggctggcgcgggagcatctctcatactggaagcattcgcacccttcgtgcatgcggcaagatagtttgtgtccgattccgaaagctgatttgcatgccccgaggcaactttctcgtgaatcgtctcccaatcatctcgaatcgtcgccaaatcgttttcatcataatgcaagacaacagatttcaagaccttgcagtccaagcgtgattgggttttcttgtcttcgcggtcatcgtagtagtacaccatgatgatgttcttcgacttattccaaaaccgggaatcttcaaaattttccttaggcagattctcgtaattgatgatgtcaaggacaagtctctccttggcaactgtcttcgtacgtttgcccttgccggaatgcttcagtggggtcactttaagctcataacgcgtatcgccaacgaggatatcagcctcagcatctgagttgacaggataatgcagaacggattcctcaatgatattgccaagcgagcccttgtttcctgccgaatcgccacgacctgtttcgtcaagttctcgaaaagtcttcccctcagctgcaatcaacagtttcgtgacttcttccaatgatgaaaaactacgctcttcgttcaacatcgaactagctcccacatctctttcgaggccattccaattcagccccaactcttttgcatttaaccaccgtaagccccttttataaacacgacacactgaatttgatcgattcctcatgattagataagatattggccagtagtatctcgaacgatcgttcggatcgcaagagttaaaggagcgcgagagctgtaatgagcaaggaaatcaaagtcgttgaactattcgccggcgttggcggattccgacttggacttgatggttacagcaatcccaagtatcccgatttcgagatgaagccagccggcaatttccacaccgtctgggccaataattgggagccagatgggcgacccaccaaacaattcgcatggcgctgctacgaaaagcgctttggcgaaggaagctgcgtcaatgaagatatcgcagtcgttgtcgaacaaatcaaaaatggcgaacgtgaattgccggaattcgacatgctcgttggaggcttcccctgccaagattattcggtcgcgaagcccgcaagtcttgcatctggcattgaaggtaaaaaaggcgtgctttggtggagcatcaacgccattcttgaaatgcgccacccgaagtatgtacttcttgagaacgtcgaccgacttctgaaatctcctaccgcacaacgtggccgcgatttcgcgattattctctcttgcctatatcgcttgggctattctgtggaatggcacgtggtgaatgctgccgattacggcatgccacaacgtcgccgacgcgtatacatttacgctgaacatgacgctccaaaatgggatttggaaaaccagctcttccatgtgggggtcgaagcacgagctttccccatcgaaccggatgagcgattcggagctgaacgtttctccgtcagcaaagacccttataggtccacgaaagaattcggcatcggagacaaaatctcacgattcaaggaagccggcgtaatgcagaacggtaaggtgcttacacgccgagtcaagcccatctacaacggcccacagcgtacgttgggtgaattcctcgtaccgatcgagcaggttccggaagaattcttcatcactggagacaatctcaagtcatgggaatatctcaaaggcggcaaacacgagaaacgcaccgctagtaacggacatgaatacgtctactctgaaggtcccatcgcattccccgatccgttggataagccgagccgcaccattctcactggagaaggcggccgtggagcaagccgcaccaagcatgtagtcatgcagaatgggcggctaagaagactcgttcccgacgagctggatcagctccagcgtttcccgaaaggctggaccgacgacggaatgacagacggacatcgcgctttctgtatgggcaatgccctcgttacggaaattccgcatcgcatcggcaaagtcatcgctgaagacaacgattcgaaacggtaaatcaaacgaattccggtggctgttggacggaacggaacgtactccggaatggcagaatcgccattttgtgccggttttcatccgtcgtaaagccgaggagcaggagaaatcctattatttcatcggcagcgcggttgcattggatgatgtgcgcgaatcggtgaaccgcagcgaggacggcagtgagtcaaaggtggtcgtttccacgctcaatctcatcaagccggtcgatccggagctctaccgccatctcaccggcaagtccgcgctgtaatccgcggtcgttttgcaattccttttgcctatctcgagtcggatacgccaggcacaagtgagtcgtccatcatcggcgtcagaaacacgacttatcaaaatcagacgcattcacacagaccataatcaactacacatgttcatatgaacactagagcaacacgaatttccaaaataaaaagaacacgctcaatgttatctttttccatttcttttaccccatggcagattgcctatattgcaacgaattaacgcacacaaccacaaatatggcttatcttcagcgatttcaacgcccattaatcgtgatatcgttattcatggacagaaaaactatccaccacacatgttcgcttttcatctaaagagaacacgaaaacaaacattactcatgttcacaaatacaaggtaaaaggacaaagccatggccgataagaaccccatcatcaccgtagatctcaacatgttcagccaagacgccgaggcgaagaccactgaagccaataaagtcgccaagagcctcggcatcagcgacgaggcactcgccaaagtcgaagacttcaaacgaacgcttaccgagcataacgcttgggatctgccgttcatgggctacgtgaacgaggacggctacggctacgcctacgtaccggacgcggccatcaccatgaatccctattgggacgcgcataaggaattcatgaatctgcccgaagacgtgcagaccgccttcgccatccgcatgctattcacgcatcgtccggtcgatcgctacggcgcggatatgttcctgcactaccaccgtggcttccaagtgaacttcatcggctccggcgccaacaagtactgatcgggatcgcccgaatagttctcgtgcacaaaaccattccgaaacagacaacccaaacgacaaggtggtttgcacatatatcgaacctatgcgcaaaccaccttcatcgactcatttcgcgccgctacagcttactgaccgtccgcataggcacccgcatcaaaaccgtcgacatccagaccatctgaaccaggaccaaattcccgtccacccggtcctccgaggaactcacgagcggacatgccattctccttccgggacgcatccacagcctcctgcagcacctgacgcacctcgaaaccgttaatcacgttcttcagtgccaccacgccgttgccagacgactggtcacgcgtatccagcacaagcgtgctcataccgaaaatacgctgcaggaacgtacgctccacactgatgtcaacgatacgaaacagcttgatcaggttgaatctctcattcaagataccggttttgacgctcaattcccgatcggtaagcgtgtatacggtgaatgtgaatggcgtacggcaccaattacgcttacgctgccgccacaagacattgccacttgcaaccttcataggtaattctctttcttacctgaccataacgggcctttatggacccgcctaagtccacggaatacgccacgactacgtgacgtatgcaacaacaatcgcaattctaccggccaggacacccaacttatctcgaatcacggagacagcggcaacggcacgaatcgcaatcacaaccaagagctcataataagcgcgcagaagtgtttcacagaatgtttcatgcatcgaaactggaactttcggcacgagcgccatatcatgctataggcttgggcgtcagtagcgaactgataagacatattcaaccacaacaccgcctcacctagatgcgcaatggaaaggcatgcaatggattctggacagggcagcttcaatcgcaggcaggatgccgacgatctcaccgattacgtcaacaacggatggctcagttccaacgaattcgacggaccgaccttcctgtggaaccacatgatacgcgaagccagtcgagaaggttccgaccaacgtaacgatgtgccggtcgccaatctttccgacgcggacgtggtcatcaccatgcccatgcaatggtatttcgacgccctcgcctccatggtgcctaccgcggaacgtaccgatacgggcgtggagattccacgcatcgatatgccgacgttttcgatcgattcgcaggcgctgtccggcgtggacgcggtggtcggcaacgcggtgatcagcacgcgatggcttgacgcggtcggcaatctcgccaaagctgtggagatgaccgcaaggttcgtcggcaatgtggccgaccgtgacaacgagggtttcgactacctgaaagatctgattcagaccgtacgcgtgtacatggatgccgtggcctgcaacgccgatccgatgacgggcgagcaggcgttgcgcatgatcacgcaggtggcgtgcaatgaggatttccggctcaacgccatgcagatggtggagctgctgtcttgcggactgtcgttcgcgcaatgggatgatacgcgcatgttcgcctatgacgcgttgaacaagggcattgccgcgatgcgtgatttcgcagcgaagtccggtaatggcgatgcaagcagcacgactggcgacactatgaacagcgtcggcagtatcgacagtgatgttacgggcgatacgggtgcacgcgacgccaccgcaacgcaatcgcatgaccttcgtgatacgtcctctgacgcggacagtgcgcatagcacgaatagtacagacgctgcggacggcgcggataccgcgaactcgatcacgcattccacgggcgctgccggcgattccactaccggcggttcgcccaccctctcccccgaggaactgaacgatctcgccatgcttgacccatcattcctgtccaaacagcagcttgcgcagaccgcgcaaaaccagttcgaccatgccgtgcagttcctgcggcacgatctgatgcggatcagtggcgatgccgaggaggccgatcgtttcctgcgcgacaaccatacgtccgagccgcttgccgacgcgtacgcggcgcggctgatcgctgccgaacggtggcaggatctgctgaatttcgtcgatctggtggagcgtgacgcaccgaaccagtgcacggtcatgttccccgaggaagtggtgccgtacgaatgggagtcgattcgtgaggccgctttggaggcgttgggccgcggcggagaactggtcgcgatgtatcaggagcggttggatgacacgtacgatcccaacaccgagctcaatcgtatgaagcttcaggcgtggactcaagccaaggaataggcggcgcacggctcagcacatccgccgccagtttctcatctatcgcaggcttccactctcattcccatcagtatttccaccatcgcttccacaactgacgcgcaacgtggccaattggaacggatgcaggctcagcatcgctccttgcgccgttcttgccacggacggatcaccgtcggcaaaagccgcgggcaattcggcatccagccgcgcatcctccataatggaacactcgcgtaccgtggccttccccaaagcggcgttgacggcaagtctcgcatgggcttcgccgccgaccgcctcatagacgcgcagtatcagatctccggaaccgtcatcggcaagcttgacccagtcaagcaccatgacgccatccaccgggttgagctgcgccagcggatcgaacgccggcacggcaggcagcacggccgcgttgagacggttcgcctcgtcaagcacagccggcatactggcatccgccacaacgttccacgcgaactcatgcacgcccttgtcagtgttcggatcggggtatagcggggacgacagcaacgaaagtcgaatcatcgtgccacgcaccggcccggaagccgtgttccggtgaatcggcgaaacgtcggaaccgtaggtgctggcgttgacgaccgcagccgcatagccggcatcggcgacgcgtacgaaccggtgcgtgcagctttcgtatttcgcctcgtcggaacgtgtgttcttctgaatgggccgttccaccatgccgtactggcattcgtactgcgcccggtcggcctggatagccatgggaatgtcgactttgaggaatcgttcggatgcccgccaatccactttggtccggaattcaaggcttttcgactttggccgcaatgtaatgcaggcatcgatggacaccccgtcggcggtgctggacacgtgcacggtggctccgccgcgttttgtctccgtcactcgttccacatgcgagtcatcgatgccttcggcgctgaggaaggcatcgcgctggatgtcccatgcgtcccactcgtatggctcgtcgcggagaagctcgtaatgcccgattccactgccgtcgggcaccagttcgtgtccattatcaaggtcgatcagtgaacggaccgtaccgtctggtgcgatgatggcacgtagcaaaccgttgtcaagtatgattcgaccgtcgtcacatgtcgttgcgatggtggattcatcggcgaccgcgtcggtgccgttcgcgtcatcatcctgcgttcccactgccgcggtgcgagcaatccacgaatcgccattctttgccgtatatgggacgatggccgcgttcgatcgcatgtcggcatcatcccgcgccgatgcgatggaagcacccgcttcagcggcgatatcacgcagtcttgtgatgtcgcgcacgtagtccgcacgtgcctgccgatgcacccatgcgatcgccgatccgggaagaatgtcgtggaattggttcagcaggagcgttttccagataccgtcaagttcctcacgtggatatcggtattttgggttgaacacgctggctgcggcgcacagatattccgttgttctcagcaggttttcttcccgcctgcatccgcgtttcatttcctgttgcgatgtcagtgtggcgcgatgcagttccagatacagttcacccttgaaaaccggggtttcgtccggagcctcatcgacgatatcgtgtcggacgcggtcgaacagttcgtccggagtgccgaaatcgatgctcggagcgccggcaagatcatggtccctgcggatacgtgcgaccatttcgcgggtgggaccgccgccaccatcgctgtatccgtacagcagtatggcgttgcgcgacaggtccttgtcaaggaagttgcgctgggaatactgcagttcctgcatacttacggtcgagccgtacgtgtccgacggcgggaagtgcgtaaggattcgcgatccgtcgatgccttcccattcgaaggaatggtgggggaatttcgtggtgtcgttccatgagatcttctgtgtgaggaaccattcgaaaccggcacgacgtgcgatttgcggccatgccccgcaataaccgaaactgtcgggaagccacagtccttttggttccacgccaagatgctcacggaagtaacgcatgccgaacgtgatctggcggatcagcgactcacctgtgggcagcatgttatcggattcgacccacattccgccgacgggaatgaatcgtccttccttgatgcgctgcagcatgcgcgcgaacaggtctggatgttcctgttccagccacgcatactgttgggcggaactcatcgcgtacgtgaaatccggatcctcgtccatcagggcaagcacgttggacaccgtgcgggccactttacggtgggtttcgcgcacgggccacagccatgcggaatcgatatgcgcatggccgaccgcgacatgatggatgacgctggaatatgcgggttcggataataccccggcaagcttttccttggctggctccagagttccggcgatatcacgctcgtcatatgtgttgagtgatcgttgcagcgctttggccagctgccaatatcgaggatcatcatccttgagttccctcatcagcgaggtgacggtttccaagtccatcagatagtcgaacacgttttggttgaaagcgcacacgtccattgtggtgagcacatagtcggatggacgaccgtcggcacgctcccccagattcatcggcgcgaatggcaggtcagcttcgaccagtggattcgatgcggcctcgacatataccgtgaaacgaccggcatcatcaagctccacattcgccacgccattggcatcgataagcggaatccagcaattgtctggattcaccgctttgatgacgctgccgtcagggcgatagcataatccttccgcttggaagcccgggccacgatgtcgtttccatcccagatctacaaccagttcgacggctctgcctttgaccgactcacggtcgatacgtccacgaacctcgaaccatgtggtaccccatatcgtgccccaggcaccaggaaccatgaagtcgagaaaatccactttgttttccctgacacgtgcaagaaagtcggcgctctgttcgggttcgccttcatcggcgaaagcgcgtaactgacaatgcgataatgtttcgtgcacatatggcacaagtcgttgccgcatcactcgattgacacgtctgagttgctgatctggaagaagaaacatagctatccccttggcacatgattcctatggtgtatccatggtgccacaacacaatctcaaatcaaaaaatatcaaagagaaaagtggttctcaaagcggacatccggtggagactccggataaggaccttcgacgagcccgaaaggcgttgccgggaggcccgggaggtgatgaaaaaaatgggggttcccggagcgacgcccgccgggaagcccgaaaagagaggataaaaaaggggcctcccgggagccaaaggctcgaccgggaggcccgatacgtttgaagcggcggcgtgctactctcccacaccctctcgagtgcagtaccatcgccgcgcctggccttagctaccgggttcggaatgggaccgggcgtctcaccagggctatgaccaccgcaaaaccgcgatcacggaacgacaaccaaaacatggcggccattccggccattcaattatcgtgtggcggtctgggaaccggctagcggacgcgaggcaaagcctaccgttgtatcgttcagtgaccatcccaacgcatattgccgtccaggacgatccagcacaggaaagacgcggaaccaatcccgcaaaaggatcggaatgttatgtcgccgtcgcccgttagtaccggtcggctccacccctcacggggcttccacctccggcctatcaaacacgtgttcaacatgcgggctacaacagttcaagaccgtacggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccgcgatggctggcgccaccgtttcaaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccggacgcaaggtccttcaccccagtgggtctcccttataccgaaggcacgggagtgatttgccgagttccttgaccaggattcgctcgatcgccttggtattctctacctgaccaccagtgtcggtttggggtacgggcggccatggccctcacgccgaggcttttctcgacggcctggacaaccggatatcgaaccataacggctcccatcatcacacctcgccatgcacgccatgcggatttgcctacatgactggctgcgtgcttgaccacggaaaaccacctccgcggccggctcccattccgtgtcacccctgcgctgacctactgcggctacgctcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggccggtttccaccgccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatcccccggttttcaacccaggtgggttcggtcctccacgcggtcttacccgcgcttcaacctgcccagggctagatcatcccgcttcgggtccaggacaagcgactaaaaacgccttttaagactcgctttcgctacgcatacgccacacggcttatgctcgccacccgccactgactcgcagactcatttttcgataggcacgccgtcaccccaccagggaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtacccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaaaaccatcgtcccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgatccgaccagccacccaggaccggccaccacgcatgggcatcgaaccgcgccacagaaaacccgtggggtggcggtccgggagcccaaaagcatacccataccactcccggacgggacgaatcccatccaagccattgatctcttccacaccagcatccacaacaacgacgccgactgccggcgcccatgtggctcacactgtccaaaaacatggactgtattctccgtagaaaggaggtgatccagccgcaccttccggtacggctaccttgttacgacttagtcccaatcacgagtctcaccttagacggctcccccaaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctcccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatagaatctttcccagaaggacatgcatccaactggagcatccggcattaccacccgtttccaggagctattccggtgtatggggcaggtcggtcacgcattactcacccgttcgccactctcacggccggagcaagctccagccgatcccgttcgacttgcatgtgttaagcacgccgccagcgttcatcctgagccagaatcgaaccctccacaaaaaaacttatgcggaaagccaacacgtgactctcatctaagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccactcacccacctcgcaatccggagtgaaccggaccactcgctgagcggcagcaagagataaacttacagcacgatcgcgatccgcgcaacccgggccgcatgaacaacgcgtgaaccgttggaaatccaacgttccatcggcgtgtcgaaacttgacaaaccgagaggcaaatacctaccgacggcgtccacagtgtttgccgccgatgccaaatttgccatccacgccccacggaccacgaccttcggcacgaagcacacccaagtgatgtttcatggcgaccaacatgatgtgcgtatcttccaaaccgaggtgacgttccgacttgctctcgtcaagcgcaccctggcgtttggcgtacgcgtccaacgtgttgttgccgtatgggtgctcatcgtcgggaatcgacccctcatcccaacggcggctcatcggcaacgtgtcgatgatcgtgattttgccggcacgatagctttccgcatatccggccacgttcagcatgaagaagctatgttcgaatcgtgcgttgtgcgccacgtaaggctgctgctccaatcgctgcagcaatccgatctgcgccgccggccactcatcgaacaagcggaacgaggaagcggcttcggcaacggaacgcgtgcgcacgtcgataccggtcaagtcgagaatcagcggattgccaagcgcagcgttttcagcggggacgccgaaagccaaccgcgactggccgtaagcgtcgcccgcctcgtaatagccttgctcgtattggtagccagccggagcgtccgcaggccgtggggaaatcatgttcatgtattcgaatccgacgtcgatgatgtacacgcgcgccggatccgtgcccgtggtttcgatgtcgatgcccatgacgttgtccacgtcacgaccgggcaggtaagcgtcacgccaatcggacttgcggtattcggacaggcggctggtctgcttttgatcgacggcgttttcctgcgtgccattcgccgaaccggtcgaaccagaaccgtaatcgaacaatgtggaaccgccaggactggtgacgccacccagattcgcgcgagacacggaatggtcgctggcgtgcttctgccttttctccgcggcgcgacgggccgcacgagcgttgacgatgtctgcggtgcaatcctggatatcatccagcaccactcccccggcagctgcggatgaccccgattgcagcaccgggaccgtcacccgctcacgtcgttcttcggtaatcgtccacagtcccatggcaacgccgatttggcgcaacaccgcgatctcgtcgcacaaccgacggttcgcataggcgagcgcgcgtggcagacggtacgaggtgatgagtcggtcgaaatccgtcatgaaagtgctgttgcactgcgcgatgacaggttcgagccggtcgcgaatcgcaagatcatctttcagcaggtcatgcagctgctgcgcgaacggtcgggcagacggctgcgatgtcgaggacgattctgacgtaacattgccggccgacgcggtacgaagcgccgacagcaaatcgatatgctgctgcgcggcgacgccgatgccgtgccgtaagtcgagggacgctatccactgccagtcgatcggctgttcgtcggcgtctttcggcatcgatgccgaccattgcccgatgtcctgtttcgcatcgtcaagccagggttgattcgtcgtcgattcgctcatacctgcacatcgtagccgatgtccaccttcaattcgcggaattcgctggcgaatccaatctgtcgatgattcgtagcggcccgcaaaatacgggaagcgtctctcaggcgtttgcttgagagacgcttccacttgttctgacacacggctatccggctattcagtcattcggcttttcgcttttcgtccgcgcgaaaccatgaccgtaatccgcgcgatttgaggctactattcggttacagttcgaagccgagttcggccgccgcttcggtcggtaccggatcctcgcaccagaaatcctcaaggttctcattggtggtcaggcttcggatttcggcctggtcgatgtacagttcaccgctcaaatggtcggtttcatgctggaagatgcgggccggccagccgtgcagatgttcctcatgcttgttgccgtcctcatcctgccaacgggcggtgatgtcaagccaacgcttgcgtacggcctggtaaccgtcgaagctcaggcagccttcgtagaagctgcgggtttcggtgccgatcggttcgtagctggggttgatgatggcgtggaaggggaattccgcggcttcgcgcggatcgccatcgtcgccttcgcatacgtggtcttcgacgacggccaaagccagaccgagaccgatctgggtggctgcgaggcccacgcccggcgcttccagcatggtggtgcgcatggtgtcgatgagcttgtcaagcgttttgcggctcaactggccgtcataggcgatggtctgctggcgtaataccggttcgccggcctgcacgatcggcatgattttctctttgccgccggttttgatgagcttttcgacctcgcggttgagttcgaggtccactttcgagttgtgtccgaacatggggcatatctccttgcgggctcttacagggtgagttcgtcggcgacgaccttggcgaggcgatcgcacacttcgtctgcctgctgctgggtttcggcttcggccatgacgcgcacgagcggctcggtgccggacggacgcagcagcacgcggccggtgtcgcccagcagcttctcttcgcgttccaccgcggcctgcaccttggcgttggtcttggcggccatcttgtccacgttcggcacgttgatgagcgtctgcggcagctgcgggaagtcggcggccagttccttcaggctcttaccggatttgacgacctcgttgcacagggtgagcgcggtcagggtgccgtcgccggtggtggcgaattcgcggttgatcacgtggccggactgctcgccgccgagcgaataatcgcctcgcagcatctcttcaagcacgtaacggtcgcccacgttggtctgcacggtcttgatgcccatggaacgcagggccaacttcagaccgaggttgctcatcaccgtcacgacgagggtgtcatggttgagcttgcccgcgttcttcttggcgcgcgccagaatgcccatgatctgatcgccgttgaccatgttgccgtcctcatccacggcaaggcaacggtcggcatcgccatcgaaggcaacgcccatgacggcgccggaggccttgaccatggcctgcagctgctcaggatgggtggagccggcgttcttgttgatgttgtagccgtccggcgacgcgttgatgacggtcacgtcggcgccggcgcggcgcaaggcttccggagcgaccacggacgtggcgccgttcgcgcaatcggccacgatcttcaggcccttcagcggcgtcggctgcgacttgtccggaccgaccggcgcgatggcggaaaccagatggtcgatgtacaggttggttgcggtggcggtgtcatggctgacacgacccacgccggcgccggtaggacgatcccaatcctggccgagcaccgcttcgatctcgtcttccttggtgtcgggcagcttgaagccgccgcgggcgaagaacttgatgccgttgtcgggcatcggattgtgggatgcggagatcaccgcgcccatttccacgttgagcacggacgtcaggtatgcgacgcccggcgtcgggatgatgccggcgtcgatcacgtcgaagccgccggcggacatgccagcggacaatgcggcggcgaggaaatcgccggaaactcgtgtatcacgaccgaccagcgcacggcgacggctttcgaattcgctccgctcgtcatcgcccagcacgcgcaccgcggcgtcacccaaatcaagcgccagctgtgccgtcaaatccctattcgccaatcctcgaacgccgtcggttccgaacatacgtggcatgagtctcaaatcctcgctatctgcaaacgatatttccgtgacctatcgtactcaaccgtgccgccgaaaccagcaggtgacgacgcaatcgcataacacttcacaattcaaagcatttcacggcgcgcaatgcccttttcgtgtcgcacgactttgatttcaaggcggaaaatcaagtcgtgcgacaacacttgataaagaaataccccctaactatcattttccgttgaaaatcagcgaaaaataagagttagaggttatgaaagccagcacgcttgtcgcacaactttgaaaaatgcctccaaaatcaaattcgtgcgacagccttcgacgcaaaatgccccctaatccttattttcaagcgaaaaccggggattagggggcataaatgccgatatacccgtcgcatgactttgaaaatcgcacccaaaatcaaagtcgtgcgacgacatgacggactctaagcatgaacactccggtcgttccggtttccagacggaatcattccgactcttaaacggaatcatgccggcttggagtgtgcggaacgttcagatcgttcgaatcgccccacatactccaagcgccatcagaaaagcgctatcagagcgcggcgttgaagtcgcgtactttcagcgtgcggtgagaagcctcgacgttgccacgcacaatgcgctgcaaggcgttgtccgcgtccttatgggaggcgagccaggcgtcacccagctccacgagcttcgccggatcggcatagcccggatacaggccttcgagcagcgcttcagccatgtggaaggtcttgtgctcccaaatccagtcggcgacctcgaaatacttctcggcgtacggttcggccaaatcggcgcgcggggtggccgcaaagccaccggccacagcctcgagctgcatgttggtcagctcgtcgttgtgcagggcctcgttccaagcccatgccttcgcttcggcggtaccggccacggcgcgtgcgccataggcgaactcacggttctcagtggtttcgcgcttggccagttcggcgtcgattcccgcctggtcgatcgcgttgacggtgctcagcgcgttgatgatggtccagcggaagttgttgtcgatttccagaccgtcgaatgccacggaaccgtcgagcaggcccttcgcgttggcgacgaacgcctcgtcgcccggctcgccgtagcccaggtaggcggtgacgagctggaactgttcgtcggagccggccttggcccaacccgccagcttgaacagttcggcggccacgtgcttcacgatctcggcacgctctgccggagcggtgtaatgccatgcggtggtgctgacctgtgccagcgcgtaacggaaggtggtggactcgtgttcggtggcgagcgcggccagcgaggtgtcgatgaactgtcgtgccggcagttcgccgtcgcgggtcatgtcccacagggcgagccagagcacggaacgggcgagcgcatcgtcgaagcggtacaggttgcttgtcgcgaatgcgaggctcttgtcgtcgaaacgcagcttcgtgtaggtcaagtcgtcgtcgttcaccaggatcagcgacggacgtgccttgccggcggcagcatcgacgaccgtcagttcgccgtcgacgtccagttcgaaacggtcggtgcgcacgatcttaccggtttccggatcctcgttgtagaagccgacggcgagacggtgggcgcgcagcacgggatgctcggccggagcggtctggcgcagggcgagacgcttgatggtgccgtcctcgttctcttcgacttcggtggcgatggtgttgatgccggattcctcaagccactgggcgctccacgccttcaggtcgcggccggaagtgagttccagttcggcgagcaggtcggcgagggtggcgttggagtaggcgtgcttgttgaggtagttgttgatgcccttgaagaacttctcacggcccacgtagtacacgagctgcttcagcacggaggcgcccttggcgtaggtgatgccgtcgaagttgacgtaggtgtcgttgaggtcgttgatcggggcgacgatcgggtgggtggtgctcagctggtcctgacgcagcgcccagctcttttcgccggagctgaaggttgcccaggcgtccttccattcggtggcttcggcggtggcgagggtggacgtgaactcggcgaaggattcgttgagccacaggtcgttccaccacttcatggtcacgtagtcgccgaaccacatgtgggcgagctcgtgcagcacggtgaccacacggcgttccgcgtaggcgtcggtgaccttggattcgaacacgtactggtcgcggatggtgaccatgccgatgttctccatggcgccggcgttgtactccggcacgtagatctggtcgaacttggcgtacgggtacggcacgccccaggtcttggcgtagaaggcgaagcccttcttggtgatgtcgaacaggtagtcgacgtccttgctgaaggccttggcgagcgcctggcggcagtacatggccatcggcacggtgcggccgtcctcattggcgtattcggtgtgccattcggcgtacggtccagcgcagatggcggtgaggtaggagctcatggtcggggttggttcgaacacccacagcttggtggtttcggcggcgtgatcgccgagcgtgccttcctcggtgacggtttcgttgtcggtcacggaggaggtgggcatgttggacgtgacgatccaggatttggctgcgagcacggagaagtcgaacacggccttcaggtcgggctggtcgaacacggcgtagacgcgacgggcgtccggcacttcgaactgggtgtacaggtagacgttgccgtcggacgggtcgacgctgcggtgcaggccttcgccggtgttggagtactggcacatcgccttgacggtgacctcgttgtgctccttgaggcccttcagctcgatgcggctgtccgcgtatgcttcggtcgggtcgagggtttcgccgttgagggtgatctcgctgacttcgttggcgatgaggtcaaggaagcttgactcccccggcttcgcgtcgaaggtgatggtggtttcggagccgaaatccttggctccgcgggtcaggtcaagcttgaccgtgtaatggattggcgcggcgatgatgcttttgcgttcttccgcttcgattcgggtgaggtttgctcctggcatgtcactccttctttctggtaacagaaggcggcgcgatcagttgtgccgatcacgtcgccttgattcaatttatggtaaatttacggcttatttcgcggcgttcagtcccatcgcgtcatccacgtcctgcgcgatgtcggcgacgacggggacgatcatcggcttgcggtgcagctgtcgtgccacccagccgccgagcgtgcgtcgcatgatctgctgcagcttgtaggtgtcgcgcgtgccctgcatcatcgcgtcctgcagctgctcgacgatctggtgacggaccttgtcgaactcgctttcgtcttccgcgaccgcgttgaggtagatcttcggaccggtgatgacatccgcggtctcggtgtcgacgaccacgaagctggacacgaagccttcggtgccgaggatgcggcgcttctcgagttcttcgtcggtcagttcgccgacggaatcgccatcgacgtagacgtagccgcacggcacggagccgacgaccgcggcctggccgtggtacaggtcgacgacgtcgccgtcttcggccagcacgacgttctgcggatcgacgccggtcttgacggcgatcatgccgttggccaccaagtggcggttttcgccgtggataggcatggcgcacttcggcttgacgatgttgtacatgtacagcagttcgccttcgttgcagtggccggagacgtgcacggcggcgttgtctcggttgaccacgcgggctccgagctgcacgagcttgttgatgaccttgtagacgccatgctcgttgcctgggatcagggagctggcgaggatcaccgtgtcgaactcgttgatggtgatgtcacgatggttgccgtcggcgatgcggccgagcgcggccatcggctcgccttgggagccggtgcacatgtagacgagcttgtcgtcctgcacgtcatgggcctgcttcaggtcgatgacagtgtcctcgggcagacgcaggtagcccaaatctgctgcgatggacatgttgcggaccatggaacgtccgacgaacacgaccttgcggccgtacttgtgggccgcgtcgacgacctgctgcacgcggtgcacgtggctggagaagctggccacgatgatcttgcgagtggcctgtgcgaacgcctggtcgagcgccggaccgatggaggtctccggcttgacgaagcccgggacctcggcgttggtggagtccatcatcaggaggtccacgcccttttcgccgagcttgccgaattccaccagatcggtgatgcggtggtcgagcggcagctggtcgagcttgatgtcgccggtgtcgatgagagagccggcgggggtctgcacgaacacggcgagcgcgtccggaatggagtgcgtgacgttcacgaattccaggttgaacgggccgaccttgagcttgtcgcgtcccttgacctcgacgagcgtcgggttgatgcggtgttccttgcacttggcctcaacgaaggcgagggtgagcttggagccgatcagcggaatgtccgggcggagcttgagcaggtacggcacgccaccgatgtggtcttcgtggccgtgggtgagcacgagcgcctcgaccttgtcgagacggtccttgatgtagtggaagtcaggcaggatgaggtccacgcccggctgctcctcttccgggaagagcacgccgcagtcgatgagcaggatatgtccattgtattcgaccacgttcatgttgcggccgatctcacccagaccgccgagcggcacgatgcgcatggagcccttgcggtacttcggcggggcgatcagcacctcgtcctgctgcggcgcggtggattgcggcgcggaatgcgacgggcgacggttcgaaccgttgccgccacggaatccacgggagccgccgttgcgcgagccaccgttgccacggctgcgggtggaggacttggccttcttggtggcggtcttctcggacttcgcggccttggtggtcttggatgccttgactgcggtttcagtgcgcttggcagccttgctgccgcgcttgtgtgttgttgtctttgtggtttcttctgtagccatttcctagttggatttctattactaattgtctccgcctatgcggaaacgaggaatttgggtgcctgtcggcgttcatgcgcgacaggccagtcgcatcatgcgattcggttcacagcagtcccgcggcgcgcatgcccttttccgcgcgcacgagttccgcttcgcccggaccgacgttcggcaggcgcatttcggtggagtcgaggattccacgcaccttcagcgaggccttggccatcacggcctggaagccattgccgttcatcgcttcgacgagcggcgccagctgcacggagatgcgctgcgcttcgtggatatcgccacggtcgaacgcgttggcgaggtcacgcatcggaccggcggccgcgtgtgcgatcacagagatgatgccgacggcgccgacggacaggaacggcaggaacaggccgtcatcgcccgaataccaggtcagaccggtctccatacgcttgcgcaccgcgcctgcgatgtcgccggtggcgtccttgacggcctggacgtggtcgagctcggccatacgacggtaggtttccagctggatgtgcagtccggtacggctcggcacatcgtagacgatgatcggcttgtccgcggaatcgttgaccgccttgtagtggcggaacacgccctcctgcgacggacgggagtaatacggggcgaccacgagcaccgcgtcggcgcccgcctcctgggtctgctccaccatgcgcacggtgtgcgcggtgtcattggaaccggcgccggaaatgaccggcacgtccacgacctccttgacggcctgaaccagctcgaccttctcctccatatgggtggtcggcgattcgccggtggtgccgttgaccacaagaccgtcggcaccatccgccacgagctgcctcgccagctgttgcgcggcttcgaaatctacggctccgtcggccttcatgggggtgaccatggccggaaggatacgtccgaagggagcaggatcgagcagatgcattgtaccgtcgtcagtcttagggcttgtcatacggctaacggtacttccctctgcggacgctttcgatttcatgagacgcgaaaagtcacattttggaaggcctgccgacgacgaccgcgacgacgcactgcaggaaagcgacgaacgtgaacaccatcagcggcacatgatggccgccggtggtctggaccagcacgccgaacataagcgggccgagcgaggcgatcagatagccgaacgactgcgcgacgcccgacagcaccacggtttcggcgctgtcatgcccgcgcagcgcgatcagtgcgagcgccaccaccagggacgcgccctgcgcgcaaccaccgacgaacgcccataccggcatgagatgcggcaacagcagcatgccaaggccggcgatcagcatgggagcgctggcggtgagcgccgcgcagacctggttgccgcgcacgttcatgagcttaggaatgaccaagccggaaaggatgccgatgccttggaagatgaacagatgcacgccggcggtggaggcatcgtagccgatggatgcggagatggacggcatccaattggacatggtgtagaaagcggacgattgcagccccatgaaggccgtcacgtaccacgtcatcggacggcgcagcacgcgggcgaacacgccatgcgacgattgcgcggaacatgccggtcgctgtgcggaatgcgggttttgtgcgttggccgtcgtgctgcgatcgccaatatcatcgatatcgccagtatcgctggtttcgatggtgccgccggcggaagcgataacgactttgcgattgtgcaggatacgcaacgcccacagcgcggcgacaaccagcggaggcacactccagaaggcgagtgacgcacgccaaccgccccacatctgcgcaagcggcgcggacagcaaacctgcggtggcgctgccggcggtgatgcagccggaatagacgccggtcgccatcgcgacatggccggcgtagtcacgtttcgcgattaccggaaccagaacgttgccgacggcgatggcggaagcgaacaccaccgtgcccagccagatgccaacgccgccgccgaacgagcggatggcgtcgcccgccgcgatgcacagcagggccagcagaatcgacatgtcgatgccgatgcggcgtgcaaggaacgtgaccagcgggctgaccacggcgaaggcgatcagcggaatcgccgtcaatacgccctgcacgccctcaccccacgcaaggtcggttcccatttgggcgaggaccggcccgacggcggcgatggcgggccgcagattcagcgatacgaggaaaatcaaagccacccacaatccggtggaggaccggtcgtacgccagcatgtttcgttttgaattcattccgttcccattcccgcttccacttccgtttaccgccgttccaacgggacgtgccacgcctagattttccctatcaatcttcaagctcattgagcgcatcgaagcaatcgttgatgccttcgatacgcgcgtgcacctcgtcttcggtatcgacgaggcattttccgacttcgtccaccatcagggcgatcagggcgaacgccgcggtgaagctcgtcagcacgtgggagctcagcaccactttgaagaaggcgacgttacggccgatgacggcgttgcgcgccgaaatgtcgccaatcaccaccacggtcaggccgcgctcaagcatcacgtcgatgagccgtgagaagaagggaagacgccggcccacgccgatgatgacgattacgtcgcctgccgcataatcaaccagatcttcggctatggactggcctggattcggcagaatatcaacgtttccgcgtagccgcatcagctgttcgcgcatgtgcagcgccacgggatagctgctgtggtacccgaccaccgccacatgcggggccgtggccatggcttggcatgcggatgacagttgcgcgcggtcgatgccttcaaacgtgcgtttcaggctttcctcgtcacggcgcagatggtcggcgaccaaatcgtcgcactgggtgtgccgtgaaagctccggagagccaggacgatggacgcgacgcacgtcacgtctgaattcgcccgcgttcgcatagccgagcttgcggtacaggcggctgagcgtcggctgcgagatgccgctcaactgcgacaattccacggaattgcagaccagcacgtcggtcagatgacccagaatgaactgcgcggcctcacgttccgtcgcagtcagcgaatcgaaggattcccggatgcgcgccaccaagccgaggtccgcggcagcattgccttcctcgtccatggcgtccttcgaagcccccatattgtctgaaagcataattccagaagtcacgctcatcgcccttccctgcagtacattctcacgcggcgcatccgttctcctgacgatgctaccccttgctttccgggtttcaccaggtttggccgccgacaactgtcacgacgaatgaagaatttcagatgccgtaagcactgaaatgcatccatcacaggcagtggcggcgcctcttggcaacgcgacccaccatcaggagatgaccgaccatggcaaaaacagattaccccacacaatcaacatcgcatatcgggcggattcggcatagaagaaacggtgccaaaccagcgaaatgggcgactaacgcggcaacaaaatccccgactgttgcgaacactgttgaaccggcatcgcgcccggccgaatgcgaggcgaacgcggtgcgcaagatcgtacggctggtggcacgcaccggctgccgcacgcatattctgcacgtgtccagcggtctgagcgtggacgtgctgcggcgggcgaaggccgaaggactgccggtcagcgcggagacctgtccgcattacctcacgttggattgcgaccatattcccgacaacgccaccgcgttcaaatgctgtccgccgattcgtgatctgcatgagcaggacgcgctatgggcggggcttgccgacggcacgttggatggtgtcgtcaccgatcattccccggccagcgcggatatgaaagccggcacgctcgccaccgcgtggggtggcgtttccagtctgcaggtcggattccgcgcggtgttgacgggtgcgatgcggcgcggcttgagtttgaccgacgtcgtgcggtggatgtcgtgcaacaccgcacggcttgtgggacttgacgatcgtggcgatataacgccggtattgcgggccgatttggcgattattcgcccgtacgaacggtttgttgtggatgctaccgctttggaaagccgcaatccgatctgcgcctgcgatggcatgacgcttaacggcgtcgtcacgcgcacgtttgtagcggggcgggacgcgctctccggagtgcgggaggggaatcttatcgttcgtccgtgaatcggaatccataaatcaaccattcaacaaaaatccccaacccgccgatggccggatgtcattcgatgtcggcagattggggacggacgagaatcaggtctcagcccaggtaggcggccgggttctgggcgaacttgtcggcgcaaccggggttgcagaagtagtaggtgacgccgccgtattcgcgggttgcggccgcggtggccggatcgacgctcatgccgcaaaccgggtccttcgcaacgttcgccgcggaatcgcccatattcgaagccatgccgtggccgtcatgaccgccgcagcagtgtccggcgcccatcgtgcccatgttctcggcttccttcttggccttgtgatcgctgaacagtcccatgatcgttcctttccgactgtgctggttgccattatttttgctcggatcgggcttgcgtacccgatacgtcttgtttttcgccgcctccgcgtccggatcgaacaggcgcagccggcttgcgttcgtcaccacgcacaacgacgagaacgccatcgcggcgccggcgatcatcggattcagcagcgttccggtgaacggatacagcacgccggccgcgatcgcgatgccgatgctgttgtagccgagtgcgaagccgaggttctgcgcgatgttgcgcatggcggcatgcgtcaggtcgagcgcgtgcacgagccccatgagcgatccgcccatcagtgtcacatccgcggattggacggccacgtcggtgccggtgccgatggcgaatccgacgttggctcgggcgagggcgggcgcgtcgttgatgccgtcgccgaccatcgccaccgtatagccttgcgattggagttttgcgatttcgtcggccttgcgttccggccgcacgccggcgatcacatgacgttcgtcgataccgacctggcttgcgatggcgcgtgcggtggtcggattgtctcccgtgagcatgacggcttcgacgccacgtttgcggagcagttcgatggcttggcgcgagtcggctttcggcacgtcggcgacggcgacgatgccggcgagatggccgtcgatggccgctaggatcggcgttttgccttgctgcgacaggagttccatgtcggcgatgatggcgtcgaggttcgtatcgtggatggtctcggaggcaatttcggaggtatcggacgtaacgtcgggcatgtcgacgtcaaggtcgtcgatcaggtcggtgttgccgacggcgacggtgtgcggcagaccgcggaaggtgacacgcgcggtgacgccacggccggcaatcgcctgaaaatcggtggtttgcgcggcatccgcggcatcgacatgttccgcggcggtcgcgacgatcgcgacagcgagcggatgctcggaatcacgttcggcggcggcgacgatcgtcaggaaatcatcggcctgccgacgccacttgccgaacggcagcacgtcggtgagggtgggtttgccggcggtgatcgtgccggtcttatccaatacaacggcattgactttgccgcatgtttccaacgcttcggcggaacggaccagcacccccatgcgagccgcgcgaccggtcgagaccgtcaccgacaggggcgtcgccagtccgagcgcgcacgggcaggcgatcagcagcaccgataccgcggcgaccagcgcgtgcgtgacacgcggttcggggccgaacgcaaaccacagcgcgcacgaccatacggcgacgagcaccacggccggcacgaaaacgccggagatacggtccgccaatcgttgcacgggggctttcgagctttgtgcggcggtcaccatgtcgatgatctgcgcgagcacggtgtctttgccgactttcgtggcgcggtagcgcagcgagccgccgccgttgatggtggcgcccgtcacttcgctgccttcggttttggcgaccggcatggcttcgccggtgatcatcgattcgcccacggtggaggtgccggatatgacgatgccgtcgaccggcagctgctcgccgggacggatggcgatgacatcgccgacgcgcacgtcatcgatggcgatgctggtttccttgccgtctcgcaccacgcgggcggttttcggttgcagacccgccaatgcgcgcatggcttcaccggtgcctttgcgggcgcgcgcttcgagcagctggccgacaagcataagcgtgacgaccacaccgaccgcttcgaaatacggttcgcgcgcgttctcgggcaggacgttcggtgcgaaggtgaccacgcaggagtaggcgaatgcggccagcgcaccaaggctgacgagcgcgttcatctccggcgagcggtgggctatcgcggcgaaaccgctgcggaaaatcggcaatgccgcatagccgacaatcggcagcatcagcaggaattgcagccagttcggcatcggatacagcatgagcatggtggagccgaacacgggaatcgtgcagacggcggccacgacgagacgggcgacgagggcgcggatgtccgtttcgccggaatcgggcgtttgggcgtttttttgcgcggtctgtgcgtctgtttcatcagaatcggacgtgtggccaccgcccgtagtcgagtgcatgtctgaattgccagaatcgggcatgctggtattggcagcggtagttgcgataccggcggtagcgtcagcaccggcgcctgcgtgcctgcccggcagcacacgcaacatgccatgcagcatgttcatgccgcatgcgaagggatactcacccggctcatcggggtgcaacgtcagcgtggtcgtgcggaaggcgggcagcgcaagatcgaccccgaaatcggaaaaaacgacgtgcgacgaacattcgccgtcttccttgcgatcgaagatcagccgcaacggcatgcccgcttcggcttcgatgacggctgggttatacccgcctttgacttcgacgaccgcttcctgcacgccgtcgcgcaacggcgcacgatacgctttgcgcggtgcgaagaagaaccacagcacgcccgccgtgacgagcagcgccataataagcgcgattgcgatgtgcatattccagccgccttccgtccgtaattggctttcgatttcggcaaacaccatcacaatatacccctatagggtatattggcaagaaggacgagcaaacttcagccgtagataaaattttcagcgcagcgaggaggacgatatgaacgccacacaacatgggtacgcaagcgaccagaagaggatcatcgcacgattgaatcgcatcgaagggcaggtgcgcggcattcggcagatgacggaaaacggcgaatactgcatcgacattctgacgcagatttccgcagcggacagcgcgctgaagtcggtggcgctactgctgctcgacgaccatctgcaccattgcgtcgccaaagccgcggcggagggcggtaccgtcgccgacgaaaagctggcggaagtcagcgccgccatcgcacgccttgccaaataatcggaacagatacgccataaaaaaactgccgacggaagacacatgcacccatcggcagtttgaaaaaagaattacgattacaggtcgaggaagtggtcgaggccgacggtcagacccgggtaggttccggtggagaccttgcgcacggccagcagcacgcccggcatgaaggagatgcggtcgaagctgtcggcgcggatggtcagctgttcgccggagttgccgaacagcacctcctcgtgggcgttgaggccgcgaagacgcacagcgtgcacgtggatgccgtccaccacctggcctcgggaaccgccgtcggtttcggtggcgtccggaaccgggccgagaccggccgccttgcgcgcttcggcgatgccctgcgcggtatggaaagcggtgccggacggagcgtccaccttggtcgggtggtgcagttcgatgacttccgcggattcgaaatacggcgccgcgacctttgcgaaatggtcggcgagcaccgcggaaatggcgaagttcggcgcgatgaacacgctctggccctcacgcggagccgcggcgagcgtggcacgcacctggtcgagcttctcttcggtccagccggtggtgccgaccaccacgtcgacgccctgcttgacgagggcgagcacattgcccagcgacacgctcggcacggtgaattccaccacgacgtcggtgttttcgggggtaattgcggccaggtcgtcgcctgcgtcgagcgcgagcgcgagttcggtgtcggcggcggcattgacggcgtcgaccacgtgcgagcccatgcggcctttggcaccgactacggaaaccttgatcattgcagctccttgatgttttcgcggacgcgcatgttgcgcatgtcgtacgtttgccgtgcgcatgtgttcgaaatcgcgtgtccgcgtccataacgtgttccacttatgaatctaaagagacgcttcgacgcgaaggcaggcggctatgacgcttgacgatcgaacgtcggtcagccgcggcgacgcgccagcagccagccaatcagcgcgaacggaatcgaacagcccacgaacacggcgggcaggctcaatcccacgcttggattgaaatggtcgagcacgatgccggtgatcatggagccgaacgacgcacccatcgtgccggcggtgctcacccaggacaggccttcggtgagcgattcctcgggcacggtctccttgacgaggaggttgccggaggcgaacaccggcgaaatggtcaggccggtgaggatctccaccagtcccatcacgatcaggttgccctggcacaggtggatcaccacgaagccgacggtcatcaacgcgaggaacatgatcatgtgacgccaacgggagcctttgagctcgcgcgagccgaagaccagcgcgcccatgcaggagccgacggccagcatggccagctgcacgccgagcacggagtcgaggtgcagcgatttcatgacggcggtcatggacgtgtcgaacgcggtgaacgccatgttgaacacgatgaacacggcgaggagcggcagcacgcccgcataggtgagcacattgcgcttgttgcggtcgcggccgtccgtcttgagccggtcgaggtcgaaacgattcgcggaagcagcggtaccagcagtaccgttcgcagcggcaccagcggccgccaatcgcacgtccgcatcgtcggcatcggccgcgacgaccgtgatttcgcgcaataccggcggttgcgtgtcgcgcagcgcgaagaacacggcaccgccgaccgcgcaggcgatggtcggcacgaacagctgcgatacggggtgcacggacgcggccaggaacgccgccagaatcggtccgaagatgaatacgatttcgtcgatggcggattcgagcgcgtacgcggtgttgagcagctcccccttgccggcgcggtcgagcacatacgcccaacgggtacgtacgagcgcgccgaacgcgaactgcgtcatacccatgaccacggccagtacgaacagcagcggaatcggcacgcgcatcagtgcggcgaacgcgaagcccagcatgacgatgacctgcaccgtcaataccaccggaccgaccttgcgttggccgaaccggtcgaacaggcgcgcgtacaacggtgtgacggctgcggtggcgagcacgtatgcggcgctcatcacgccggcgatcgtccaattgtcgtacatgtggttgagtgcgagcacgatgccgagtcccatcatggacatcggcagtcgtgcgacggcaccggacgcgcagaacgctttcgttccaggtatggagaacagccgcgcatacggcgatgcggtgtccggtgatgtattcgggctgacggttgcgtcattcgcagccatgatcgaaactccttaactgttgttgcgtccggcatgtgcgcccgcccacacatgctgcacgagggtagcggcgttcctccacaacgctgcctgcatagcggtttctcccgcaggcaggccggaaagcgccgctcccccgctttcttcggtcaaggagccattgcgcaccggcactagtcgttgtcggattgctgcggaattccgtagctcaactcggcaaggatctcttcttctgttttgtcgggggcatccagctcccggtcggcctcgtgaggctcactcacatagtagagacaggcgtcgattgcatccaacggcaccccttccatcgccgcgagcagcaggcggtacaggtcgagctgtgcgagtttctctttgatttcgtccggtttgcgtggttttacgccggttttccaatcgaccacggtgtagcgtttcgtctcgtccgtttcgtcgagaccgccgaagaacaccgcgtcgagtttgccgttgacgatggtgccgagctggggcatgtcgacgacgagctggcgttccgcccatgctggacgtcgttttgcccacggcgaagcgacgagacgacgctgccaagcggccagtttccgttcgtctcgcaattgggcgtcctgcgattgcacgccgccgttgtccgcgtcgacttgcgtatcacctatcaatgcgatcagttccgcacgcgactgcgcggccataccggcagcaccttccgtaccgccgatgccgtcgacgtccgcatccgccatgatgaaacgctcagcccatgcgtggaaccgcgtgccgagctgtgccgccggcgaggcgacgtgcggaatcggacggaccagaccacgccagtaggcgcgggagtcacgctcgcccatggaaccggcgcgcgcttgcagcgaggtgacgttttggcggccggcagcaaggatacgttcgcctttggcacgcacggcctcgtcgaaggcgtcctgcgattcgcctgcgtcagccgcgtccggttccggcatgagatgttcgtcggcgacgagcagtttggcgagacgcagcagtgagtttccggtttccggcgatggcgtggcggattcatcggcaacgtcgccctgcgttcccgtggattcagcgatattcggttcgttggattcgacggcacgtacctgttcggccgcggcacgcagcttgtcggcgacatcggcgctcagatcgcacggccaaggcaaagtatggtcgtccgagaccggttcgagcggcgtgttccacgcatcgcccaccacggcattctcgaaatcgcgggcgtgttcgcctacgaaatagccgtcgggcaggtcaagtcccagcgtgtgcggggagccatccacatcgtcggacaggttgtccggttcgcgtaccgcggtgacgattccgttcatcgaatcgcgcgtctccagccagaaattcgacggcgcggcgcttttctttccctccgccaggcgggagtcgcggctcgtctcgttgcatccgctgtatacgagcagcgcctcgtagcgggcgcgcgtcaacgccacgtaggcgagacggcgttcgtcggcgtgcagtcggcggccgtattcctcctgttgcgtcaggtacaggcttgccggatccattccttccatatcgtcgacggccatggttcgcaaggtgccgaacacctcgtcgtcgatcacttccgcatcgtccaatccgtcgagcgattccacgggattgcccccgatgggcgcgtcgtgcgggaatcgtggcaggatatccgcgtcggcgcgcaccggaaccggcaccgcggacgggtcttccagccaagtgtgggctttttcgaagtattccggcggctcccatacgccgtcgcgccgaccgcccggatggtcttcgtccgttttgacgctcaggtggtcgccttgactggacgggaaggtgccgtcgcgcatgccgaccacggccacggcgtcccattccaggcctttcgactggtgcacggtcatgagcaccacatcgacgggggtatctggtgcggtggcgttgtcgtcggacgcgtcacgcagcgaatccacccacgagatgaacgcgcgcaggcttggcgtgccctgcgcggcgatttcctgcaagtaggtgtccaccagagacagcatcgcgtcgagtgacgaagcggcatgcgatgtggcacgattgccggcatccggatgccgcatccgttcggcgagcagcaggtcgatgtccagtccgagcgcggtgatggccgtgcgtaccacttccggcaacggatggccggccgtgcgctgcacctgttggatgacgcgaccggcgtggatgacgctcgcggctcccgtacggctcaatacgccgtcgacgaggtgccgcagatcgccgcgcagcagcacgtcgatcaggaagacggcgttgggcacttggtcgcggtaggcgcgcacggtggcgcggatgtcggcgtcggacggattcgcatccgcctccacgatgccggccgacacgagcgcgcggtagcgttgcgcggtgttgagccgttcggcgatgccggcgagcgcctgcagatcgtcggcggacaggccgaatcgtggcgtggcgagcagccgcatgagcgcggcgctgtcggtgtggtcgcatacgacgtgcagcagggcgaggatgtctttgatttcgggacgttccaggagtgcggcctggccgacgacgagtgtggtgaggccggcttgttccagtgcgtcctcgtaggctggcatctgcgttttggagcggaacaggagcgccacgtgcggacggttgtctttggctccgtcggcgagctcgttttcggttggcatgtgcagtgcgatcgcttgtttggcgaagcgtacgatggcgtcgatttcctggccgaatgtggcgtagccgagcacgccgagcgtaccttcgggagcattgtcgatgttggcgagcgggggcacgtccacttcgcgcataagcgagctgccgcgacgtctggcgggcaggcgcaatggtttcgtcagattgttggccgcttcgagcaccatgcgcgagttacgtcgggtgacggtcagcgtgtagggcttgtcggtggcgtcgtggccgaagtcgtgttgcagcatgcggaatgcgcctgggctggctcctcgccatgcgtagatcgattggaaggggtcgccgacggcgttcaccgcgctgcgatgggtggaatcggcgtggaacagtgcggtcaggagggccgcctgcgtggtggaggtgtcttggtattcgtcgagcagcacgtgcgtgtagcgtttgcggtaggtggctccgatggaggggaatcgggtgacgagttggaatgcggcgatggtgaagtcgctgaattcggccatgttgagggcgcgtttttcggcgtggtagtcggccacgaggtcgagtagcaggtcgcgtttgcgggccgtgccggccaattgcgcggtcttgtagacgcagagttggtggcattgggcgcggtattcgcgcatgcgggtttcgaaggcggtgtcggattcctttttcttctgtttcggagccttgcccactttcggctcgtcatcgggaacgtcctcgtcttcaagcgctttggccacttgcgccacgaacgccttatcccatgcgcgcacgcgttccacggcttcgtcgaagctggtgcagtcgctgccgatcatggctcctgcgatggcgttggatagggtgaacacgttgccggcgatggtggagaatttgccgagttcgtcgccgccttggtcgaaggccatgagctggtccatgtgcttgtcgagcacggtgtggatgagctgcagcgctccggcttcgctcaatggctgcgtgttttggtcgaagccgacgagcaggccgtattggcgcacgatggtttggaagaacgcgtcataggtggagacttccggtttgaggaaggcgacgcgtgtaccgcgtccggcttggttgcgtgtcacggcagcggagacgcgcgaaagcagttcggaggcggctttgcgcgtgaaggtcaggcccagaatcttctcgggactgatgccctggtcgatgagggtgatgatgcggcgggtcatggtgtaggttttgccggagccggcgcccgccaccacgaccacgtcctcgtatgagggggcttggatgacggcggcctgttccggactgtcggtgaatttcggcgtggcggccggcacagtgcccatcgcatcgccctttgcggcggccccgttcgttgacatgcttccgttcataccgttactcccgttcatgccacggtcctttcgaatacggtgttctgctcgccttggcaggccgggcagaccccactgccgtacgttctgcagtatccgacgtgttccacggtcggacgcgcggtgatgcgggtggcccggctcgccgcggccgcatagaagacgcgggagatcatggtcagcgaccataccgtcatcttcgaccgcgattccagaagttgcttccaatgttcttcgctgacctgcgccggccgttcgacgtcgtcgaggccgctggtgaagacgctggccattttgggcacgtatttgcggggtatgaaatcgcccgcgttgatgcttccgccggcgaacagcgcctgctggtggtacgcttcgtcgccttgccctttgcgtggcgcgggggccgcgtattccatgacgtggaacagggcgctttgggtgatgtccggcatggttgcgatcgcctgcgcgccgcgttttccgccgtgttccgggaatgcgaggcccagctggtagcagacgagctgcaggtcgctgaacagggagcgtccgttcggcactttgccggttttgtagtcgatcagccgtacctgttcgcggccgtcggcggtacggcggtgttcaagacggtcgattctgcccgacaggcgtacggtgagccggtcgctcatgccggtttccggccagccgccgacgagcgcgcccatgatggcgatgagttcgtcgcgggagatcggagcgttgccgtcgatggcgttgtaggcgtcgaggatgtcatcgaagtcgaatcgcgcggcgaactgccgttccgcttcggcatggtccaacgttcccacggtgatgttttcggtgttgttcgacgggtatcccgtacggttcgacttgacgaaatatgtggcgatgttgcgcaatgcgaccgacgccttcgcgtccttgccgagcgccttgtaccgttcctcggggtcgtcgatggcgttgaggtcgccacgtagggtcttgtatcggccgatcatccattgggtgatttcgtcgatgttgtcctcgtcgcttactgcggtgtggttttggggcaggtcgaggccggcttcggtggcctgttgcgcgacggtgtggatgagcgagccgaagctggtggccgcgctgcccatgcgtgggccggcgaaacggttctccagcatccagcacaccgggcacgcccacaaactgtccacggcggatggagaaagggtgaccacgtcggattggccgtctgttttttcgatggattccggttgttcgataagcttcgccttgtcggcatgctccgtttttccgtcagattccatcttgccgtcgatttccgtcatatcgtcggctcccgcatgtcccgtaaggaacgcccaattgtcgggattcgcggcggcgatgccatgcgatgccaacaacgccaaggcttgcgcggcatcgcgcgcttgggggaatcggccggcgcatgggccagcacgcttcgcgcggcggcgaccaggccacgcgggtcggcctccagtcccgcgtattcgccggcctcgccgaccgccgtgtacacgcgtgtttccgcatcggcatcccggtcgcggtcgaaccattccggcaggtagccgtagaggaagtcggacggcacatggtcttcgttgaggaccgcgcttaccgtcacgcgctcatcggcgcgggtgagcgccacaaggaggcttttctgttcggaggcgagcaccgcggcgagctgcgcgttttcgcggcctgcggaggtgacgatgtcgtcggacagtcgtccatgcagcatgatgtcggcgagttcctccccgccgaacagggtgttgcgcggtgagaggttcggccattggccttgttggaacgcaggcatgaatactagtttccaatgttttccggcagctccggcgggcgtggtgagcgtcacggcctgatcgatcggcgcggtgtgcgccagggagtcggcttcgatggcgagcgcgcggacctgttcgatgaacgcgtcgatggtgtgcgctgccgtcacgccgttcgattcgccgccggacgcgtagctgaacaggcgcatcgcggtgtcgagccggtcgttggccgcgcggccttcggcgttgttgcgcaacgccgttttctgccagatttcggctttgccgaacgcctgccatgcacagtcgagcatgtattgcggttcgtgggatgtcaggcgtgcctccgaccgcagggtatcgtcgagcgctttccacaggcgtgcgaaggcttgcgcttgggggtctttgcggcccagtacggaggcgatcgcgtcgagcacgcggtcggtgtcgccttccaatagcaggatgtacagcgcgttcatgccgaaggatggttcgtccgcgtcctcagcggcacgctctcccgtcatcagccggtcgtcggtgtcgattgccggcaggcccatgtcggcagcgttttccgcgtccgacgccgatgccgccgcgcgtgcggtgtggaaggcttcgacgtaatcgttccaatcgtcgatcagctgtggcagcagcgcgcgtccggacgtgtcggacgtggtcggatcggctgtatcgtcatgcaaaaccgtggccagcgagccgagcgcgttcatcgccgattcgaccacgcacagccgagccggacgttcgccgggggtggtgatcagcggcgagttcatgattgatgcgacgcgtgagcgcacgtatgcgccggccgtgtcgaggttcatggacgaggtggcgatgccttgccgtttcagttcggccagttcgatcatggagaacaggccctgcacgaacggttcgtccttgagggggcgggtcacgctcgaatagcgtacgggcacgccgtcggcgcgtagccgttcgccgaacgtgcgcacggtggcgttgtcgtgggcgatcacggccatgtcgttccagtcgcggccgtgttcgagatgttcggttttgattttccacaccacgtcgtcgagttcttcgacggtggaacggtacatcgcggcttcaagactgccgtcgtgcgtctccggtatggcgatggccggcattttgccggggcggttcgccagcgcgtcgtcggtcgattccgtgctggcgatggtcaggctcacgcggctcgtcaccgcggccaggtccgtgccttcggccatatgggacggttccagccgtaccagtcgcgcgcccaatcgcgattgcgccatgttgaacagatattcagggtacgatccgcggaacgtctgcaccgcctcgtcggggttgccgacgagcagcagacgcacgccacggttgcgcaatgcggtgagaaagtcgaagccggcgagtgtggcgtcctggaaatcgtcgacgatgacgagtttcggcaggtcggacgtttcggcttcgttcacggcggccgcggcgtcgatcatgagctgcgaggcgtcgagacggtattggtccggatatgcctcgttgatggcctggttgtattcggcgcgcagcgcgaaggcgagccgccattgcacgcgcagtcgttcgcgtcgttcgtcgagcgtgccgtgctcgtcggcagcgcgggaaatcagcgcgtcttcgagttccggtttcgcgccgatctcgttcatgcgggcaagcatgtcgcgcagctggttggcgaaggcgtcggtggcgtcgtccaccaccatgcccgaccagtcggcgaccacgaagtaggtgcgcaatagcgcgcaggtggagcattcgtcgccgtgctcggcatgttcggcatgcctggcgagcacacggcggatgaccacgtcctgttcggccccgttgagcagtttcggcaggggttgtccggcatgcgatcgcacggcggtcatgatgcggaacgcgacggctggcagggtggtgacggggcgcgcctgcgagatcgcggacagttcgcggatcacggtgtcgccgagccggtcggccacctgtctgccggagaccgtcatcacggcgtacgcgtcgccatgccgcttcatcgcggcgaccagcatgtccagcgcgaaccgggtcttgccgctgcggggtgcccccgcaaccaatgtcacgtcatcgagatcgtccacatccatcatgtctccccagcttagccgaacggtccgtcctgcactcatatatcaccggacaaaacggccggacaacgcagccggacaaacacaacagacgccccaaaaaagcggtcagccagaagggacaaaaacctgcgaacaatccgcgatgcggaatgcggctactgcagggaggcccacaccgtggaggagatgtcgcggatctgagcctgcgcggccgaggaatcgggcacgtcggaactcatgacggcaatcacgtacggatgttcgccgtagacgatcgcggaatcgttctccacgcccggagcctcaccggttttgttcgcgcacgccacgccttgcggcagtccggccgggattttggcgcggcgggtctgcctggacatgatgtcggtcatgcgtttgctgtagccggcggacaccagctgcccacggtaggcggcggcgaggaatcgcccctgatccgccacggacgtctgcttggtggaataattggacagatcgcccatccggctgttcaaatgcgattcgttgaacccgtattgcgcggccaccgagttgaccacgccgaatccggcgttgatgtttccggagccgagccgctccaccagcgcgttggtggcctcgttcgaactgactgtgatcatctgttccagcaacccgtccagcgaggcgtcttcggcgagcgtgccctccgacaccttctggaagacggcgagcatgaccatgagtttgacgacacttgccgaatacgattggtggctgttgaccacggctgtggccccgctgtcgaggtcttcgacgtacacctgccaggaaccttggtattgcgcggtttttccggataattgcgattgcagcgcggccagcagcgtctgccgttcggccgtctgcgtcttgcgttcgtctgctttcggggtctgcttgcgatcgagcgcggtatgctccgccgccgtttcgccacgcgtggccggcttggtcggttcgttcggttcggccgatttggcggagccgtccgcccctttgacggcgggggtctcagtcttcgccacggccgcagcggaagaggccgcgccatggcgtcgcgctcccgcaattgcaatggcgcagccggcgagcgccacggcgaccacgcaaacggctgcgatcaccgcgacggtgattcggcggcgcccgtcaaacgcggccctggattgttccgaagcccatcgggggtaattggagtgacgtcccatatcggcggcttaattcctgagcatagtgttccacaccttgtccagcatgcgcgatgcgagctgggcggccacggctctgccctggttctgcgtcataaccgccacggagaccttcttcttgccgttggagatcaccatgaagtagttgtaggagtctttgatgccttggccgcggtgcgcgtgaacggtcgcgccggacggaatgaccacgccttcggaggcgatgtcgtagttcatgaggccgtcgtctccgttctccgccatctcattcagcatgcgggccgcgtcatcgggcgacgcgtagttctcgtagccgttctgcgacgctttgacgtctccgtagtcgcgttcgaaccgcgtgcggtagtacttgttgtcgctgagccattcgttgaggtcgctttcgccaccgaccgcatcgatcagcccgttggccgatccgttgttcatgccggtcagcgaatcggcgtacgcgtcgggcctatcaccgtaggtgtcacgatagtcgagccatgccggcaggtacagaccggcggcgacgaacgacaggctcgcgttgcgcgacgaatagctgcgcagtccgtcttcgttcatgaccgaaacgcccacatcgatggtggagtagccgtcgacgatggaatcggtcgagcttttgtccagtatgcgattggaccgccggtcccgttccttcgaagcgtcggttttgccggatttgcctggcttgtccgattcatccgactcgccagccttgcttgatttgccggatccgccggttttatccgacttgtccgactcgcccgatttgtccgacgatttgccgtccgccttcttggctttcttcttcggcttcgtcgtttcctgcgattgcgtggccggctggaccccgttcgaattcgacgtgttcagataccagacggttccgccaatgagaatggcgatgaccacgatggccgccacgatgatcatcccaacgccgcccgatttgccttgcttcgcaggtggcggcaatgggccgttcggcacggtcggcggcacagcgggcgacacggtcggcgatacgaccggaggaacgaccggtccgggttgcggcgtcaacacgctggagggtgcgccgtcgaccatggtgccgtcagcgttgccatccaccatggttccgtccgcgggacggccgccggcctgcgtctgcaatgtcagaccgcagttagtgcagaatcgtgcgttctgatcgttgtgaacgccgcaggatggacaaaacatatgccttccccctctttccccaatgcttctcttccggtatttcaacagccgacggggacaggcaccgcacgcccggcgtctaccctttggaacctccgcggcacacgggcaaacccccatataatatagcaaggcagagcgcggtgcattatgcctgtcccaatgcgagccggcagacgcccatcgcacacagaggaaagaggaagcatggaagcctcaaggagcattccccctcagattcccggctacacactgatcaaacggctgggctccggttccgaagccgacgtgtacctgtaccagcagctttccccggcccgtcaggtggccatcaaaatcagcaagaacacgctcgacccacgtgccgcggtccgcttccgttccgaagcgaatttcatggggcagatctccacacacccctacattctttccgtctatgagaacggcgtgaccgtcaacgggcgcggctacaccgtgttcgaatacgctccgggcggcaattacaagacgttcctcgagcatggccgtctcaccgccgaccagatgctcaccgtcggtatcgatctggcgagcgcgctgttcaccgcgcatcgcaaaggcatcatccatcgagacatcaagcccagcaatattctcatcaacgcgcacaatatgcccatgctcgccgatttcggcatcgccgggaccgtctatgggcgtccgggtgtcggcttcaccatcgcgtgggccgcgccggaggtgcttgcccaaggcggtggcggcaatgaatcgtccgatatctattcgcttggcgccacgctgttcgccatgctgatcggccaatcgccgtacgagtatttctatgccgatgtgctgggcgattcccaacggcaggtgcgggccgaacggctcaagtccgtcattctcaacaatccgctgcccaaactcaaccgttccgacgtgccggccgaagtggaatgggtgttgcgtaaggctttgagccgtgcgcccgaggatcgttactattccgcgttggagttcgcgcgcgacatgcagcgcgtgcaacaggccttgtatggccgtgccgtgcagaccaccgtcgagggtgtgccggattatccgcagaacatgtacgcgcagacttccacattcgaccagtccgccccggttgcgaagcagcatgcccggtgggtgaagccgttggccgtcacggttgctgcggcggccgccgtggtcgtgatggcgttggcgttcgtcaccgtcgtcatgccgaatatggatgcggcttccgacaacagcaaggtgcaggtgcagaaccatggcgcccagaaccatgccgaggacgatcccgattcggcgatcacgtcgggcagtgtgccgagcgtgcaggatcttacgggcgaatacaccgccgacagcaaagtgcggttcacgtgggtcaatccttcgccgaaggatggcgattcgtacgcgtggtcgctggtcggcgattcgggaaccgacccgaacgcgcagggcaccaccacggagtcgacgagtatcgaaatcgatccggccgacggcgcgcagacgtgcgtgcaggtgagtctggttcgcgcggaccggcagatgtccgagaatcccatgatcgcgtgcgcggccaagccgtgagtttgcggccggatgcgggtgacatgaaccgatacgaaccaatacagcccggcatgcatgcgggcaaacaggtaggcgcatgcggttggatgcgcggtcaagcaaagtttgggcacaatcagggaagagccagtcgatgagcaagcataggaacgccgagaaccagtcggcgcaatcgtacgaacggcagttgcgattcgggtcgatgctgcgcaagctgctgccttccggcagtcgccggtggatcacgccgatcgtcatgctgctgctgttgctgggcatcgtcgccggggccgtcatcgtcagttcggtgacgcaacgtcacgtgcagctcgacgatggcaccgtgtgggtcacttcgctcaaagaccgcaaggccgcccgtttcaacgtgcgcaaccgggacgccgatgcgggcgtcgcctccactgcggcccggttcgacgtggcccagcatgatggctccaccgtgatctccgaaggtacgaaggccagcaacatcgaggcctccaccgtcagcgaaagcggcaacaccaccatcaaatcggatatgcggaccgtcgtcggaggcaacaccgcggcgttcatcaacgtcaagacgggcaatgtgtgggtcgggtcagcagatgatgtgaaatccatgaatccgaccaccgattcgccgaagatgaagctggggtcgggtggccgtatcgcggtgacgcatgacggtgtcgtctacggctatcgcgcgtccgacggcgcggtgctcagtgtcgacggacctcagggaacgcccggcaaggatgcgacgatcaagggcgccacgaatgtcgaatcgttcaccgtggtcggcaagacgccggtcgtagccggtgccggcaaggtgttctggccgaagggcagcgcggatatcggcctgcagggtcaggcgacgttgcaggcgccgtccacggatggcaggcagactggctgggtggcggtttccacgccgcggggcatcgccatggtcgatttgggtagtaaaaaggtcacgcagctgccgaatgccggcaagggcgatgccgcgcagccggtgtccaccaatggctgcgtgttcgccgcgtgggcgcagaaggccaacaattacatcagggtgtgcgcggcgaacgacaaggacgcacagttttcctcgttggaagatgtcaatcccacctcgcagctcgtgttccgcaccaaccatcgtctggtggtgctcaacgacgtggtcaacggcaatgtgtggaatccgcaggagtccaccaaggtcatcaaaatccagtggaacaaggtggagaccaagcagtcgaagcaacagcagcagaacaacgacagcgccaacaaccagcataatttcagcaagaactgttcggcgcagtcggggcagatcaaggccgtggacgattcgttcggcgcgcgcgtgggatcgcagcagattctcgacgtgttgcgcaacgacgagcagaccgactgttccgtgctgcgcatcacgtcggtgagcgctccggatggcgcgaacatcaccgtctcccccgtctatgacggccggtatctgcagctcgacgcctccggtgccgccgcgggcaacgtgtccttcagctatgagatttccgacgggcgcgggcagacgtccagcgccaccgtgtcgctcacgctggccggcggcgacgaccatgcgccgctgcagagcgacactccgccggaaatcgacgtggagcagggtgcttcgtacaccgcgaacgcgttgggcagcttctccgaccccgacggcgatccgctgaccttggtgtcggcatcgccgcagaacaccgatcaggtgacggtgtccacgcgagccgacggacaattggtcttcaacgccggttcgatgtcgtccggcagggcgggcatcgaggtcacggtgtccgacggccagcagaccggcatcggcatgatctacttctccgtgaagccggcgaacacgctgggcgcggtcatcgaccccgtggtcaaacagaccacgcccgacacccgcaccaccatcgcgctcaaaccgtacgtgcacggcacgtccgtcgaaccggccgaattgaccgcggtggagacgccgtccggcgcggccaccaccatgaacgccaccgacatgtcgatcacgttcaccgcctccaatcccggcacctactatgtgccgtacaccatcacgcagggttccattccgtcgaccggtctggctcgtgtggaggtgcaggcggtggccggagacgccgccaagccgatcgcggcgaacgatgtggcgctgctaggcgcggacaataccgcgattgtggagccgcttgccaacgacgtcgacccgatgggcggcgtgctgtcggtgaccagcgtcaccgcggacgcgcaaagcggcatcaaaaccggtgtggtgagcaacaagcgcgtctatatcaccgcgcgtcaggtgccgaccgagccggtgcggatctcctacaccgtggccaacgcggccggatcgtcgaccggcgtcatcgtcctgcagccgccggcgctgaccacgtcgaattccgtgccaaaggccgagaacatcaccacacaggtgcgcaccgaaggcatcgtgtccgtggacgtgctcgaccatgtcacgtattccgacggcaccacggtgagcctgcagaacgacttgcagtatgacaagaacacgttcaagggtctggtgttcgtgtccggcgacaccgtgcgctatcaggccaccagacaaaccggctccttccccgtcacctacacggtgaaggacaatctcggcaacgcggcctcggccaccatcaccatcaacgtgcatcagaaggacgcgtccaacaaggcggctccgacaccgtccgacgtcgaggcgcaggtggcggccgggcagaaggtgcagattccgatcacgctcaccggcatcgacgctgacggcgatgacgtgcagctgctcggcttgggcaacaaagcgccgaaactgggccgtatcagcgagatgggcgccacgtatctggtgtatgaggcgtatgccgattcgtccggaacggacacgttctcctacgccgtggaggattggaccggtcagagggccaccgcgcaggtgcgtgtgggcgtgttcaaatccggagccgattcgggtgtgtacgcgcgcgacgacgagatcacgctgcgtccgaacaccgcggccaccgtgccggtggcgcagaacgacatttccggggacaatactgatctgaccgtggccaaggacgtggaatcgcaaggcatcggcggcattcaggtcgttgacaacatgctgtcgttcaccacgccgaagcaggcgggcacgtattacgtggtctacaccgtcaaggacaaggctggcctgtccgattcggcgacgttgacggtgaatgtcgacgagaacgccgccatcgacccgccgaccgcgtacgattaccgtgttccggccgccgccacgatcgacaagaaatccgtggacgtggacgtttcgcagtggattgccaatccgtccggcaccgccgacgagcttcaggtgggcgtggatccttccgcgaccgaccatgcgcatgtcaagggcggcaaggattccaccatcatcaccgttgatctgaccgatgaggcgcgcgcggtgccgtacaccgtcacgaacacgacgtacggcatcacgtccaccgcgttcatccaagtgcccgcatatggcgtgtttccgccggttctgcgtccgaaggcgccggcgttgaaggtcaatgcgcgtgagaccatcaccatcaacatcgccgactacgtgcgtgtgggcgcgggcaagaccgcgtatgtggacggcgccgattcggtgagcgccacgaaggccgcggacggcgacctgtacgtcaacgaccagacgttgaggttcaccgcgccgaaggattacgcgggtcccgcgtccatcaccttcaccgcggtggacggcaagcgagacaagaacgacaaggtgaagatcgtcaattcggcggtgctcacgcttccgatcacggtgatcggacgtgaggttccgccgccgacgttctcgtcctccaccgtcgatgtggtggccggcgagaaggccactaccatcgatctgacggcgctgacccattcgacgtcgggcctgtacgaggatgagaagcagtactcgtattccggcggcgtgaattccggcagtgtggatgccagagtgtctccctccggcacgttgaccgtgtccgcggacaagacggccacgccgggcaccacggtgagcgtgcccgtctcgatcaaatatgcgaagggtacggtgagcgccggtatgaccgtgcgcgtcaccgcgtccaacaggccgctcgcccgcgtcaccgagaagaccgtgaaaatcaaggccggttccagcgagcaggtgaatctgctgtccgacgcgtacaatccgttccccgacactccgctgacggtgaccggatgcacatccgacggcgcgtcgaagctgacggtggattgcccgtccaacggcgtggtgtccatcagggcggcttccgacatcggcgcgagcaccaacaaggtggtcgtcaccgtgcgcgacgccaccaaaacaaaggaacgtgaggtgaccggcaccatcagcgtttcggtgatggacaagcctgatgcgccgctgctttccgcggtgtccggcgacccgcaggatggcgccgtgaatctgagctggacggccggttcggccaacggcagcccgatcaccgaatacaaggtgatgtggggcggagacgcgtccggcgagcgctcgtgcgggcagaagacctcctgtctcatcgacgggttgaagaacggcaagacctactcgttcaaggtgcaggccaggaacgaggtcggctggtccaaggattccaacgccgtcgagggcacgccggacaagctgcctgatgcgccgacggatgtgacggccagtgtgaagggcaacacggtgagcgtcacgtggaaggctccggacggcaatttctcgtcggtgaacaattacgaggtgactttgtccggcaggaacgcaccgtccaagcagacgacaaattccaccggaatcgattttgttttcgataacaacgcgattttcgacggcgactcgtacacggctacggtacgcgcccacaacaaggtgaattggagccaaccgtccaaggcgtccgacgctgtcaagccgtggggcaagcccgatgcgccgaagatctccgtgacgaacgacgacaccacgggaaccgtcaccgtcgaatccgtgggcaacacccacaacgcgggatgcaaggccgtcgagatttccggagatgtcagcgcaagcatcgacggatgttccggatcctacgatttcaagattccggatcatgatctcaacaccagggaatacaccatcaaggcggcggtggtcggcaaggagaaaacgaccagtgacgattcgaccgtacgtttcacaccgaaatacgcggtgaaggcgcccgaatcggtcagcgtcaaggggcatgacgacgtgtgcgtagtcagttggaaggagaacggccacgccgacgggttcacggtgagcgcggacggactcggctcctaccatgccggcgcttccgaacgatcgcacgatttcccgctcaaggaatggcagtcctgttcctcgggctccgtcacgcagcatttcaatggcgcggcaagcacctccaagtccggcagggccgatccggcatacgtccgcaaggtgaaggccgccgtcaaggcgccgatgctgacgtgggacgccaatgatccgaacatcatcaaggtcagcggcggatcggtgaacatgtacggccagcccggcaaaaccgtgatcaccttcaccgcggacggcaaatcctatgacgtcgcctgggcattgggctccgacaaactgaacgtcaaggatgtgctgccgaccggagccgattacgcgtggaaggcgaaggtggtgggcaccgacaccgcgctcaacaacgaggacaatggcggcacactgctggaccatgacaggtacaagactcccacgccgaaacccgaaccgtcggaaccttcagaaccatcaaaaccgtcggaaccatcggattctgacgcgtccacggaaggcgaagcggccacgcggaatgaccggcctgtggcatcctccatcgccctgtccaccgtcgacggcgcatccaagccttggatccgcggcctggcctactacgccagatggtgaaacggacgatcacagcaatcgcaaacacaacgaaccatccacacgagcaacacaacaagcaaggagcaacccatgagcaacgatttcgatgacgccacccagctgggttccatcggccataatccaagcgttcccagccaacccggccagcagcagccggcgttccacacgccgaatctgccggagcagccgcaagccgatgaggatccggagggcacgctgctgagcgcgcacggcaccacccaaccggcgttgccgcaacagtccgccccggcaacgccgaaccagccgcggttccgtcagccgatgccgcagaaccttcgccaaccggccgccaatccggcagtcgcaatgcccgcgcagcagcccgtccagccaacccaacccgtccagcccagccagcctgtacagcccgtcaaacaatcccagccggtcatcgacacgtccatgatgaccgcacccagcaaagacatcaccgaattccatgagaagttcgccaagctcgtagacaacgtctcccaggtcgtggtcggcaaggaagcacccatccgccaatgcgccacagccatggtggtcggcgggcacatcctgctcgaagacaacccgggcaccggcaaaacccagctggcgcgaggccttgccaactccatcgacatgtcgttcaaacgtatccagttcaccccggacctgctgccgtccgacgtggtcggcgtcacctactacgaccagaagcgcggcgaattcgaataccgcgaaggcccgatcttcgcgtccatcgtgctcgccgacgaaatcaaccgcgcctcaccgaaaacacagtccgcactgctcgaagtcatggaagagcagaaggtcaccgtcgacggcgtcacccacccggtgccgcagccgttcatggtcatcgccacccagaacccgatcgaacagctcggcacctacaagctgccggaagcgcagatggaccgtttcctcatcaaaaccaccatcggctatccaagccacgacgtgagcgtcaacatcctgaaacaggtcaacgtcaccgaccgcgccgccaccgtgcatccggtgctcaccggcgaagacgtgctgcgcatgcgcaacatcagcgaaaccgtgcatctcgacgacgcgatcctcgaatacatcgtgcgactggtggaagccacccgccacaacgaacgcatccaagtcggctcctccatgcgaggcgcgctcgccttgacccgctgcgcgcgcgtatgggccgcctccgacaaccgcggctacgtagtgcccgacgacgtcaaaaacctcgccgtacccgtgctcgcgcaccgcatcaccctcaccgccgaagccaccttcgccggaaacacccccgaacagatgatcggccagatcctcgaagacgtgccggccccaaccctgggcgccaacgcctgaaacacaatccaccccggcatacgcaccacacaatccgaaaggtcaaggaatgcggcattcgcacacagtgcagcgcagacggaccatccaacgatccctacgccgcctcaaacatcgcatcaagcgactggccacctcatacgtgtcgccgcttggctgggcggtgacggcgctcgccgtcgcctcgctggtggcgttcgtcctgctgggatggcatgagctgctggccatggcggtggtgttcgcggtcatgctggccgcggcggtcatgctttcccttggcaacacctcgttccaagccaccatcgacgtgtccagcagacgcgtcacggtgtcagacacggtgaaagtcgacgtctgcgtggacaatccgggccgcacccccaccacgtcggcgcgcggcgacctgcccatcggagacaaccacgaacggttcgccattcccatgctcgccgcaggccagtcacgccagacgactgtggaattcaccgccgtcagccgtgcggtgctgcccatcggcccgctatccatccgcaaaggcgacccgttcggtctgatccgccacgaaaagaaactcgtggaccagatcaacgtgttcattcatccgcagaccgtgctgctcagcaccctgaacgccggcattccacgcgatttggaaggtcagccaagcggcgaaatcgtcgacgacgacctcgacttctacggcctgcgcgaatacgagcccggcgatgacgtgcgcaacgtgcattggctcagctccgcgaaaaccggatcgcttatgatccgccaatacgaagccacccgccgtaccgacaccgctctgaccatcagcgtgaacccggatgattacatcgattcccaggaattcgaactggccgtatccgtccacgcctccatcggcgtgcaatgcctgcagcagaaccggccagtcaccgcgcatgccggttccacgcacgccattccgcgcaacgccacggaatttctcgatggctgcagcggcatcgaccctgacatcgacgacaatcccaacctcgcgcaaaccactctcgaacatgcccccgacgcatccttctacttcttcaccgtcggcaggctcaaaaccatcgacgacatcaaacacatggtcctcgcactcccccgctccgcaacctgcgtggtgcttcaagccgcaaccggccaaccgcgcgccatcaaacgctactccgacttcaccttggcaaccgtgggagacctcaacgacctccccatgatcatgggggtgctggcatgagcaccacattcaccaacaccgacaatttcaccggcaacctcaccggcacaggcaccaactccgccaacaccaacactggcatggcgaccggcacaggcaccggctcatgggcggactccacccactccgtcatctggatgtcccgcagcggcaagtccccagccatgcccaacaccaaccagccacacgccgcgcaatacgcaagcctcacggtcgccgccctgctgaccatcgccgcagccagcaacctcatcgacgtatacggctccgccctgtcttggacgagcgccgcaatccccgccaccatcatcggctcgctcgtggcgcttgccggtctcgttcccgcgttgcgcctgtggtggcagatgctgttcatggcgtgtgcgcagctggtggtcggcccggtcatcttcctgaatggcaccaccatcgcccatgtcattcccacactgcgcacgttgacgcaagggtggatgcggatgctcggctcgttcaaatacctgctggccatcgacccgccgaccggcaccggcgacggctcgctgctcgccgtgtggacgatctgcctgtgggccgcgctgctggccggtattttcgcggttgcggaggatggccggcttacgatggtcgcggtcgttcccgtcgtggcgaatcttgcgatctgcgcgctgcttggcacgtcgagcggtttctaccgtatggcgatcggcacgattatggcggtcgtgctggtggtttgggtcagcgcgcgttggaaactgttggaattgggccgttggctcagttccgtagtcatcgtgctgctggcttcggctgtggcgatcggcggatgcttggtggtcgggcaaaaccgcaccattctgcgcgaccattatgatccgccgctgagcccgtacgattacaccagcccgttgagcggcatgcgttcgtatatcaagaaccataaggacgatgtgctgctgaccgtcgacgatctgccggccggttccacggtgcgtttggcggttatggaccgtttcgacggcaatgtgtggaacctgtccgattccaccatggcttcggattcctccaactaccatcgtgtgggcgattccattgcaaacaacgccaccggcaagcggttcaccgcgaaattcacggtcgatgacggtttgagcgactattggctgccgatggccggcgcggcttccagcgtgaagttcgccacatcgtcggacgccgattcgttctactacaacaccgacactatgtcggcgatctacccttcgcgcacctctccgggattgtcctatacggaaaccggcgtcattccacggacgccgacgaataaggagatcgccaaggcgaatgcttcctccatcagccagcccaaggcggaggatgtgcccgattgcgtggataagctggccaccgcgattgcgggcggccagtccaagggcggcgaggccgcgcagtctcttgccgacaagctcagggaatccggctggttctcccatggtttgaatggcgattacccgtccagggccggtcacggcaactatcgcatcgaccagctgctcgccggcagtgcgatggtcggagacagcgagcaatacgcttccgcgatggcgcttatggcccgcagtctcggcttgccgagccgcgtggtgctgggcttcctgccgaagaacgacgagggcgagatcagcgacagccgcaccgagaagcatggcaaaaccaccaccacgaaattcaccggcaacgatgtgaccgcttgggtggagatcaagctggacggttacggatgggtggcgttctacccgacaccgaaggaaacgaaggttcccgacgagaaccagaatctcactccgcccaatccgcagaccttggtgcgtcagcctccggtgccgcttaccgatccgctgcgtgacgacaaccaagccaagggcaaaacgtcgcttggcggcagcatggccgacgagacgccgacgagcctgttctggcagcgtttcggcagaatcgtcagaaaagtcgccatctacggcagccctctgtggacggtgctcatcgtctgcggcctgctgctcgccatcaaggcgatcgccctggctcgggcgcgcaggcatggcagcgcatcgcaacgcgtcgctgccggatggcaggcggtcgcggcgcttgcccggcaaagcggccttgacgtccaaggcaccagaaacgagcaggcgcaggccatcgccgaacagatgggcttcgaagccgatacactgctcgcgctgggcagggaggctgattacgcggccttctccggaggcgatgtcacgcaggagcatgcggaacgctactggcatgacatcgccgaagaacgaaagttcatgctcggctcgctgccgacgttccgcaggtggcgggcgaaactatcgcttgcggacgtgttccacttccggaaaatccgcttgcggaaaatcggtgtgaaagggcgggactcatgaacgtcaaacatattgaggtcggcctgaacagcaatatcggcttgcgtaggaaagacaaccaggacagcgcctgcgcaggcaacggcgtgtatgtggtgtgcgacggcatgggtggcggcaagggcggcaagcaggccagttccgatgttgcggaacggttcgcgcgtttggccgaactgccgacgcgcgatcttgacgcgattgaagaaacgctgatccttgcccagcaggaggtgctccgtctgggtgagcagctcggcggcgttgcgggcactaccatcagcggcgtgctgctgccgacgcgtgtcggcgatgacgcgatatgttccgacgaacggtgttacatcgtcaatgtgggcgattcccgcacgtaccatatgcgcgccgacggcaatggcgcgtggctggcggattcgctgacgtgcatcacccgcgaccattcggaacggcagaacgccatcgattcggggcagatgctgcccgatgaggcgagccgttgcattccgcgcaacatcatcacgcaatgtgtcggcgcgcctgccggcatccagcctgactggtacgccgcgcatgcggacggacggttcatcatctgttccgatgggctgcatgcgcagatcggccgtgagcagcttgccgagatcgcggcggcgtacgccgacccgcagatggccgcggacatgttggtacgcgccgcgctgaacgccggtggccgcgacaacatcaccgtcatcgtggtggatatgcgttccgatatgccgtgcgacaaggattggaacgtcagcaagatcggcgatgacgaggatatcgacgatgtgctggacggtacgttgcaaacgttacgagtcattcaataagatggttacagaccacgagacaaggagatcatgatggtcgatttcgatgccgcggtggcggccgtgcaggatccgaacgccgatcccatgttcctggcgaaaatcgcgtacgagaatccggaattcggtgcgaatgtcgttgccaatccgcgagcgtacccgggtctgaagcgttgggtcgccgaattcggcgatgagcgcgcccgccagcagctggtggcgatgggctggccggttccgcaaaatggcgtgcagccgcatctgattgccgaaccgacggcccagccaatggccgaaccggttgccgaacaggtccaaccggaacagcagtatcagccggcagtggcggaacagttccagcaggagcagcagtatcagccggaacagccggtgaaccagcaatacggtcaggacgctgcctatgcggcgtccaacgaggcttcgaccgagtatgtcgacccatacatgaatcccgccgatttgtccgaagtggccgattattcatcgagccagccgcagaacaagccggaacagcagtatgccgaacagcagtatgccgcggcccaggaatcgccggcagacgcggggttcaccgcggaactggccatgaccaccaccgatcagatgctgatggcccgtatcgccagcgaagcgtcggagcttcgtccgtgtcttgcgcgcaatccgtacatctatccggaattgcttgcctggcttggccagttgaacgattcggccatcaacgcggccattcgtctgcgccagcagtgagctaacgccgattatcagaccatttgaaacataaggggttgtcgcgggaatctccgtgacaaccccttatcgtcttaccgctaaccgtccgcgccgacgctgccaacacaaatcgtcaacgcagtccgtcagcgtaatcgtgtcttcactgacaaacgccctcactgtttgcggaattggaagaactggtcgccgatacgcaccgtgcatggcgcctccagctgcatcggcttgtgttccactttggtttcgacatcgtcttggatgatgtacgtgccgttgagcgaaccgtaatcctctatccacagcgtgccatcctggtcgaagctgatcgccgcatggttgcgtgagattgtgcgcgtcggatcctccagcttgaccgatttggcgccggcgggcacttcggccgaaggcttgcgaccaaggagcacgcccatatccacgatcacctgctgtccggtctgctcgttgtccagcacgtacgtgtgcttcggctgcttcatggtgaaggcttcggaaagcacggtgccgtcccagtcgatatcgtcctcgtccgaaacggcagcgtcgcccttcgcaacggaaacatcctgcatatcgtggtcgtccgattcgttctgtgcggcgagccgttcgcgtgtttccaaggaatcggcggcattgtcgacgggttcggctgtgggttgcgccatcaccgtgacgtcatcgtcataccaccctggttcgggcggcggcgggtaaggtagaaaactcatattcccattgtagaaaggtgacgtccatgccgtctgacgatactcattctgcaatacgatgctcgcatattccatctcaaaatagtcctatgccgagtatggcgcggatatgcaggaaagcgtcagcaagaagaaggacattgtggatcagatggccgatctgaatctcaacgatatcgagtatgggtccgccgattacgaaaagcttcaggatcttcattcgaagatgtccgacatcgattcgccgaccctggatcagtccgatttgcaaaaggccgcgaaggaggccgatctcagcggttcgttgaaggatctggaaaccacgctttcggagaagatcaagtaacgtcaaaagacgactgcgaaaccctcccccgcgattaatccacaacctcgcaatcccacgacatatagatatagcgaaaggcggaaccgaccggtattggtcggttccgcctttcgctatgtcagatgattcgtctgtcgactatcgtgaggggaatctcacagggtgtcgcccagatcggtctggccgccgttgtcgtccaggaagtcatccgggttgaagtcatcgcccagcttcaggtcgccgaagtcgatgttggagaagtccacatcggacaggtcggtgtcgccgaaggagctgtcggtgccttcgccgcccaaaccgaagttcgggtagatggtgtcgcggatggccttgtcgggctccaccgtggcattgcggtaacgggcgaggccggtacctgccgggataagcttaccgatgatgacgttctccttgaggcccttcaggtcatcgaccttctggttcagggcggcttcggtgagcacgcgggtggtctcctggaaggaggccgcggacagccaggaatcggtggccagcgaagccttggtgatgcccatcagctccggacggccggcggccggcttgccaccgttcttcacggcttccatgttggcggccttgaagcgtgccttgtccacgagttcgcccggcagcaggtcggtgtcgccggagtcgatcacagtgatgcgacgcagcatctggtgcacgatgacctcgatgtgcttgtcgtggatatccacgccctgggagcggtacacggtgtgcacttcctccacgatgttcacctgtgcggcgcgcgggccgaggatgcgcaggatcttcttcgggtcgacggagccttcgatgagctgggtgccggcttcgacatggtcgccgtccttgaccagcatcggcgcacgacgggtcaccgggtagacgatcggctcgacggagtcgtcgtccggcttcagggtgacctgacggccgcgctcggtgtcttccaccttgaccacgccggcgaactccgcgatcggagcctcgcccttcggggtacgggcttcgaaaagctcggtgacacgcggaagaccctgggtgatatcggaagcggaagcgacgccgccggagtggaaggaacgcagcgtcagctgggtaccaggctcaccgatggactgtgctgccacgatgccgacggcctcgccgacgtccaccagcttgttggtggccagggaccagccgtagcacttggcgcacacgccacgcttggattcgcaggtcagcacggaacgggccttgacctcttccacaccgtgggcaacgagatcgttgagcacgtccatggacagggcgtcgccggccttatacagcacggtctcgccgtcggccgggtcgatgacgtcggccgcgagcagacgggagtacgggccaccgtcggcggccttgaccaggtgcaggttgccttcggcatcgcgttcgccgaccttcatggtcaggccgcgcttggtgccgcagtcctcctcgcgcacgatcacgtcctgggagacgtccaccagacgacgggtcaggtagccagactctgcggtacgcagtgcggtatcggccagacccttacgcgcgccgtgctgggagatgaagtattccagcacggacaggcccttacggtagttggacttgaccggtcgaggaatgatctcgcccttcgggtttgccaccaagcctcgcatacctgcgatctggttgatctgcatcatgtttcctcgtgcaccggactgcacgatgatggccaggttgttcttggaatcgaagtgttcctcaaccgcctcggagacctcgctggtgcacttggtccacaggtcgaccagttcctgacgacgctcctcttcggtgagcataccgatttcgtagttctcgttaaccttgtcggcttcgccttcgtacttttcgatgtactcgtccagttccggcggctggataacgtcggagaacgcgaaggacacgccggaccacggtgcgcgggtgaagcccagatccttcagggcgtccagtgtcgcggccacctgagcggtggagtaacgggtcgcgatgtcgtcgacgatcttgctcagacgcttcttcggcgcctgctcgttgacgaacgggtagtcgaccggcaaggtgccgttgaacaggatacggccgtaggaggtggcgaacaggacggagccgtcatggaaacgctcctccttgaccacgtccgggctgcccggttccggatcgacgaccttgacctcgcccggctcccagtccttcggcagcacgaagtcctgcggaaggcggatgagcaccttggcctgcatgtcgatctcgtgcttgtcgagcgccatttcggcctcttccagcgaggagaacacgcggccctggcccttggcgccgtcgatgacggtggtcaggtagtacagaccgaggatcatgtcctggctcggcatggtcacggtgtggccgtctgccggcttcaggatgttgtcggaagccatcatcagggaacgggcctcagcctgggcttcggcggacagcggcaggtggactgccatctgatcgccatcgaagtcggcgttgaatgcggcgcaggcaagcggcggcaggtggatggccttgccttccaccaggatcggctcgaatgcctggatgcccagacggtgcagcgtaggtgcacggttcaggagcaccggatgctcggagatgacctcttcgagcacgccccatacttcggagtcggcgcggtccacgaggcgcttggcgctcttcatgttctgcgcgaagccctggtccacgaggcgcttgatgacgaacggcttgaacagctcgagggccatcggcttcggcagaccgcactggtgcatgcgcagggacgggccgaccacgatcacggaacggccagagtaatccacacgcttaccgagcaggttctgacggaaacggccctgcttgcccttgagcatgtcgctcagggacttgagcggacggttcgaagcgccggtgaccggacggccacgacggccgttgtcgaacagggagtcgacggcttcctggagcatgcgcttctcgttgttgagcatgatctccggggcgccgagctcgatgagacgcttcagacggttgttacggttgatcacacgacggtagaggtcgttgaggtcggaggtggcgaagcggccaccgtcgagctgcaccatcgggcgcaggtccggcgggatgaccgggatcacgtcgagcaccatggcctccggcttgttgccggtggtcaggaacgcgttgacgaccttcagacgcttcagagcgcgggccttgcgctggccggtgcccgtgtcgatctcttcgcgcagctgcttggaggctgcctcgaggtcgaagtcctgcagacgcttcttgatggcttcggcgcccatgcagccttcgaagtaatcgccgtagcggtcttccatctcacgccacaggtcgacgtcgccttccatgtctcccggcttcagggtcttgaagcggtcgaacacggcgctcagacgctggatctgctcgtcgtagcgggtacggatggcggccatttcacgctcggcgctgttgcgtagcttggcgcgtgcggagcccttggcttcgccttcggcttcgagctcggccaaatcggcttcgaccttcttggcgcgctcctcgatttcggcgttgcggcgcttctcgaggttggcgatctcgttgtcgaactcctgctgcaggtccggcaggtcctgatgacgctgctcttcgtccaccttggtgaccatgtaggccgcgaaatagatgaccttctcgagatccttcggagcgatgtccagcaggtagcccaaacgggacggcacacccttgaagaaccagatgtgggtcaccggagcggcaagctcgatatggcccatgcgctcacgacgcacacggctcttggtgacttccacgccacaacgctcgcagacgatgcccttaaaacgcacgcgcttgtacttaccgcaggcgcattcccagtcgcgggtaggtccgaagatctgctcgccgaacaggccgtctttctccggcttcagggtacggtagttgatggtctccggcttcttgacctcgccgtagctccagttgcggatgtcgtcggcggtggccagtccgatcctcagtttgtcaaattcgttgacgtccagcactctattgtcctgtctatcgattcttaatgcttatcacgttgttcggggaccgaccgcggcgcacgctgtgtcatgcagcgcggccggtcctttcgatcactggaattcgggttcctcggcaacctgatcttccttggcggcagcgtcaggacgcgcaccaatgttgaagcccagatcatcggaggatgtggacggatcgtcgtcctcttccttcatgtcgatagccacgccgtcggcgttgagcacttcgacattcagggacagggactgcatttccttaagcagcaccttgaaggactccgggatgcctgccggcggcaggttctcgcccttcacgatggcgccgtagacgcgcacgcggccgtcgacgtcatcggacttggtggtcatcatttcgtgcagcgtgtaggcggcaccgtaggcctcgagggcccacacttccatctcgccgaagcgctggccaccgaactgagccttgccgcccagcggctgctgggtgatcatggagtacgggccggtggagcgggcgtggatcttgtcgtcgaccaggtggtgcagcttcagcatgtacatgtagcccacggagatcggcttcgggaacggttcgccggtacggccgtcgaacagggtcgccttgccgtcggggccgacgagcttgttgccgtcgcggtccggaagggtgcagctgagcaggcccttgatggtttccggacggacgccgtcgaacaccggggtggccaccggagtgcccggagcgcccttttcggcgccctgcggcacgtacttcttccaagcggcctcggcatccggatccagggagatgtcccagccagcgtgcgcgatccagccgaggtgcagttccagcacctggccaaggttcattcgagaaggcacgcccagcgggttcagcatgatgtccaccggagtaccgtcggcgaggaacggcatgtcctcttccggcaggatgcgggagatgacgcccttgttgccgtgacggccggagagcttgtcgccctgggtgatcttacggtgctgtgcgatgtagacgcgaatcatctggttcacgccgttcggcagttcgtcgccgtcttcctcggcgtcctcgcgggtgatttccttgaccgcgatgacggtgccggtctcgccgtgaggcacgcgcagcgaggtgtcacgcacttcgcggctcttctcaccgaagatggcgcgcagcaggcgctcttccggagtcagctcggtctcgcccttcggggtgaccttgccgaccaggatgtcgccggcttcgacttcggcgccgatgcggatgatgccacgctcgtcgaggttggccaccgcgtcctcgccgacgttcggcaggtcgcgggtgatctcttcggcgcccagcttggtttcacgggcatcgatctcgtactcctcgatgtggatggagctcagggtgtcgtcctgcacaaggcgctgggagatgatcacagcatcctcgtagttgtagccgttccacggcatgaaggcgatgagcaggttcttgcccagtgccatctcgcccttctgggttgccggaccatcggccagcacggtgccggcttccacgcgttcaccgtcgtggatgagcgggacctggttgtagcaggtggtctggttggaacgctggaatttggccagcttgtaggagctggtggtgccatcgtcgttcatggtacggatgatgtcggcggacacgtaggtcaccacgcccggcttctcggccaggatgacgtcgccggaatcgacggcggcgcgccattcggcgccggtgcccacgagcggacgctcggattcgatcagcggcacggcctgacgctgcatgttggtgcccatcagcgctcggtggccctcatcgtgctccaggaacggaatcagggaggcgccgacggaaaccatctgacgcggggagacgtccatgtaatcgacggagctgaccggcacatcgaccgcttcctcttcgccgactcgggcaagagcctgcttcttgacgaagttgccgttctcgtcgagctcctggttggcctgggcgatgacgtgctcggcatcgcggtcagcggtcatgtactcgacttcatcggtgacgtggccgttgacgaccttgcggtacggggtctcgatgaaaccgaacgggttgatgcgaccgaaggttgccagggagccgatcagaccgatgttcgggccttcaggagactcgatcgggcacatacggccgaaatgggacgggtgcacgtctcgcacttccatggaggcgcggtcgcgggacaggccaccggggcccagagcggacagacgacgcttgttggtcacgccagccagcgggttgttctgatccatgaactgggacagctgggaggttccgaagaactccttgatggtggcgttcaccggacggatgttgatcagggactgcggggtgatggcctcgggatcctgggtggtcatacgttcgcggaccacacgctccatacggctcagaccggtgcgcagctggttctggatcagctcgccgacctggcggatacgacggttgccgaagtggtcgatatcgtcgacgtccacgcgcaggtcaacgtcctggccgtcgcgcttgcccgggaacttggtctcgcccgcatgcagggtgaccaagtacttgatggtggcgatgatgtcctcgcgggacaggctgcggtcgttgacgtccttttccagaccaagcttgcggttgatcttgtaacggccgacgcgggccagatcgtaacgcttggtgttgaagtagaaggagtccagcaggttcttgccggcttccggagtcggggtgtcggccggacggatcttgcggtacaggtcggtcagggcctcgtcctgggtctgcacggtctccttggcgagagcgtccatgaccagcgggtagtccttgaaggcgtcggcaatttcatccttggtcatgccgatggccatgaggaacacgatggcggactgcttgcgcttacggtccacgcgcacgccgaggacgtcgcgcttgtcgatctcgaactcgagccatgcgccacggctcgggatgatcttcgcgccgaagacttccttatcggaggtacggtcctgggaacggtcgaagtacacgcccggggaacgcacgagctgggacacgatcactcgctcggtaccaccgatgatgaaggtgccgtgcggggtctgcagcgggaaatcgcccatgaacacggtctgggacttgatttcgccggtgtcgccgttctcgaattcggcgttcacgtacagcggcgcggagtaggtgtaatccttctccttgcattcctgcacggtgtggcgcggttcttcgaagtacggatcggagaaggtcaggctcatggtctgagcgaagttctcgatcggggagatctcctggaagacctcgtcaagaccggaggtgtggggcacggtgttggtgccgttctccagatcctcctggactcgcttctgccagcgctcgttgccgatgagccagtcaaagctgtcagtctgtacacccaacaggtagggtacatcaatgggctcgcggatggagccgaaattcacacggtccgacgccttgtgcagatcaatatcatgctggtcggcgcgtgcgatgatggtggtggtgttcgtcgtagcctcagccaatggacgttccttatcgctcgctaatcgtatcgatatgtttccccggaagcgctctcattggccaccatatgcctagtacgcgggcgcttcttccttgtcagcgtgcccgctatatgacacgcatctacgcaaagtcataagaatagcataacctgtagattttattccactgtgatgccgaccggctccgacttggttttcgcatgtcctttgaccgacagttgggccgaatacacgccacggtccacgttcggcaggtccgccgcgtcggcgcattcgctgccggaacgcacgcccggccaagtgatcgtctgcttgacctcgtcgcccttggctatcagccggtaatccgtgtccacggggcatacgttcgatttccagaccacgtccttgcccgacttgatcgtcagcaccatgcccgcctgggacacgtcgatcagacagccagccttgccggaaccgttgtatttcacggaagcggtgaagtccatcgtgccgcccacaccgaagctcgatgcggccggagtaagcgacagcgcgacgttggatgcgtcgcaatcggggacgctgcttttctgctgttgggtcggcgacggcacctccttgcgggagatcgcgtaaacatcggcatggtggatttcgcggttgacagcgacgacgccctgcgtcagcgaatacaggcagaatacgatgaagctcagcaccagcaccgtcgcgataccgaaaacgatgcggcggcggcgatacatcgcctgctgttgtttcgtacgtttcttaccggtccgcggggaggtcttgtaagccatggctcccagtctagcgtgtcatcctccgtgcggcaccgcggccgcacgcaccacgcatgccgtgtacgttacaccggcagccgcacccctcccccgggcaggatttcgatcagaccgtcctcgtcaagcgacgcgatgcatttgtccagctgcacgtggtctttccacagccgttcgacgctcttgcgatcaagcaccgtctcgccatccggcaggccgcgcagcgcgttcagcaccagcccgcgcacctgccggtccgtaccttggaatcgttggcgtggtcgcgtacgccgctgccccaatcccggtcttccgttgcgtaggaacgcgcattttccggcgatcggacaggcttcgcataatggcgatttcgcagtgcacaccgtcgcgccgagttccatgacggcctggttccacacgacggacgggcgatcgaaacgacggcatttcgcggaatcatcgtccggcagcagccgtttcgccagcgcgcgttccgcgggacttgcgctgccgccgagcgattcgacgccgacgaacgcacgtgacagcacacggcggatgttcgtgtcgaccaccgcgatacgttcgccgaaagcgaacgacagcaccgcgcttgccgtgtaatcaccgatgccgggcagagcaagcaattcgtcgtacgtatgcggcagctcgtcggcgtaatcgtatgcgatgacgtgcgcgcattcctgcaatcgcagggcgcgccgcggatagccaagccgcccccatgcggtgatcacgtcggatttcggggcgtcggcgagcgcggctgcgtccggccatcggtccatccatgcggtccaatacggcacgacgcggcccatctgcgtctgctggctcatcacttcggaaacgagcacgccccacggtgtggtgcggccgaatcgccatggcaggtcgcgcgcgttggtctgccaccattgcgcgagcgtcgttgcgatttcgtcagcatcggaagcatcggaggtgacggcggtggcggaatcggcaaagtcgtcaaagtcggcgtcacgtacggcggtgtcgtatgtggtgttcgtgtcgttcatcgttcctattcttagcatttatgacgaacgaagaacataccgataacgcgcagggcgcaacgcgcgacgccgagacgcaggcggccgaagccaaggtcgagaagatgttcgaatacgggtaccgcaagtccaattacggcccggacgaactggtgaccgacgcgcacggcaatccgatttccgtggtggacgcgatgctgagcgcgaaggacgcggcgaaggcggagacctccaccccgcacctgtgctactactccccgcgtattccaggcaacacgggttccgcgatccgcctgtgcgccgtgacgggaacgattctgcacctggtggaacctttgggtttcaatctgcgggataccaagctgcgccgtgcggggctcgactaccatgacatggcgcatgtggtgctgcacccgaatttcgaggatctggtggaatcgatgccggattcgcgcatcatcgccttcaccgcgcacgccaccaagctgtacaccgacatcgaatacaggccgaccgacatcctgctgttcggtccggaaccgggcaatatccccgatccgatggacatcatggccggcccgcatgtggccgagcaggtgcgtctgccgatgcgtccttcgctgcgtagcctgaatctcaccaactgcgcctccatcgccatctacgaagcctggcgacagttgaactttgccggcggtaagtaaaaacagttttacaaacgcaaaagagcccggccctccgtgcaggaaggtcgggttctttcgtaagaacgtcagttcttgaaggagtggatcggcgccggaatgcggccgccacgggtcacgaaggcctcgcagctggtctggttcaccggaatgatcggcgcgtagcccatgaggccgccgaagttggccatctcccctacgcccttgccttccaccgggatcacacgcacggcggtggtcttctggttgaccatgccgatggccgcctcgtcggcgatgatgccggaaatggtggccgcggtggtgtcgccggggatggcgatcatgtcaaggccgacggagcatacgcaggtcatagcctcgagcttttcgatcttcaggcagccgttgttggccgcgtcgatcatgttcttgtcttcggagaccggaatgaacgcgccggacaggccgcccacataggaggacgccatgatgccgcccttcttcacctggtcgttgagcatggcgagcgcggcggtggtgcccggtgcgccaacctgttcgaggccgatcttttcaagcacttcgccgacggaatcgcctacggccggggttggcgcaagggaaaggtcgatgatgccgaatggaatgccgagtcggcgggaggcctcctgggccaccagctggccgacgcgcgtgatcttgaacgcggtgcgcttgatggtttcgcacaggaactcgaagtccttgcccttggcctcgtcgagcgcgcgggagaccacgcccggtccggagacgccgacgttgatgaccgcgtcgccttcggtcacgccgtggaagccgcctgccatgaacgggttgtcgtccggggcgttgcagaacgccacgaacttcacgcaaccgtaggaatcattgtctgcggtggcgtgcgcgatgtccttgacgatgtggccgagcagttcgacggagttcatgtcgatgccggttttggtggagcccacgttcacggaggagcacacgatgtccgtttcggaaagcgcctgcggcagggagcggataagcatctcctcggccggggtcatggacttggacacgagcgcggagtagccgccaatcaggtcgacgccgaccttcttggccgcgcggtcgagcgcgtgcgcgatcttgacgaagtcctcggagctcttgcaggagcttgcgccgaccagggaaatcggggtgacggtgatgcgcttgttgacgatcgggatgccgaaatcgcgttcgatggcccggccggtggacacgaggtccttggcgtacgtggtgatcttgttgtagatgttctcgcagacctcgtcgacgctgtcggctgcgcaatccagcaggctgatgcccatggtgatggtgcgcacgtcgagcttctcctgctcgatcatcttgttggtctcgtggacctccatgatattcagcatggtttttccttacgattggtacgattcgtagcttcggttgcttgcatggcttacgtgtgccgcggatcagacgcggtgcatcttggtgaagatctcctcgcgctggcagcggatgcgcacgccgatctcctcgccgagcttgtcgaggtcgtcgacgactgtgccgaattcctcgtccgcgttggaataatccacaatcatcatcatgttgaagaaaccgtcgatgatggtctgggagatgtcgagcacgttgacctggtgcgcggaaagataggtgcagacgcgggcgatgatgccgacagtatcctgaccgacgacggtgatgattgccttgttcatggaactccctaaacgtgaggtgtgaatatccagttgccgtctcggcaaattgccggacgtgccctcaagtataggaaaggcacgtgccaaaacacccctctctcccgcttttcgcattacatggtgagacgccacacgcgcatgtcagtagtcaaacgtttacctaggtcgtcaccgcccacggattcacccgcgccgtgtcgcaacacagcatgacatgcaacatccgccggcaaattacaacgcagcgcacatatcgtgcccatatctcgcgcatatcgcgtacatacccctacacatacggcagcggccccgcacccgccgtgtcacaaggaacacgcaggaacggggccgccggatacggctctacgtcttagcgccaaataccgttcaatgcacgcgcatcaaccgcatcgatcttgccggacgacgcgatgcgaagctcaccgtcgccatcagcgccttggaacagcatgcttcctgccgtctgaccgccattgaggaacacttcgacaacattgcggtcgaagaacacctccacctggcgaacatcggtgatgccgctgtcgaagtcgacatcctccaccgcagtgcccttggccaccaggcgggtcacgccatcagtgcgctgcagcagcagttcggtcggcctgccgtcctgcgggttgacgcccttcgccagcaccatgatggcatcggcatcatccgccagatgcacgttcgcatagtatgcgttgccgggagccgtaacgaccatatccccgccatcgccgtgcacggcaagacgctcgccgagcagctcgcggtacacttcgctcaccggcttgctgtacagcctgccgtcacgcacatgcaattcgcgcggcagcgacatcatgccgttggccaggcacggctgttcgacacgcatctccggaaaatcggtgaaccagccgaatacgatgcgacggccgttatcgtcggcgaagctttgcgtggcgtaatatccggtgccgaaatcgcaccagtcgctggccttgacatccagtttcggaccattatcggtgttcaccaagtcgccggcataccaacgcacctgctggaaacgcccctgcttgtcgcggtagtgcatcagcgcgccgacggcaacggtcacgccgtcgacctggaacaggtcagggcattcgtaggtgcgtgcgatctgatggccgaaatcggcgagcaccggcccttcgtagcgccatgtcacgttacgcttgagcggcttcttcgcggagaacaacgtcatggcgggaacggtggcgttgttcggctggtcgacccccggcttgccctgaggagaataagtgaaccagccaccggtattctgggtgctgatgccgggaaccgcactatcggcggcgtctgcgccaaattccgataccggcagattggtggcggttaccatataggcacgatccgggtcgagcgcctcgccgcccatgccgcattcaaccttcggatcacggaagtcatagccaaaatcgtcattcgcacgcagcgccaccggcgattccacgcgaacatgcacgccgtcctcgcacaggcaggtggtctggtattcggtgacggaggattcgtcgccgcgggtttccagatgacgggtcaggtacaggcggatggcgtttgcctcgttgccggcgaccggattgtcatgctcgtccacggtcacggccgaaccggagaacgcgccgccgacgatacgctcgtcggtgtgcagttcgggctgcggttccaggaagactggcagatgagtccaatgcaccagatcacggcttaccgcgtgcccccaatgcatattgtcccagccgaaaccatacgggttgagctggaagaacaggtggtagcgcccttggaactggcacaggccgttcggatcgttcatccaacgtgcgaacggttcgaaatgcgcgcccgaacgcccgaaacggttgtagatctgttccagcgtgggctgtgcaggccaatcggtgtcgcttggattcatgttcacgtagcgaacgccgttgtcaagcaggtcatcgcattcggaaaggtagccgaagcgtacaaccaggccgcttgccgccacggtgacggtggatttctgcggcaccgcaatggagaaatgatgcctgcgttcggcgatgggcatggtgtgcgccgcgattgcgacgccgttgccgtccgcaacggtgacgacggcgttcccctcgccacagcgttcggcgaacagatcgagctgccggtagccgccggtttcgacggagatggaataggtattcgacatagtagacccctctacacgtgtgaaatgaatatggaaaatggatggaaatactcaaagacgcagtgccgtcaggaaacgatcgaatcgcgttcgatgatgcggcatcgcaacggtgtcatcgggccgttctccaaacgcctgatcgaatcctcactgcgtgcaaggctttccgtggcggcttcatcgtcgatcatggcgaccagctgatgcaccgcttcgaagcccatttcgtagtgaggaagctccaaggtggtcaacgcgggcttgagcacgtccgtaatgagcggctggttgtcgatgctgatcacggaaacgtctgtgccgatgccgaccgaccgctctctggccgcctcgtagatgaaggtcgcgcgcacatcgttgaagcagaagatgccgtccggcttgatctcgtcgaacacgcgaccggcttccgaagcggcgtttgtggcctcttccacgttgacgaccaactgctcgtcgaaggggatgcccgcgtccgcgagcgctcggcgatacccggcgaaccgctccccctgggcgataatggtgattgaggaaccgtagtaaacgatgcgtttgcagccggcctgaatcagccgattggtggcatcgtaccctgccatttcgtcgtcggggtagatcgagggaatcttgcgattctcgtcttcgctgtcgacgacgaccgtggggctgccttcgagttcggcggggatctccacaacacggtggtacatcatggcatacaggaaaccgtccacgcggtactgccgcagggccgcgatctcctggttctccagttcccgatcgtttcccgtgttgacggtgagcagaatatagccgagtttgcgcgctgcctcctgcgctcccaccagtacgcgcccggcatgtggcgaggtggcgatctcatcggtgataaagccgaggacatacgacctgctggtgcgcaatgtacgcgccacggagttcggcttgtatcccattgattgggccgttccgcgcactcgttgcgccaccgccttgctgacgcgattgcggtccttgttgttcatgaccaatgacacggtgcaactggagacgccggcctcttttgcgatgtctttgatcgataccaatggttttgccttgtctgcttggcggctttgtgaagcggattccattgtatgcccgcctttctttggcgacactctgccgttcagcttttcgcgtatcggatgcccggctgctcccggtcatggatgtccattcccggaatccggccgaacgagtacacgatccacgcagtgcagaacatcggcagcgacatgccgaacaccatgagcagacccggccattgcgcccaggcaaggatcgccagcagtgcgagtccgatctgcagcagggtgcacagcggacgggccacgatcatggtcagtgttgtgcggacgatccacagcggacgttcgtcatagttcgcgcgcaccacccagaccagcatggtgaaggccagcaataccagtgccagcacgaacagtacgccggaaaccgccacgtcgaacgttccgcgtgcatgccagttcatcatgtagtagtcgatggcgagcaccacccagcatacggccaacggccagccgaagagattcgcctgcttgagctcgtttttccatgcgccgtggaagatgccccatacttccttggcacgcatcgaccgatcctcagcacgcagccacgtgcggaacgtggtttgcgcggcggcgcaggatgggaagaatcccagcaccacggcacccagcagtgtgtgcacgagcatggcgatgttcaccacgaagatcgtgagcagcagacggcagaaccgttcataggccacggaaaaacgagcgagcatggcgaatccctttcaatcagcccttgacggcgccgagcatgacgcccttgttgaagtacttctgcaggaacgggtacagcaccagcagaggcagggtggagacgatgatgatgccgaacttgatctggtcggccgcctgctgttgggccgcggcgttgacgttcgtaccggtgccttgtgccaccagcagcaactgctgcaagaccacctgcaacggctgctttgtgtcgtcggtgatgtagatcaagcctgtcatgaagtcgttccagtggccgacgaagtagtacaggccgatgacggcgaggatggcggagcttaacggcagcacgatcttgaagaagtagccgaagtagctcaggccgtcgatctgcgcagcatcatgcagttcctccggaatggaggtttcgaagaaggagcgcgccacgatcacgttgtatacggagacagcgccgggcaggatgaacacccacatggtgttgttgatgccgagggctttgtacagcaaatagttcggaatcaggccgccgctgatgaacatggtgacggtgaacaggaacatgatgacgcggcgcggcttgaattcgcggcgggacagcgcgaaggcgcaggggatggtcacggccatgttgaccgcggtgccgaccaccgagtagatgatcgtgttgagatagccctgccagatgcgatggttggtgaacaccttcgcatagccggcgaaggtcacgcccttaggcagcagtgacacttcgccgccggccacagcgttcggattggagaacgatgcgatgaccacgaaccacagggggtagagcactgcgaccacggtgaacaccagaagcagcacgatgacaaagtcgacggccagatcacctggcgttttcttctgacgtacatgcttgttccagggaatatcgttcttgctttgggcaacggccccggttgttgttgcagacatgatgactgcctcctagaaaatgctcgtatcggaaacgcgcttggcgatcgcgttcgcggtgatcaggaagacgaagttgaccaaggtattgaacaggccgatggcggtcgaatacgaatactggccgttaataataccgatcttgtaggtgtaggtcgcgatgacctcggtggccggcatattcagcgaattctgcatcaggtagatcttgtcgaaacccacgttgagcacggaacccatgttcatgatgagcaagattgcgcaggtcggcatgatcgccggcaggtcgacgtaacggatcagttgcagacggccggcgccatcgatcttcgcggcctcgtacagcgaggtgtccacgccggcgagcgcggccaggtagatgatggagttccagccgacgtgctgccagacttcggagatccagtagacggcggtgatggcgctggtggagcccatcagcgattcgtcgccgaagaagcggcccaggatgccggagcccggggacaggaagatgttgagcatcgagacgatgaccaccacggagatgaagtggggcatgtaggtgacggtctgtacgaagcccttgattttcttggagccgatctggttgatcagcagggccaggatgattgggaagatgaagcccatgaccagcgtccacagggagatgcggacggtgttggtcatgatctcgccgaagagcgggttatggaagaactcgttgaaatatttgaatcctacgaacttgccgccggtcagacccttggtcgggtcgaattcacggaaggcaagctggatgccccacatcggcacgtaggcgaacaggccgacgaagaacagggcgggagcggtgaggatccacagctgccagtagcggcggaagtggtcggcgatgcgatcgagcagacctggtttcttgcggtcgggagccgcttccatcgccacggtccgtgcagcaacgccttgcgatgtttgtgcactcatgttggtctccaatttaggatgattgctagggaacaaaaatgcggggtccggcggcagtcacgggagagaaacgaacccgtgcgatggaccccgcggtattacttggctacttggtgtacttgtcgtaccacttctgccaaatcttgatgttggcgtcgaggccgagggtcggttcggacaccttcttcacgtaggcatcccattccttgtcgatgccgcccttctggacccacttcgcgatctggttgttcgcgtagttggagatggcggtgttgttgttttgcagggtgttggagtcctcggtattcgggcgcacgtaaatcggtacgacatccttgacgccgtcgacgcggttgcgcgcctcacgaatggccaaatcggacgcagtgacctggtcggcgttggtgtcgttgaccatcttcacgtcgtcgcgaatccagccaccgaagcggtcctgcagggcgacggcgcgggtatcaggatattcggcgtaggctttagccttgtcgatggtgtactggtggtcgccgtcatcggagacgatatccggaatagagccgaagaatccagccacggaaagcttctcgccgtacatggcgtcgatcaccttgtagatggcgtcctggttggctgcgttcgggttgacggtcaggccggaaccggagtaggcccagcggcaggcgtcctgggaataatcccacttgacctgggagtcgggcgtggaggcgtctttcttcagcggcggcagggtgacgtactggtcgccaagcgcgttgccgtattcggagtagttggaccaaccgaaggagacgccggtcagcgcggtcttgccgtcactgacggtctgcgaagtgtattgcgaggcgtcgcgggtgagcacatccttcgggataaggcccttggccatgagtccgtgcaggtaggagacgacgtccttgagcgcgtcggaggtgtaatagctcttaaccttgccgttgtccacataatagccctgttcggaagcgccgccgcccatgaaggaggtgaccacgccttcggagttcatcagcgccagagggctccacaggccgaagccgaggctgcggatattcatcggcacctcatcggccttgccgttgccgttcggatcctgggtcttgaatgcatcgagcacgttctcgagctcgtcccaagtggtcggcatctggagtcccagcttgtccagccaggtcttgttgataaacatgtgagtgccggaaacctcgtaacccttgccgcggtcggagggcagcatggcgatcttggtgccatcggtaacgtacttcgcagcgcccggctgggccttgaggaacttcttgacgttcggcatcttatccagatgcggcttgagatcctcgaagtaggtgctgtacttggccgcatccaccatgctgaacaagctcaagccaatgtccgggaattcaccggcggccatcttggcgctcttctgctgaccccaagcgttgtcggcgacttcctgccacttgatggtgcagtcgcaggcggcttccagatccttggtgtactgggtgtcctgcatcggatggtcggtcacgttgcgacgaaccagaatattgacgattggcttgccgttctcgtctgtggtggcctgcttgttgccgcaggcggcaaacgtcgtgaccatagtcgcgactgcagctattgatgccaacaggcgaacacttcttcgtgccatgattaggctccttcttccttgatgtttcctcctcgtaccgatgtaagacgcaccggtacgacctcatcagccgcttgctttgcggtgattaacactataaatcgttaatcgtttaatgtcaaacgttaatcgtttatctcaatagttagcgctctcatcaaccagtccccccagcgtcgcaaacgtaaacttcggctccatactgccgttcttgcagaacaccggaatcacccacatcgcgacacgccgttaatcgtataacgtatcgtttttcatcaaatacacgtacaacccgtccgttgtacgcacaaaagcgtagccgaacatgacggccaccaagtcgacacgtcgctacttacgaaaggtgctcccctccttcagaaaagaaggaggggagcacgaatacgatcacagacagcatcaggccaaacacgtagccgcaccgggagccgggatgaagcattcggcatcgtacctgctggtcatcgctgtgggatacgctggtgcgccatctggtccacaagtaaatcgtgcaaaacgcgcgttggcgcacgtcctttttcatgggcgtgcgccaacgcgcatttttgcatcggcttctgcgatcaggcctcgcggctcgcggaagccgcagcgaacgccggcaaggcgcgaggcgcgttgaagccttccttttcgaagcggtcagcaatcttctgtgcgatctcgtgaccctgacccttgtccaccaacgcgatgatggagccgccaaagccgccgccggtcatacgtgcgccgtacgcgccgttgacacgagccacatccacggcaatatccagctcgggcacagtcacttcataatccgcagcgagcgaatcatgagacgcgttgaacagtcggcctgcctcgtcgatcttgccgttggcgaaggcacgcacgaaggagttgacacgggcgatttcggtgatgacgtggcgcacgcgcttcttcatcgtgtcgtcttccagcttgtcgagcgtttccttgagcgcctggaacggatcgtcggacttggcgatgctgtcggcgaccacacgcaggttggccacgccgaggatttcggcagccttctcgcaagtggcacgacgctgggcatactggccgtcgttgagctgatgcggagcctgagtgtcaagcaccagcagttccagaccgtacttgtcgagatcgaattcctgctgggagacgttctccagcgggctcagctctggacggcagtcaagacgcaacgcatggccgaaagtgcaacgcatggatgcgttctggtcgagaccaccggtggacgcgcccgccatgtcgttttccgacttgatggcggcgttgatcagcgtcacacgaccggcatcggatgcgccataacccaaaccgtacacatcatccagcgccaaggcggtggagcaggtcatggctgcggaggagctcagaccggatccgagcggcacgcaggaggagaatgccgcgtcgaagccctgcaccgcatcgaagccggcttcgcgcaatgcccaggcaacgcctaccgggtaggcggcccagccttccacaccaccggcctgcagaccatcgaggtcggcttcggtaacgtttccggaatcaacgtcggaaaccacgcgcaccttggtgtcttcacgcggcttgagcgcgatgaacgtgcggtgcggcagtgcgatcggcaggcacaggcccgcgttgtagtcggtgtgttcgccaatcaggttcacacggcccggtgcggcccatacgccagccggttcctcaccgtaggtggctcggaacaggtcggtcgcgttcttcacaccctcgtcatgcgagagcggctcaatgaattcaacagcagtcattggtgttttgtcctttgggttttattggctttcagccttcgatatcgattggtccgagctcgtggaagcgcttggcgatgagttccggcgtggtgtcggacacccatgcggccatgcctgattcggagccggccagatacttgattttgttggcggcgcggcggaacgagaagaactgcaggttgaggcggtagttttcgcggcgcttgtcgtggatcggggcctgatgccatgctgcgatgtacggcaggtccatgcccttgccgtcacccttgtcgaagaacgcgttgccgcgcttgagcagggtggagtacatgacggccagatcccaacgctcctgatcgttgagctcgtcgagggtgagcacgtcacgcaccggggccacatgcacctcgagcggccagcgtgccgcggccggcacataggcgacccaactgtggttgcgcatgacgatgcgctccccggcctcgatttcggagttcatgagatccttgagcaggttgccgccggtcttctcatggtaggcttcggtctgcttgagttcggcttccatcttcggtgcgatgaacggatagcagtagacctggccgtgagggtgcgccagggagacgccgatttcctgaccgtggttctcgaacgggaagatctgctcgatgccctccatcttggagatttcggcggtacggaacgcccatgcctccacgacggtgcgcaggcgggagaccggcaggtccgccggcaggccgttttcgtccgggtcgaagcagatcacttcgcagcggcctgcggcgagcttcttctcccacagcgggttgccgttgacgtattccacggcttcggaacggcccggcacgcgaaccatcgacgggaagcggttttcgaacacgaccacgttgtagtcggtatccggcacttcgccatcctggtacggatcgcccggcttgcgcgcggccagcggattgcctttggccgtcgcgcccggaccggcggtgatcggacggttcatacgtgcggtcgccatcggaatccaatcgccggtcagtgggtcgcgacgcatttcgggagccgcatacggcacttcctcgccagcggcgttgagctggttggagaaacggtacggaagttggcgcggatccttcagttcgcgagtcttgacgccggagacgtattccggatcgtcatcgagatagaagaagtcgcggccatcggcaagcgtggtcggcgtgatacggatatgctccttcgcatattctcccggagtgtagttgacgaaatcactcatgtgattattcaccttcctgaaccggctcggcctggcgtgccagaacgagctctttgaccaaatcccttgttttcgacaccgaatcggggtccaatccgtcatcggtgatgaccgtatccacctggtcaaaacgtgcgaacagcgacagtgacgtgcagctccacttggtgtggtcggtcaaaattatcgtgcgatcggcaatgtccatcatcgccatatcggttgcggcttccagcgagttcggcatgaggaaaccgcgcggaatggacacggaatgcgtgcccaggaatacggtgttgacgcgcagcgaggcgaccactttgtctgcgatcggcccgacgagcgagttggaacgggtggtcacgccgcccgtcacgatgacttccacgtctttcgattcgagcgcctgcaccagctccgccaccggaatggagttggtgaggatggtgatgccggacgattgctgcgattcgagcagatgctgcgcgaacacgtacgccgtggtgccgccgccgatggcgatcacgtcgccgggggccacgtatttgacggcttcctgtgcgatggcgtccttcagaccgatgtccatctgcgactttacggaaaacagcggttcgctcagcagcgtgctggtgctgacggcaccgccgtgcacgcgcttcagcagacccttgtccgccagatcggcgatgtcacggcggatggtcatcgcggagacgcccaattccttggacagtgcagtgatgcgcaccgcaccacgggtacgcagacggctcaaaatcaaatgctggcgttgcgacgaaatcatatgaacattatcgcacatgttcactcaaaaatacaactgagttgagcgtttcgcgcgtgtttcgtgcaaagccgcaccacaatcgactcaaattcagcctaaaacgaacaaaaacgaacgtcctatatgccgcaccgacacacatcggcttttgcccaaaatgccatgcgaaaccaatgaaaacgtgcgagaataaggaaccatgacatacgtttccgaaaacttttggcacgacgcagtgaacaaagccaccaccgaccttttcacgttcggctacaagcacatcatcaaaccgcatttcatcttcaaccagacgcccgacgtggcccacagccagatgatcgatttctgcaaggtcacccgcaatattccaccgctgatgtggctatgccgcgaaatgctcgactacaccgacccgatactggaaaccaacgtgatgggcgtcgatttcgccaatccgttcggcttgtccgccggcctcgacaaggattgcgagatgccggtgctgctcgacaacgtcggcttcggtttcgaaacggtcggctccaccacgtcgcgcccctgccccggcaacccgcgcccatggttccaccgcctgcctgaatacgattcgatgatggtgcacgtgggccttgccaacgagggttccgcggtggtgattccgcgcgccgagaacgcatggacgaaggcgaagagcatgcaggtgtcggtttcgatcgcccgcacgaacgacagcaagaccggcgatctggacgaaggcatcgaggattactgcatttcgatgcgccgcgcggccggacgcaccgccatggtcgaagtgaacatctcctgcccgaacaccatggccggcgaaccgttcaaccaaagcccggaagcgctcgacaagctgttcaccgaactggacaaaatcgaccgtccgcagccgacgctcgtcaaaatgccgctcaataagacgtggccggaattcaaggatctgctggacgtgctcgccgagcacaacgtgcagggactgtcgatcgccaatctgcagaaggaccgcaccggcatgtccattccgcgcgattgggagggcggactgtccggctcgccgtgctacgcgaccagcaacgaacgcatcaagcaggtctaccgcgagtatggggaccggttcgcaatcgccggcatcggtggcgtcttcaccccgcagcaggcgtatgagaagattcgttgcggctcgtcgctggtgatgttcatcagcgcgcttatgtaccgtggtccgcagcagatcaccgtgttgaagcgtggactggccgaactgctcaggcgcgacgggttcgaacatgtcagcgaggcggtcggcatcgacgcgtgaaaactttttaattgcgatttaagttgcgatttaaaaagcggtttttaggcactataaaggcgattaataatcgcagataaatagataaatacagaggcgcgtctccgtgggagggcgggcgtcctgttcacgacacactcaaggccgttcggccaagcttacggtcgtgaacaggacgcccgccctcccactcgtttttttgttatgttgcgttgggttgtggctacttttcgcaataaaaaagaggaagaagggaggggaagggtcagcggaaggcgccgcggaggtatggcggctggtagggggcttcctcgaccggcacgtccagtttgtgggcggcacggagcggccaatacgggtcgcgcagtgcagcgcggccgatttccacggcgtcggcggcgcccgacttcagaatcttcttcgcctgcttcggcttggtgatgagcccgactgcggtggtgggaatgcccgcgcgactgcgcacctgttcggcgaacggcacttggtagtcgggcttcaccggaatggtcacgtcgggaatcaatccgcctgtggacacgtcaatcaggtccacgccgtgggccttcagaatcttagccagttcgacggtctggtcaaggtcccaaccgcctgcggcccagtcggtggcggaaacgcgcaccagcaccggcatggtatcgggcacgacggaacgaatagcatccacgacttcgaccagcatgcggacgcgattgtcgaacgatccgccgtactcgtcgtcacgctcgttgatgagcgggtcgaggaactgcgacagcaggtagccgtgcgcggcatggacttccaccgcgtcgaagccgatgttcatggcacgccaggcggcgtcgcggaactggtccacgatggtgtggatctcatcgacgctcagcgcgcgcggacgagccagggaaccgtatgcgttggcgcttgggcaaaccgtccgccatccgccttgctcttccggcacgctctgtccatcgaaaccgatcgcgtggcagccggtggaacccttgcgtccggcgtggttgagctgcaccgccatcgtggcacccgctgccttcgcgtcggccacgatccaacgccatgcgtccatctgtccgtcatcccacaatcccagatcgcacggcgaaatgcggccttccggcgcgacggcggtcgcttccatgatgatcatgccgaagccgcccatcgcacgcgaaacgtaatgctggtagtggaacggcgtcggcttgccgtcctgcgccaatgcggaatacgtgtccattggcggcagccagatgcggttgcgcacggtgacgccacgcaacgtcatcggatcgaacggtttgaccgtcttgttctgcttgccgttcttcttgtcttcgctcattgtcatctctcttatgaatcgttggtatcgcctgaatcgtcgatatccgcaccgcgttcccacgcgacgggcatggtaccgattgcattgtaagcagaacgcccgccggttggggcgggcgtttatggactgttcactttgccatgcgatttacgctccggtgacgtgggcagtcagtgcggtcagtcaatgcgggcagtcggcatgaatagccgacaatcgcaactattgatgctgctggtcactttgctgctcagcaggctgttgctgcgattgctgctgctggccttggttggtctgctgctggctttgctgctgactgttctgctggcgctggtattggtactggttgtatgttctggtggcgcccttcgaaaccgtgtacttgtcggcaccctttccgtaatcgttgtcgatcggcgcgttgatggcggcaagatacgtgttcatgaactgcttccacgccggcgttgcgatgtacatgccgtaccaggacgggcggtacacgccgttgatggtcttgttgtcgaaggtgttgttgatcgggtcctgcgcgtcggcgaccgcgacgaacgccgcgacctggttcggcacgaagcctgcggtggccatcaccgtgttctcgttggtgccggtcttggcgaaggtcttgcgattgttgtcaagctgcgtggtcgacgcttcgccgccaggctgcacgataccttggttcagcgcgtaagacacggtctgcgcgatgtccgggtcgatggcctgatggcagttcgcggacggcactttcaccttgctgccgctgcggtcggtcaccttggtgatggcgatcggagtgcattccacgccgttggcgcccatggtggcgtacacgttggccatggtcaacggcgacgcctgcaccgtaccgatggtcattggcggctggaacgagttagcggagtagatgtcggacgcgttggagatggcgttgtggtagcccatctccttggccgcgtcggcgatcgcgcacaggccgatgttcgacgccatcgaggcctgcgtggtgttgtgcgacttgatcagaccctgcagcgggctttccggagaggtggtgccgccgccggaattctgcaccctccacgggccgacgaaaccgtagccgttgcagttgaacttcgacgtgtcgtagacggtggatgtgacgagcgactcgttgatggagtggcctttctgcatccacgccaccatgttgatgggcttccaggtggagccgacgttgaagcccataccgccgccgtcctcctgatcgaccatgtagttcatggaggtcttggtctcatccgttcgggcgtcatccgtggcatcgtaggttcggttgataccgaacgacaggatttcaccggtgcccggcttcacggccgctatcatcacttcgaatccggacgggtctgtggccggcacggtgctgttcgccgcctgcatggccgcgttgttggcgttgcggtcgagcgtggtgacgatcttcagaccgccttccttcagcagcttctcgcgagcctcgtcgtccttgccgaacgccttgttcttcaggatctggttgaccacgtacgagcagaagaagccggtgttttcaatggccgactggcatccggagctcacgtcctgcaggttcagcgtgtccttcaacggcgtgttgatggcgtctttgaattccttttcggaggtgatgtagccctggtcgtgcatcagctgcagcacgatgttgcgctggtgttcggcttccttctggttggcttccacggaaggatcgaagttctgcggattcttggtgattgccgcgatggtcgccgcctgggtgacgttcagttccgaagcggagacgttgaagtagcgtttggcggccatttccacgccgcacaggttgttgcggccgaactgcgcgatgttgaggtagccctgcagaatctcggctttggagtatttcttttcgatctgcaccgagatcagcatctcgcgcagcttgcgtgccacggtgtcttccgtcgcatggtattcggcgatcggatcgtcgtcttcacgggcttgggtggacagcacgttcttgacgtactgctgcgtcagcgtggaaccgccctgctggtcgccgcctctgacataggtttggaagaacgctcggaacacgccctgcacgtccacgccggtatgttcgaagaagcgcttgtcttcacgggccacgacggcctgctgcatggctttggagattttcttcagcggcacgacctcgcggttctgcgtatagaattccgcgaaagcggtcttgccgtcgttgaaatacatcgtcgagcgttgcggaagcgaggtcacatcgaaatcgatgccttcgaccgcaagggacggaatgacggctttggccgcgttattggcggcgaacacagcgggcataaagaaaatactcgtcacaacgccgccgcccacgcataacgtgatgtatgcgattaccaatgcgagcacacgttgaacggtaagggtcttcttcttgggcatgacgcccattctaaagtggcgggtctactaaacacatgcccgccaacgcatgtgccggaagccgtcacgggtttctcacaaaacagacaatttcttaggaaaagttggaaatcagccgaaaaccagccgaatgtcatcgtcttgatcggcgaatcagcatgcccggctggtagatgatgatggaccggccttccctggcgatccatccgcggttagcgaaatccatcaacgccttgttcaccgtttcgcgtgaggatccgacgagctgcgccatctcctcctgtgtcagatcgtgcggcaccttcaggccggcttcgaccggttcgccgaatcgtgatgccagattgagcagtgttttggcgagtcgtccgggaacgtccatgaacaccagatcgcagatgcgttcgttgttgctgcgcatgcggtgcgccaatacctgcagcatgtccacggccacgcgcggatgttcgtcgagccagtcgaacagcgcgtcatgttccagccagaccacacgcgtgccgttggtcatcgccaccgccgaagcggtacgcggtccgccatgcggatcgaacaccggaatctcacccaacacttcgccgtacgcgtggatgctcagcagctgcacacgcttgtcggaggattgtctggtcagtttgacgcggccttcctccagcagatacatgcgatggtcggtgtctccctcgcggaagatgaaatcgcccttgtcgtattcggcatgcagcagatacggcagcagttcccgggcttcttcggacgaaacctgcttgaacagcgcggtgtgcagcaacgtctcacgctcatcgtcgaaaccaccaaaaccattgattccgttggttccattcggggtgaccatcgacgtgcctccgttccgccgtgcttctgcgttttccgttgtcgacatccatgccaacgctcgttaagtcgggcaccatcgaccattcgggctacattgtaactcgaacggcggcgtcgaccagtcgcgctactacctcgtctcggcccatgccggtttgagagcgcatgggatcgacatgttttgccgctgatttcaccgctttgtcggacattttctctcgtgagatgttcaacacgcgggtcatcttttccgcgtcgatgtcgtaggcgagcgtgacgtggtgcagaatcgcgccgggtccgccgtgggtgggcgcgaaccggcgttgcgcggcgccgccgagtttgccatattgtgtggcgatgtcgttgagtccggcgaatcgtacgttgaggccgagggcgcgtaacgcttcgacgagccagtagtcgcagagttcgtaggattcctcgacgctcatgccgtgggcgaagtcgagtggcgcgtacagcgagtaggtgatggtgttgcctggttcgatgaacatcgctcccccgccggtgcagcggcggactatgtggaatccttcgtcttgcgcggtgtgcacgttgacttcgtcttcgagcgactggaatctgccgatgaccacggccggctcggcccattcccagaaacgcagggtgggttcgcgggttccggcagccacttcgcgtgcccattcgacgtcgaggtccatttgttcctgcggtttgcgggggtcgtcgtgcacgatgttcggtttgagtgcgtgccagcgtcgcgcgtattccgcccaattgccggtttcggcgatttcgccggttccaacggttccagcgttttcgtcgctttccgcggttccagtgttttcaatgttttttgcgatttccgcggtttctgcggtttccattgggctggtatgccgccgaatgcgcaggtcgtcgcgtggttccactttcgtaacatcattaccgccgataccggcaatgcgatcggcgccatcgatgccgtcaatcgcacgttgaaaggcgatggcgatgccacgcgcgcccatgccgacgatgcgcacgtccggatggtgcagcatcgtccgttcgacggcggcggtcacgtcacgttcggaaaccatcgaaccgctgaggcaacgggccgcgcactgttccagcgcacattccatggaatgcaagagattccgcgttccggcatcgtccccgtcgaggaagaaatcgccgtcgatatggcattcgataacagtcgatgatgcagccggcccagcgtatggaaccgttttcacggcattcgtatgagccgaatcaatatagtccgaatcggcataatccgaatcggcgtaatccgaatcggcatgagaaagccggacagtcactccaacgagtttgccgcccggctgtttgtaaagtcctcgagtcatcaatcctgcagttcgacgccttgagcgtcacggtgccattgcgagccgtagtgggagcacagaatcaggatgccttccaccagtccccagatgcctgcgacggctgggccgatgatgagaatccagccgatgacggtcagcagcagctgtgccacggccttgccggtgttgcccaagtagaagttgtgcacgccgaagcagcccaggaagatgccaagcagaccggcggccagtttcgacttctgggcgtatccggccggtgcgacgggctggccgtatgccggctgctgcgcgtaggcgggctgggtgtaggcggattggttgtaagacggggccgcgtagccctgctgtccgtagttcgcttgattgtaatccggctgggcgtaagcgttgttggggtcatacgccggggctgccggctgaccgtacgacggctgcgcagattgggcgggctgggacggctggccatactgaccgtactggttgtacgatgcggcgttcggatcatacgccggagcagcgggcgtggccggctgagcgggctgggtatagacgggagccgtaccgtacgccggggccggagtcgccggctgaccgtatgacggctgagcggactgggccgactgtgcggtctggccatactggctgtatgcggaagcgttcggatcgtacgccggaacggcgggctcggccggctgagcgggctgagtgtatgcggcggagttctgatcgtatgcgggggtttccggctgcgactccggatggttcatctgcgcatcgttctgttgtggaatgtacggttggttgtagtcggcctgggctgcgttatccgacgttggattgttgacttgaccggcaccattgaaatcggcgttgttatcactcatgcctcaacaatatcccaaggtttgcccgtcatcgggcgtttaccactggcacgaaccccgaaaaacccctgaaaaatcccctgattatgcgaagacgcccaccgttccaaggaaaaccttgtttcggcgggcgtctcaccaaatggaacatccaaatggaatgtcagcgaatgccaatcacatgcgtgccaggatgtcgcgtcccacctcgtcggtggtgcgcgtggtggagccaagctcctcgatgtcagcctcaacggcggtatggatcttcttggcagcgtcgtcgaaaccgagatgctcgagcagcatggcggcggacaggatggctgcggtcgggttggccttgttctggccggcgatgtccggagcggaaccgtggatcggctcgaacatggacggatactcgttggacgcgttgatgcagcccgaagcggagtagccgacgccaccgaccacggcaccggcctcgtcggtgatgatgtcgccgaagaggttgtcggtcaggatcacgtcgaagcgggacgggttggacaccaggaagatggtggtcgcgtcgatgtgcaggtagtcgtgggagacctccgggtattcctcggccaccttgttgacgatgcgctgccacatgtcgccggcgttgaccagcacgttcttcttgtgcacgagggtcacgtgcttcctgcgcttcatggccagttggaaggcgtaacgcaccacgcgctccacgccgtaggcggtgttgatggagacttcggtggccacctcgttcggggtgccacgacggaccgcgccgccggcaccgcagtacaggccttcggtaccttcacgcacgaccacgaagtcgatgtcacccgggttggcgagcggcgacgtgacacccttgtacagcttggacggacgcaggttcacgtactggtccaggtcgaagcggagcttgagcagcaggccgcgttccagaatgcccgccttgatgcgcggatcgccgacggcgcccagcagaatcgcatcggtcttcttgatacggtcctcttcctcctcggggaggatcgcgccgtcacgcagataacgctcggcaccgagatcgaaatgctcgtactcgaattcggcgacgccttcggccgccttctccagagccttctgagcccacggagtcacttccttgccaatgccatcgcccggaatgacggcgatggtgtacttctttgcagaatcactcatagctcgcgactctagtcagtgattcatcaggcggaccaaacccgctcagcaaatggacacccgtcccatgccccacgtacggcgggcggatatccgtttgtttcgataggcacaaagaacgcaatgggcgcaatgcccaacaaagcgatggacagacatgaatgtgcacatatatggacgtacgcaccgcccacatacgcacgttggcgccgtggacagatggtccgcgacgccaacgtgtatgtggcgaatcggctgattcagttaacccaaggagtggattcctcggtgattgacccgaaatcggtgttcgggaacttgcctggctgacggaccaccgcttcgaacatggccagtccgttgagtccggtttcggtattggaatacgcgccgatctgcgattgggttgtggagtcggaagtggaggtcggcggcttgaccactgtgcccatcttcgcccacaacgcatataccgtgccatcgcggtcgatcggcatcagcgacttgccgttctcgtcgaacgagaggacgctcttggcgagcgcgtcgttgcggacggtgctccagccttggaattcgtagccgtcgagcaccggcacgttcgtctggtccacggttggggagatcagcgggtcgccgtcgtagaccttctggtccgcgtacagtttcgtgacttcctttccttccggagcgacaccgccgttgaggtcgaacttgatggtccactggtgtgaggtgcgtgtccattcggcgtacagcgtcacgtcgccgtaacccggatatgagaacgtcttgtctccgccgttgttgccaccggtcttgtcggagttgatggtgcctttgaccgtcacatacgcggtgacgttcgatcccgcgtcctcgccgcgggtgtacgcggccaccatgcgattgccgttgatcacataatggccgaccacatcgcccgatccgttgatgatgtcgtactgttgcccggattggaaggtcagattctcgggcagatcgtagacgaaggtgtcgcccgatttgacagtgacgctgttcggcacgttccaatgcagttgcatgtcgatctcatcgccgtagtcgacggtggtgccggagatgaacggcttttcctggccgccggacacgatggtcagcttggaggagtccttgtccacccagccgagctcgccgatgttgtattccacggcctgcgcatgaacgggcccaatcaatacgcatgccagcatggtcgccaatgtcaccagcatggcggcaaacgttttcacacagcgctttgacgccaactccttgtgcctatgcataatccctcgcttcacgattaagcacaacctaaggtggcggcatccactaccttgccccagctgcagccactgtcatgcaagcacggtgtcacgacgtcaacattgacgtatgaaacagtgtctttccttataaaagttaaaaagcgcggcataaaacgtttgacgttagagtgcccccccaaaaaaagggattcgcgaaacgccgaagggtgtttgcaatgtttcatgaaaattttctgaaacaaaaacccattgccgcaaacgattgcaacaatgggttttcgtcagtcatgattcttctacccccggaaaatcccccggagtaccctcggggccactcagccgccgatgcccatcatcgacagacaccaagcgttctcataggagacttcctcccattgcttgtaccgcccggacgtacccccatggccggcttccacctcgattttcgccacggcgtccacaccggcatgctgcagccgggccagccatttcatcggctccacatacagcacgcgggtgtcgttcatggatgtggtaatgaaaattttcggaaaaacggcagttctttcgtcattttcactatctggcgcattctcgtatggcgtgtacgacttcatatacgcgtacacatccgcgtcgtgcagcggatcgccccactcgtcccattcggtgacggtcaacggcagcgacgggtcgagaatcgaggtcagcgcgtccacgaacggcacgtccgcctccacgcccgcatagcattccggagccatgttggcgaccgcccccatcaataggccgcccgccgagccgccgttcgccaccgtacgcagcggcgaggccagtccggcacgttgcagcgcgcgcgtggcgtcgatgaaatcctcaaacgaatgcttcttgttgagcaggtgcccctgctcgtaccaggcgcgtcccatttcgccgccgccgcggatgtgcggcacggcgtacagcacgccgcggtcgagcatgctgatgcgtgacaccgcgaatcccggatcggaactgatctcgtacgcgccgtagccggtgatgaacatggcggaatcgcaggtcggcacgtcacgtcgccataccagcgagacggggatgcgttcgccgtcgcgcgcggtgacccacacccggcgttccatgtagtcgcgcggatcgaaaccacccagcacggtggcgcgcttgagcagacggtcctcgccggtgtccggatcgtagtcatgcagctcgccggggcgcgtgtagctggcgaacgagtagcgcatgcgcggcgcgtcatacgaggggttgccaccaacgccgatcgaatacaggcggcgcgtctcccccggcatgcggtcggcggtggcgccgtccgacgacgtcatcgcccgacgcgagacgccatgcacggccgatcccttgccttgcgcggcggcggccgcgtccagtttgccccagatctcggcgcgttcctcgttgatctcgtccacggattcgtcgacgtcccaatcgtcctccagcgcgtgcggcaccagttcggtgaaccgccatggccggccggccaggaaatcctcggcggcggcccgtttcgtcatcaccgcgatatgcggcaggctttccgcgcggtactgcagtgcgacgaaatgccgatggatcgagataccctcgatgcccaaaccatgcgcgccctgcagaatggcgggattgcagggattcgaatacggggtgccgatcggcatggaggaagcgccaggctccacgtcgtcgccgtgctcgcagccgtaaggcgatccgaccgccacgcgcacgccttcgcccagccggtatggcggctcgtgtgtccgcatgtcgatcacatcgatctcgaaattcggattcaacgcgttgtggtacaccacggcgagcggaatatcctcgccatgctcccccgcgacttcgaagcaggcgaagctcacgtcgtattccacgtcggtttcgcgcggaatgaacgcctggaaggtgccctctggggtgtccaccggcagcatcagcacctcggtggtggttttcgatccggtgccaatcacgatgttccgttcgtcgaaggacagcccgatacccacccagaagcgttcatccgcctcgcggtacacctccacgtcatccgcgacgggggtgccgacgtggtggcgcatcaccgcgtacggacgccatgcgtcgtcgagcagcacgtagaacacccattgcgcgtccggcgtgaagcaggcgccgccgatgccctcgaaccgctcctccaactcgtcgccggtctcaagatcgcggatgcggaaatcgtagcgttcgtcgccgctcgtgtcggtgccgtacagcatccagcggccgtccttggagatgtccatgccgccgatgcggaagaaatcgtggccttgcgcctcggcgttggtgtcgaacaccacctgttcgccgtcgagcggcacgccggcctctaccgtcggcggatcccaatcgtccgcgccgcgaatcggcacacggcactgcacggcatactgttcgccctgcttggtgcgggtgaagtaccagtagccgtccatgcgcgtcggcacggacatgtcggtttcctgcacatgcgacttgaattcgtcgaacaacgttttgcgcaacgatgcgagcggtgccatgcgctgttcgcagtagcggttctccgccgccacatagtcgcgcacatcctgcgattccttgtcgcgcagccattcgtagttatcgatgaacgtatcgccgtggaaggtgcgctcctttggcacccgcttcgcttccggcaccgccagtccattctggtgttcgtcgtgcgcgttcgtcgcttccttcacgttcatggtgttttccataccccgaaattcactcatgcacgcgattatactgacgacccacacaaacttgtgtcggccgtcagtcgccgttttgcgcggcgcgcaggtacggcagcatggttttcatgatgttcgatccggtcgttcccgtgaataccggcacgtcggtgaccggcatcggctgcgtggccacgcgcccggcgacggaaccgaaattgccggtcacttcgcgcggggacagctgccggatgccgatcgccagcacacgccccgggtagcggcgtgcgattgtggcgtatgtggtcggatccttctgcccgtcgtcgccgatcagaatgaacttcatatcgggaaaatcggccatgagctgttcggcgtattcaagcttgtgctgcacgcccgacggaatgaaggttttcggcctcgggtcaaggtcgcgcagcagcagcggaccttccggaaaaccgtggttcgtaatgaaatggcggatcgagctttccacattccatggcgaagtggacaggtagaagaacggcgcgtccgggaacatgtccgcgatgcggttgaacagcaggttcatgctggccaccggcacttttttgcgcggattaagcagcagcagattgtaggcggccttcatcagacgcggcgcctgcgtgaccatgatggtgtcgtccacgtcggagatcacgcccactttggtgccgctgggaatggtgaaaagattggcgttgaccggcttgcggctacgcactttgtacgagacgttgtggatgcccggttcgagtgaatgctcggcgacgaggtcgaggtagccggcatcgtcggatgccgcgaattcgctggaaatatcaggattgctgtcgatcgcgtcgtatacttccgacgcacccacctgcactgtttcgatgggcacgtcatcgatggcgatccgcactttggtatgtggggacggcaccatcagcatgccacggatgccgcgaatcaggcggccggcctgccgtttgaacgggccgtatacggtacggcagatcagtcgggagtagtgttcggtgccgtagccgacgtagggttcgacacgtggataccagtcgagtgaccgtaccaatgcggtcgagaatttcagccagacactgaatgctttggtgatcgtgcggcggaacagcctggtcagcggcggtttgacttcaaggcgctcatgtctggaggccgcgtcgaaggtggtgaccaccttgcgtgccggaatcggcacggtgggcatgtcatcgcaagaatcgtccatccgctcccccatacgctgctgttcgcgctgctgttcgtgctgcggcgggaactgcggcaacggctgaatttcactcatatgcccactataggggtcgcgttcgaacaaacagtaacgccaccgagaaaatcagggaactttcagggccccgcaaggcacttcccataaaaaggctgcggccggcgggtgcgatgcgcgaccgtaagcccggccgaacggccttgagtgtgtcgcgcatcgcacccgccggccgcagccgtaattaaaactagacgtccgtgctattcagtcagccacaatcttggcatactcgtcagcgctaagcaggtcaggctcgtcatcctcaagctcgatcttgaaaatccagccctcgccgtacggatcgtccgtcacaatgctcggatcgtccgcagcctcgttgttgacgtagcggatggtgccagccaccggcgagaccagcgcggtgaccgccttggaggattcgaattccgccacttcgtcgccagcttcgacctgcgtaccgacttcaggcaaatcgatgtacacgagttcgccgaactgttcggtggcgtattcggtaacgcccaccatggcgggttcaacggaggaatccacccacacgtgctcgtcggagtattcgaggtgctcgggcacgtcgaggttcactttgctatcgtttgcttcgctcatgccgcccattgtacggcgtatgcgaacgccgcgcacccgcgccacgcgtaacgggtcagcgtaccggtccggatggcatggcgccgactacctgcacgatggtgccttccggacagttgtcgtagatccacttggaatcggcttcgtacatgttcacgcagccgtgggagccgtagtgcgccgggtcgccgtgggcgatgccgtaattgttccagcttgccgtgtggaagccttcgccgccgtagaagtagcttacccacttcacacccttggacaggtagcgcgagccgtcgtcgttcaggccggtcatgtcctggatctgatacttgaggtagatgtagaaggtgcccaggtcggtttcgtgcttgccggtggtgcccgtgcacaccgggaaggtcttgacggcctcgtcgttgtgatacacggtggcggtttgcgcggtgcggtccaccacgatgcggtattcgctcttcttctgcacggttttgaagttctgcacatcaccgtccaccggaatggtggcgccttggccgtttttgagcgcttcgccgatcttcggtgcgagcgcctccatgttcttgaccttcacgccgttcacgcctttgacgatggtggccagcactttgccgctgttgtcgacggcgtcttcctggtcgaccgcgtcctggttgagctgggctgggacctgctgctgcacgtagttggtgatggcgttgtcatcgtaggacagcgaaagcgtgccgtgttcgagatcggcgtcggttttcagccatgaggccacgacttcggctggaatctggaaggtcttgccttgtccgttgtccagcacaattggcgcattcagtcgcgcgtttgcctggtcggccacgttttgggcttcaggcagtgcgaccggcacgtcgatggtttcgtacgtgatcgtcacgctgccgctgtgccccgggttcgcgatggctttggcgaccgtgtcgatcacgttgtccaccttcggggacctgccgccgcggccttccactgcgacgaaggcgcgcgcgttggcatcgtacgatgcggtggacggtaccgcgcggtcggtgtcctgcacgaatttgtcggtgacgaacgtcctgagggccagcttgttggacttggcgttcagcggcacgttcttcttgacgaacgggttgacttcgttgatgtattcgagtgcgccgttggtctggtgcttggcggcgagcagttccgtgaccgtcttgtcgacgttgtagctcacgccgaggtcgctcaggctgccggaagcgttgttgccgttgccgtccttgatgttcacggtggtgttcttcacggcggccgtcaccgtgtttttcagctggtcggcggtctgtccggccacactggttccgccgaaggtcacgcccggcgcggccttgtcttggaagtaccagtgtgcggtgaagaagccggcgatcgcggcgaccaccagcacggcgagcacgattccggtgatgatcagcggcagtttgcgtttcttggccacgacggcttctccttcgaccggcatggtgagcacgggaatggcgggagcgggcgtggatgagggcatgtcaccggtaggaatggcaccagtgggaacagctccgttggggacagttccggcaggcgtggtttcggcggcaccggccgtcgggaatgactggaacggctgggtctggtccgatgcgaaattcaacggcggcatggtctcggtggcggcgttggacacgtcgtcctgttcggacacatcggccacgtcggcgagattgatcgtatcgccgttctcaccagactgcggcggcacggcattcaccccttcaaacgagatgccggcgaaactgttgtccgtatcgttctgcccacttctatcagacatgtatgtggtttcctcattcactctcttcacggtacataccatgcagcatgatacgcagacgagtgcccaaacgaatacctaaacaagctcccccggcaaccgccccgaagacaggctcagccgataccaccttttaatggcaggtcttgtcacggcaggtcgtggccgagccattcctcaatcatgtagcgtgcgatcgtggctttgcccggagcctccatacgtcccgaaaccagttcgctcatgtattcgtcgcgtgtgacccaacgcgcctgcaacgtttcctcgccgtccacgtgcacgtcggtggtgaccgccacgcctttgaacgccatcatgagagacgaggggaacggccacggctgggagccgaggtatttgagttcgcctatttcgatgccgacttcctctttggcttcgcgccggcatgcgtgctccaggttttcgccagcctccacgaatccggccgaaaccgagtacaggccgttgttgcgccacgcgctgttgtgctgcagcagcagacggtcatcatggtcgacgatcgcggtgatcaccgctggctcgattcgggggaacagcaaacgattgccatcctcgtcgttcgtgcagtgctgagcccagccgccgagcgccggttcgacgggcgcgccgcacgtcgggcagtgacgctgccgggcgtgccacatgctgagcgagatggcggaggttgcctgtccggcttcgcgtgcgctggcgtggggcgcgaatccgcgcaggtccacccagtcgaatcgggttgccgcgctttccagcagcgatttcgcgttttcctgcgattcatgcgccggcacttcggcgaacgcgtcgtccgctcccccgctgcgagccgtcgcagccgtaatcgtcgtatcgttcggctggacgtgcgtcacgtccacggcgacgacgtgctcgcccaatcgtccgccgtacgagccgaggaatatggcgagcgccgatgggtgcgattcgagttccgcggcaacgtacgcgcccggcagttgggcgaggcgcattttcacgttggcgtagtcggcgatggcgccttggccgtgcggcacggccactttgccgtctttgacgaggatgactttcgttgccggttccgccaggactttggcgaacaggtcgggttcgccgcgtcgtgccacttcgtagtcgatgtctccttgggcgagtggcaggaacggcagggtctgcgtcaatgccagtggtgagaacacgctcatggttgtgttgcctctttcatgcgtgttatatacggaatatattcgttatacatacgtagtacatatttcgtatatatgttttatatattttctctatatcttgtcgatacgccggatggtctgccacagataatcgtcgcagccggctcagccgactcgcttcaccagttccagcaacgcggcggccacctggtcggggtgttcgtacgcgctgaagtggccgcagtcgtcgatcaccgtcatcgtcacgtcggttttcgtcatcgcgtcggcgaccggcttcatcactgccggcgggctggacgggtccttgtcgccgcagattactgcgactggcacgttgatgttcggcagcacgtcgttcaggtcggaacggccagcggccatgcgttcgcgccaggcgatgccgtcggcgggctgttcgttgatccacgtttcgaactgcctgcagtaggcgtccgactgcttcacggtggaatcggcttccgacggcacggcgaatcccatgaccggctcgtgtgtgccggtcgtttcgcagtcggtggcgattgcgacgcgcttcaatcgcatgtcggcggagtcggcgtcggctttcgtgtcgcacagggcgagcgccgccaccgcttccggatgcaggcgttggatgtcgagaatcaagtaaccgcccatcgacaggcccacccagatggctttgccgtagccggcggcgtgcagcaggtccacgtacgcgtccgccatacggtccagtccgtacgggaacgcgccgtcggcgtccttgccgccgctgtcttcgtcggacggaatcggtccttcgccggcgccgggcatgtccggagcccagatcgcaaatggtttcacgccttgtttcacagcttggtcgcgtaaagccgccgcacactcgtcccacatgcggtggtccaccgggaagccgtgcacgagcaccaccggcgtggtttcggtatcgttgccgccgtccgtatatacgttgttgttcagttcaatcgtcatatttttctaatcctcccctatctgtctattcgcctagtttgcctagctcttgccccgcttgcgcggcttgtcctacttgccggtccatgcgagcgcctgccgcacgatggtgccgtagccgttggccatttgcccgacgaaggtgtcgagcatgtcgccggacgggtcgacccattccacgtcgagcgtctcgtcctgcggcttgcaatcgccggcgatcggcaccacgtagcacagcgcgatcgcatgttggcgtggatcgtaatagtcggataggccgggtgtcgggaagaattcggccacggtgaacggctgcaggctgattggcagctgcggcagggcgatatcgcccaaatcttttgcgacgttgcgcgccaccgcttcacgcaacgattcgtgatagagcacacgtccggcgatcaatgtgcgttcgataccgccgtcgtcagtgacgcgcagcagcgagccgatttgcgccaccctgccgagatcgtcggtgcgcaccggcacgaccacgacgtacggaatcggtatttcgtggcgcatgcggttgatttcgtccgatgggagccatcccggagggttgcccattccgcggatgaaatcctccggcgtaatgtcgtcgaattccccgcgatggcggttggcgtcgaaatcgccctcgtcgggcacttcatcattcatcactggcatggttccattatcacgcacggcatgtgaatgtcacgtgcttccgattcttcccatagcgcaatcgggtgcggcagtgtgtttgcgtggcgtgcggctatatacttttcgcaaacgggctttcgcaatattgcgcagcattgcacgatattgttttttgaaatcggcttatagcgtaagccgggaaatggggaacgcatatggcaacgcatgcagtcacttcgcaggatttcaaccaggtcgtcgaatccaatgatctggtgttcgtggatttctgggccacgtggtgcggtccgtgccgtgcattcggcccaacgttcgagaaggcaagcgaggcgaatccggacgtctatttcgcgaaggtggatatcgatcagaatcccgatctggccgccgcggccaaggttcaggcagtgccgacgctgatggtcgtcaagaagcagcagatcatcttccagcaggccggcgcgttgcgcgcttccgatttggatgatctgatcagccaggccaaggcgttggatatggatgcggccgcttccgatggggacaccgcttccagcggagacgccaaagtgaaaacgccaagtagtcagtcggaacgatgattcggcccgtcgcctgcgcgttgcatacgttatcttcaagttccttggggtgcggtagactatatgcagttgcgcgcattccggcggaaccctagcggttgtgcgccgtgccctaggcacggaatccgccgaggaattgtacccgatgtaggagcagaatggctagccataagaaacatgcccaaccaactacgtttgccttgccgggcaaatctcagatggtgaagattgtcgcaacggttgcggcagtggggctgttggccactggcggcatcgtgtcgcataatctgtacgccaccgcggagaagtctcctgccaagcaggtcaccgcgtattccgtcaccgacagcatcgaagcctcccgtggcaacgcccgtgaggcgctttccggagatacttcgtacgtcaccgtgaagatcaacggcaagacccgcgtggttcccggcatgcacttcaccgacgtgaagtccgtgcttgacgcgggcgacatcacccttgatacggaagacaccgtttccccgtctttggatacgaaggtgaacgagaacaccgtcatcaagatcgaacgtgccggcgcttccgttgaggtgtctgatacggatatcgcattcaacacggtcaagaaggagacctccagcctgccgaagggccaggagaaggtcgagaccgaaggcgcgaacggtgttatggagaccacgaacctcgtcaccaagtccggcggcaaggtcatgtcttccaatatgatcagctctttcgtgaagaaggctccgaccgacaaggtgatcctcgtcggcaccggctcctcgtccacgccgtccgcggccgcagcgtcgatcggcaccaccgtgccggctggcgaaatgcagcagtgggctcacgattatctgctgtccagcggctattccgaggccgatttcaccgccaccgtgtacatcatttctcatgagtccggttggaatgtcgcagccacgaacccaagctccggcgcgtacggcctgccgcaggcgctgcccggttcgaagatggtgagcgccggtgccgattgggccaccaactaccagacccagcttaagtggttctggggctactgcgcacagcgctacggctccatccagggcgcctacacctactggctcgccaaccactgctactgagtttttcagtacgagcgaattcctcaatatgaatgagcggtgcatcgcatatttgcgtgcaccgctcattcatattgcacgcagtaccccagctgtcgtcagaaatactgtgcctgtacgaatcggctcgtgaaagtttgtactgggccgcactttgcactaactggtgcaaacccagcacaggctaatgtagacaatctgcgaagccccacgggattttctttttgcagatttcccattctgctcgtctttccatccgtacctaatcgtactttctcaaacctatccatcctctaaatcaatacttcattcataccccgtttgaagtcacagaactctccaagctctcgtgcaaattattcaaggtgcataactccctggacgtccgtgcggaccagaagaacgttcgtgcggaccatccgaacgttcgtgcggaccatccgaacgttcgtgcggaccatccgaacgttcgtgcggattttcagcaacctttgcggatgaagttctcaaattttagcaaggtgccgattgaatcaaagtcaaaaagcccagaattccaacgtttcttgccattataatttcttcaggcttcttgttttaactattattaggcaattcttatccgcacacgtcccgaacaatccgcacacgcgacaccgcgatcatgttcacttagcagtgcacgattccttccaatctcacacccacacgcccgcgcaatccgcacacacttttgggatcacccggcctacttatacacatcttcaaaaccagaacatagttatcaaccgaccgtaatcgcagtgagagaatatccacttatccacagattttcgtaagcaggtggcgccgaccgcgcattttcgcttacgctgcccacatgtacgcacagacaccgcaagatatgacccgcgctctcttcgaagcgcaactcgtagaactacagcgcgcccgcgcaatccgcaagaaataccatactgatgtggtgctcggtctcacttccgctatcagagttttgctaatcgatatgccgtcgctctatgacaagatcaaactgctcgattatctgcatatcgtggtggaggaaccgagattccgctcgtcgcatgaaggtgtgaaatttcacgcttatacagcgacacttccacccgaccgaacacccgaccgaacactacagcgcgatcgcacttctaggcaaacggcagccactccagaaacgccacatacacaaacggcacgttcgcataaaaaagtaacccgcgataccaccccttttgccgcttacgaaaacagcaaatacgctccgattttcgttgagccgcatattttcacagtgcatccgttgctgctgtgggtacagatggccgcatatctcaggctcgaggaattggtggtgctgggcgatgcgatgatgcgtcgcagcttctatcgtgtgcacgtctccccggcagattttgcgacattattgaacgagttgccaaccacgttcccgcatcgcaagaaatgtgataaagcggtgaaattacttgccgaaaataccgattcctgtatggaaacacgattgcgattccgtatgttgcgcgccggctacggtccattcgtaatcaattatcggcttccgttaaatactgccgataaaaagcaggcttttctcgatattgcaattccgaatttgaaaattgcgattgaatattccggtaaatttcacgcacaaaattgggaaagcgacgaagctcgccgcacagcgctgtcttcagccggctggcaaatactttccgtcaacgccgagaccttaagcaattcaggtaagttcaaggattttcttatacaactttcaatgacgattgcaagacaacagactatattgcaacgtaatcagcaaatgtaagatactgcaatctacgacttaatatgtatgcgtgcgcgcataaaacacatgacaactgcaatgcatccatacacgcgcacgatggaaaatgtcttgtggtcggcaacaaccgactacttggcttgcgaagtcttacggtgagaaccagccttcggaccacgcttgccgacagtgccattcttggcaccttccacgttgaacacgatcacctgctcgtcggaataatactcgccgtcaagtgcgtagaacgcaattttggtaggatcgtccagctcggggaagctgaagaacttttgcgtcgcaacaagcaaatcaacattgcgcaacgtcactgcagaagcctctcccggcttcttggtggcgaagcgaatcgcatattcatccttgtcattgcacttttgaatcgcaaatttcttctcgtcattgttcacaagaaccttgacgtatttagggaagcccagcacagcgctgacgttcttggaaaaacgaacggattcaagcatgaccgtcatggtcaatttaccgttattgctttcgccaacctctttaaaaccatccagaatagacatataaaagcctttcttaaatcaaaacaactaccggaaaaactttacatcattttacgattgaatacgaatcgtcatgaatattccacaaatagcgtataacgataacagaaaagaggggtaaataaaagggtgtaaatatcacaatctacaacttacgtaaattgcaatatttacacccttaaatagtacaaatatcagcttctgttatgcgatttagttggcaccggcgccactgccagaagatgcagcacccccattgccgttgactccgacaccggcgccattgtcttctttaccagcatcaccagcattagcagcattagcagcattatcatcgctgccaatattgtcgtcaccattatcaccattattccgcgatggattccaatactgttgcgcctgttgagcctgttgagcctgttgagcccgcgcccgttgcgcctgcgcctgagcctgagccgccgcagcctcctgagcagccctcatggaagcattcaccgcatctgacgcagcggaaatcgccttcgacgcctcctgcatagccttagtatcaacgctattgccgtcaatcagcttctgtgcggcatcgatcgcctgggaaagcgcgtcgcgtgtcgaattatccgcgacttgccaagcggagctgtcaagcaacgtacgcgcaccggaaacgctctgccccaaagcgtcgcgaatctgattggcttccagtgtcttcttgctgtcttccaccgatttcacgtccgcaatgatggtcgcggcttgttccttcatgtcattgctatgcttgttcatgctgcgggcacgcgattgcagcacggattgcgcaagcgacgtggaacattcactggccgcaccgaattgctcgccctgtttgacgctttgcctcaactttgtcagcgtgctcgcgtcggcgacttggctatccgtcagtttctgcgaagtttcagctttccttatcgccttgctcaagatttcgttcgcttcggaatatttgctgcgcgctttttcgcacattgcgattgcagcgctctcctgctgcgcttcttttttcgcacgcacaacgaatacaccgcccacaattatgacgattaccgccaccgcagcaaccgaacccactactattttcttgataggcgacggcttttccggcgatgctgggatggttttcagcggatcatgctccggatcgtcctctttttctgccttcttgcgaacgatatcagcaagggtcacacccctacagtcacccaaacaaccaataattactgcaatctcacgcatgcaaacgtttcagaaaacatgctcaatccacccgtcgaacccagataaagaggcacgatacaatagaccaagcgcgttaaaggagcttgaaaaatgaatttcaatcggtacatcgcattacgtgcgatcgtcgaattcgtgggtgctgtagcatgcgcaacgcaactgtttcagcaccgtacctggccaggcatcatcatgatgtcgtcaatcgccctgctctggattatcggcgaactgtggctcaccatggtgtacaaccgcgcgtatccgcgccgcgacgagctgtccgacgagcatcaggccaccgccatccgcttcaccttcttcatactggtggcggcactggtggtgctgggcttcatcggcatgatcgtctcgctgttcaagcatgtgccattcaacattcccgccatggcgctgccgaccctcggcatgctggcgctggccatcgccgacgcgcgatacctgtggctggaacgtgcgggcggggaaaacggagaagacgatgaagactagtctgaaattcaaacgtatggaacgcgggctcaaacagtccgacctcgccgacctcgtcaacgtgcgccgcgaaacaatcggacgactcgagcagggtcagtactgcccatcgctcaggcttgccatggatctggcaaaagcgctcgacaccaccgtcgaagacctgttcagtttcgacgacgaggaatagcttcggcgtgtcgttttccaattttcctcaagaatggcgagtttccaacgaaaattctatatttgacgattcgggggcatgtgcgaagctcgtcacacgatgagacatcgacgtcacatatgtgcgaatggcgtcacaccacgggaagggcgccattccaagcgaagcgtatagtcaaggcagtagcagggaaccgcaaggcgaactgctgaagacacttccacttattagagaggaattacgatcatgaagaagaagatcgttgcaatcctggctaccatcgccgccgtgttcggcttcggtttcgctgccaactccgcaatggctgtcgaccagtacggcgcaaccggcaccgtctccggcaatgttgcgacgttcacgttcaccggtctgaccccgggtcagtactacgtcgtgtcctacgacgacaccaccgttgagaacgtcaccctggctgccaccaagtattccaaggccgccaaggctcacgacgatggcaccctgactgccacctacaccttcaagaagggtttcgctggcaccatcagctcccagattttcgcttctgacgctgagggtcaccacaccggcgctgcccttgcctccgcgtccgtgactgtggccgccaccggtactggcgctgccgatgctgctgctaacggctccgctcagaccgcttccaccggtgctgccatcgccccgtacgctgtggccgtcgtgctgctcgccgctgccggcatctccctggttgccgtccgcaagagctccgctcgctgaactcggctcaaccggaaataattgaacacttacgttcatgaagggcttggggcattcccaggcccttttttacgcttatttcgcgcgcaccccacagggcatccacgcacgcagaaaggacaccaatgaaggttgtattcgtctgcaccggcaacgtctgccgttcccccatgggagagctgttgctccctcactatatgcccgatctcgaggccgacagcgccggcacgagaggactcgacgcgcatgaaatcgcgccaaacagcgcaaaactgctggccgcgcatggcatcgatgccaaacagttccgttccaagcgcatcaccccgcaactggcgaacagcagcggcctgattctgtgctttgagcacgaacagcgcaaggagatcgcggtgatcgctccaacggcggcgtgcaggactttcctcatcaacgacttcgccaacatgtgcgcgtattgcaaagaacaggggtatatggatggcgatacgcgcgaggaacgactcgaatccgttatcgataatgccagcatgatccgccctatgattcccgataccgccaatatcgaagatcctatgggtaaagattacgcggtctacgagcgttcatatcaggagatttgcaaggctttgcagaccattgctgataccaccactcgataaccccttactgtaagggagtcaagctgaaaccatggtcacgctcagcgccctcccccacaaggagctttcccccatctgggagggctccttgctattatgagtttgttttggattttgaaaatctctgagagggaaacatggccgcagcagaaagtacagcgtcacaaaacggtcaggtagtggttgagcctaccgaaacggaagacaacggcatcaccctgatggacctgttccgtattgtccgcaagcatattgtggtcggcatcatcacttttgtggtggtctttgccgccgtgtgcgcctacacgttcctggttccgccgaaatattcggccacttcccaggtgttcgccacgtacagcgattcctcggtgcaggataataacatttccaacatcaacagcgccagtacgtacatcactaaccagattcagtcgtacccgactctggtcaccactgaatccgtgctgaagccagtcatcgatgacttgggtctcgacactactgtggcgggtcttgctggtcagctgacggtcacgaacccgacgaacaccgccttcgtgaatatcaccgcgcagagcggcgatgcgaagcagtcgtccgacatcgccaatgcggtagccgaatcgttgagcaacgtagtggaaaagtcgctgtatgcgtctggcaaggaatcaccggtgaagctgtccatcgtgcagcgtgccagcgtgccgctctcccccagctcccccaaggtggcgctgtatctcgccgtcggactggtcggcggcctgatccttggcgtcttcgccacgctcattcgcgatcttatggccacccgcgtggaggaagccaacgatctgcaagacatcatcaacgcccctatcatgggccgtattccaacagacgacagtctgaagggcatcaagccgatcatcatctcctcccctgccggtcgtatttccgaggaattccgccgtatccgcaccaacctatcgttcacgtcgaaggttgaaggctccaacgcccgcatgattgtcatcacatccgtcggcccgtccgaaggcaaggccaccgtttccgtgaatgtggccgcagccttggccgagaacggtgccaaggtgctgctcatcgacgccgacctgcgtcacccgtccgtggccgaccgacttggtttggaaggcggcgctggcttggcgcacgtcctgtccggacaggccaccgtcaaggatgtggtgcagcgctattggaagccgaatctgcatatcatgcctgccggtccgaagccgccgaacgcttccatgctgctgaattcgaagaccatgaccgaaatgctggacatggccctgcagacctacgattacgtgattgtggatacctccccgatggtcgtggccaatgatgccgccgtattcggtgcgaagagcgatggcgtggtactggtttccggccgcgacgtcaccatgaagcgcgatctgaaggatattgccgttcagcttgagaacctcaacgttccggttgttggattcgtgttcaacttcgagaaggagcgcaagacctccaacaacgacaattactactattacgacgagggcggcaagacgagccacaaggctcctaagtcccgctccgaagccaagcgcaagaagtagctcggggttaaagtccgctgattcaagagaaggctggaaaccgctgtggtttccagcctttctttatgtcttcaaggctgacaggtgaggtggattcgatcttttcgtttcgagccggtttccgtctcgtcttatgcgcctttccttgtacgccctctctgcgcccacagctgatatggcacttgccggatgccgctatcatgtgggtatgagacttcttggcaatattctgtggctgattctgggtggactgttcctggccgccggctgggccgtcatcggactggtgctgtgcgtcaccatcgtcggcatcccgctgggcgtgcaggcgttcaagatggcggggctgacgttgactccgttcggcaagaccgtggtctatggaggcggcgtgggctcggtgctggtcaacattgtgtggttcgtgctggccggtgtgtggatggcgatcggctacgtgtgcgccggactgctgaactgcattaccatcatcggcattccgttcggtatccagtcgttcaaaatggccaaactggcgctgtggccgtttggttcgcagatttacagcctgtgattagcgcatccagcgcagtcggccatcggatgccgtccgacacgtgagtatcgaagagctgcgatccgattgcgccgtagctcctgcggaagagcagaacgcgccaccatgcgctctaccgagtgacgttgccgccggagcctgcgccggcgattgcgcagcttgggactgctgctgcgccacttgggccaactgttgttcttgagcctgcttcttggcttcctcacgttgcgcgatgttcttttcacgctcgtcgagctgtgtttgccgctggtcttgctcctgttgcttctggtcttgctcctgctgtttctgctcctgctcggattgttgctggtcaagctgcttctgttgcgaatcctgttcggctttctgctgctccaactgatccttgagatcctgaatatcgtccagtttccggttgagctcatcgacttgccgctgcagtttgttgttgtgctgtttctgcgaagtcaactgctgctccagttgcttatactggctgctttgcgtcggatcagcactcatgttgcctatggcgagcgctacgacggcaacgagaataatgacgatccaccgtttccaagagcctggctgcttggatttcttcgtatgctttccaccggttggagggtcggttggcccgttggagtttgaaagctcgttggttgagacagacggagtgttggtcaaagtcagcttgtccgcatcggaaggatatggcatgacggtggtttccactggcgaagtggtcagcggcagttgtgcagcatccgctttggatcgttttgtgttcttcttggctttcttcgccttggcgggcttctcatctgagatcttttggctgtagctgatgccggttcccggaacactggctccaacataggtgccgcgctttcccactgtgacgtgtggcgctccgcgtttgccgaatgtgacgctgctgatgccgtttttgccgagattgacgcgcatgcctttacccaagctgatgctttttcgaatcctgaatcccatgctctcccctttgatagcgtctctcttgctagtcattatatgacttttcggggttgggtccgttatttcaatgcgcctcagccagtttttcttctcttatataaaagcccgtcacattgttttcttttaggcgtctccaaaaaaaacatttacggagtgtagaacgtgccgaagcggcctgaagcatgcgtccatggcaagaaaaagcatccaagactccgcctttcatatattcgacgttccgaccctcccctatcaggaacaagaaccaagaatcccgaaaacgtcaccatcccgatcgaaacaattcccaacccaatataagaagggggacaccgcaaaagcctccacacacaaacagaaaacgtccaaggcaacgtcccagattgcacgatgttgtttcgtatgacaaaacatcaagacatccgttccttctcccgagaaggaatcagcagaaactcaagcacaatgaaaaggaggagccgacgcatcgactcctcccaggtttcgcccgaagacttccaccgcaattaaacgggaatgcactaatcttaataggcgaaagcagccagagcagggcacgaacgggggtacacgcctaacgtagcacgccggcgcactccaaagaatttcaaatggaggcaacctctagcatcgaaccgctccgcatggttcttcctcgacaaggaacagaccatcaaatccaacctcaagcgcgtgtagtagaccatagaacacaccccttttaagaaccttattcgtacaatgccctacctcgcgttcggctgtacaagacctgctttgaagcattggattagatacaccgcagaatgaacggccgcctgaacctttccctttagagaccactccagaatccggaccgccgtgacagtcgggctgactgttcattagaccactcataagtaattggatgacaccgccgagaacattgcccatacacccgaaaccgaatcattgggattgcgcaggcaacgcagcaatcgacaacggcactattgacatcgcaggtatatcatgcgactgcaattgttcaacgagcttttccctcatgtaaggccatgcaacggaaagagcctccggggtattttcatcatcaatgggcgaatcgaattgaatcgcatagcgcagatcggatacgaaaaaaggagacacattcttttcggaatcgccttttttgagagtgatctccgaatgcaacgttaattcgtacggccaaggcttgtcatcacttggattcaaaccaaaattaaaattgatgttgctttccgcgccttcctgcgagtcttgggcaaggtcgcgctcgcttgactggccgagcagcataattctgttgacgttcatccaaccagctcctttttcgattccacgtctttatttgcacgccaaggagcagccttgcccgaagcacccattacagtaaccttgcgtaaaccatcatgatttggtttttgccgggatactgttacctctacgttgatgccgcccatcgttatatcgccattggaccattcacttgttacctgcaattgtcgaacggccttccacgtatcgtatttccggcacccctccggttttagctccgcaggctcgacgctatatgtaatgcgcgccccgacttccaacgcatagtcggtaagcaatgtcacaagcttttttcttccgttctcaatctgagatatgtaagactgggacacacccatctcatcagccaattgctcctgagtcataccccgttgcacacgcatagagacaagaccctcaagaagctggtcctcagcgtgatacaaatcgtaggcaagttcccgataatcgtaaggaagctgaccatccatggttccctcctgtggtggatattacttatagtaatatccaccacaggctcgacattattaccgtcaaccctaattattatgaaatggtcaatttatgaaatcagcgacaattgttaaaagacatcatctgtatcagttaacatatatatagctgacagagagttacaagagtcaaaagagggaaaatgagcaatatcattgccttagtttgggattttgataagaccctcgtagatggatatatgcaagatcctatttttgaaaaatatgacgtagtctccaaagactactggagaatgattaacaatcttcctcaaaaatacaaggaagagcaagacgttgaagttaacaaagataccatttatctcaaccaattcattaaagatgcgcgccctgatggttgcttccctgggctgaataacgaacaactaaaagattttggcaaagaattaaaattctacaaaggtgtcccagatattttcgaggcagttaaacgagtagtcgatcaagacgcatatagagaacgcgacattcatgtggaaaactatgttgtcagcactggaatgtccaaagtaattcaaggttcaaaaattgaaccatatatgaaacatatatggggatgtgaattcattgaagatgaaaatgaaaatgggcaaaaagttattagtgaacttggttacactatcgataacacgtctaagaccagggctttatttgaaataaacaaaggtattccagaaactccaaacattgacgtaaacgcgaaagtccccgaagaactacgtcgagtccaattcaaaaatatgatctatattgcagatggccccagtgacatccccgcattttccgtcgtgaaacggtacggtggcgctacttttgcggtttatcccaagcacgacgaaaaagcctttgatcaagtcgaacaaatgcgaagagacgaacgcatcgacatgtatgcagaagccgattattccgaaggaacaacagcatatatgtggctaacacacaaagtgaaacttcttgctgaaggtatagtgcagagggaaaagaagcgactggaggaatccatttcaagtgcgccacatcatatttcataaacattagccactaccgccccttcttttacatcctttattatacgaaagtctaagagaaggaacatcagaatcaaacaatcaaaatttttaattatcagaaatcggcgttctatcttttcttcctgtctgacctatcagacaggaagaacgtgggtaacagcactataatttgtcgtgagcagattcaaatccaataggattacgagaagaagctttcctctgcaaatcgattagatggaaaacctcagattcatctagatcaagccatcgaccatcgaaaggcgactgataaaactcattcggaggcagcggaacaatcttactccccttttccgatgcatgagaacgcattgccgtctcctttctatgtggttcacgtcagtataacgcgtgaatctggacaacacactatgaccaagctcattttttcatcacaacgcttttcgtaactcactactccattcgtttaccataccttgcattttctttgcgagatttttattatcaacactgtttattttcttacctatcccgatagaaagaacagccattggcaggatactgaaccctttggattcctgcacctgaatagggaacgccattacctgtttccatattccattttcaaaactctgactactgctttgattagtcccaagaacacgtcctgcaatatatgggctatcaaacccgaccgcctcattccgcagctgttctttgtacagataaatacgatcatgagtagcatatcgcgtgagttgactgccatgcgcaatccagagagtcacattgattctgcaatgtccaatcaacgcctcacactgactagcttgctcatgaagcttctctgcgaacctctcttgataagaacgaaattccgttcccgttaacttcttccatagccgtttagttcttgttgctggagggcagtagctagaattccccatataaccaatctcgttaatcagcgttgccgcatcagtataatcattcacaaaaatcggatgaaatccaattgattcccattgagcagcaagcactttcttcattcccataaactgatttagcgtcacctcgggcatactttcacgcgcaatcaaaaccgtagcccgagaatcacctgagttctgtaaaacatcagacaaccagaatctcatatcaggatcgctaaaagacgttccggcaataagtaaatgatgcccctctgtcactgtctgctcaagataatgcttagcatggttcttaccatctctcatggctttgttgtagtcatcatgcgtaagaacaacatcttctacagttgccgaacttccatcacttgccgggaaaaccttaccgtgtaaatgctcaacaggaggaaaagtctgtttccctgaatcaaccgcaatgcgagcaatggcatattcaagaagtaaatcaaaatttagcgtcgccaaatgaacagattcctgatgctggaaagcgagtcttgctgtttgctgatggaaatatgacggaggatacgggttatatgaagcaccctccgggtatagtgcggcgaggatacatctcttccactcattctcattgccgcaatgttgttttacagcttcagctaaaaatagcaaatcaccagcatcacataataacgacgccatatttgcagacactgtcattccttgttgtcggagcatattgccaattaaatctttccatgaaggcaaccccgaaggaacggacgctccagcaccaagcaatatcgtcagttcttcgtttcggtctatgcgcggaagctgcttaatgattgaccactccaactgagatgcgaccataagaattaccaccccatctattccgtctccatcaacggcataagacatgtcaataattttttgatattatcacatcgatagcgcagataacgtccgatagtttgcgcagattcggctttggggcctgatggaaaaggacatggcccggtcttggtacgattttcagtcgccaaacatagaaaaccgcgattgaaaagcaggtcagcgccatgtccaaggaaatcatacagttcgacgacgccatgttcgagtccaagctcgaccggatggtgcgggagaaggtcgagcagaccatcaacctgatgctcaacgaggaggccgaccggatcccaacgccgccagatacgagagaagcggcgacaggaaggccttccgggccggccactacgaccgccacctgaccgccaaggccggcaaactgaaccttcgggtcccgaagctgaagggcgagacgttccgcagccaggtcatcgaacgctaccgccgtcgcgaggaaagtgtcaagggggcgctgatggggatgtacatggccggcgtgagcaccaggcgggtcgatgacatcagccaattgctgtggggagagcgcatgccctcgcagacgctctccgacaagctcaagagggtctacggggagatcgacaagtggcgcacgaggccgctggagggcgcgtggccgtacgtgttcgtggacggcgtgtgtcacaagcgttcctggggcgggcacgtggagaacgtaagcgtcctggtcgccatcggcgtcgacgcggacggccaccgggaggtcatcgcggtcgacgagggcatgagggaggacgcggccagctgggagcagttcttcaggggcatgatagaacgcggcctcaagggcgtccggctcgtggtcggagaccggtgcgccgggctcgtgtccaccgtcaactcgatgctgccgaaggcgaggtaccagcggtgcatggtgcacttcatgcgcaacgtgctctccaagacgccgcccagccacagggattgggcttccgcggccctgaaggccgtcttcgcgcaggaatcgcgcgaaacagccctggccaggccgagaccgtcgccgcggagatggaatccaggaaactcaggtcggcggccaactgcctgcgcgaggggatcggcgagacgacgacctatctgctgggcgagttccccgtgaaccacaggaccaagctgcgcacgaacaacatgatcgaacggctgaaccgtgagatccgccggcgcacgcgcgtcgtgggcggcttcccggacagcaacagcgcgctcatgctcgtgtgcgcccgcatcaggtacgtcaccgccaacagctggtccgaccggcgctacatggatatgtcccggctcgatgacagtctcgtggaagcgaactgatcatcgcgccatggacggccatgatccaaagtgcgcaacctttcgggcactaccgcgcaacgcggtctggattaatacaggcgagtacaacatgaggcaacgccacgggcaggccatgctcgacaactagtcccgaaggccggcggcttctaatcaatccgccaccggccttctcccaccataatgctggtccccaagcacaataaccagtggcctcaaaagctacaaatattcagcatgctgcggaaaaggtgccatatataagccacctagtaaaaaccaactcttcgaatctgccgcaaataagccggatagacatccttgcggagacttttctcccggtctacgacgctcccctattcaccaccgcgatttcaaaagctcgattcccgaggcacgccagaatggaatacgccagtacccggaacacacatggtatgcacctttttagcgtaaccgctgcacttttcttcgcgcccatgcacttttgctacgactcctgaatcctgttggttcgcctgcacttaggtctgttgttcagcctgcgcttggttctgctgagcttgtgcgcctgtgaaactctcctttgactaccatctctcactgtcgattatatggaggagacgagaagcaaaccaagagtagaagaacaagtcaatcatttgccgattcggcccgatcgaatcgaaatcatgattacacttcgacagagtgaaatgagatgaatcctgtatacactcaccatatttagcgttttctccttaggtcaaccactagaagtatggaatgtcttttattggacaaaaagttttacctttggtagactatccatttgttaaaagccaccaatgcctctcactgaagcacactagggtggcatttttcttgctcgaggggattccatggcaaattcgcatgacggcaacgcacaagttctttcctatccgaagcacccaccaaaagatttttcagatctggcagccactctaattaggaacggcttgggcagagtagatgccgagacccttgaacgccacctcgaacaggttggctattttcgtctaaaaggatactggtatcaattccttagcccatcttcctcatgcgactacaagcatgtcctcccgttcagaaaggggacacagttccagcaaatctggtgcagatacatattcgatcaggaactgagaactctcgtgttcgacggcataatcacctttgaaatatatctcaaaagctttctcgcacacgagctttccttgtttggcggcgaatttggatataccaagcctgaaggattgcctgagcttagctttgatgactatctggcatgcattaactcgttaagagcatcgttcacgaaatctaatctgccataccttaaacatttcaaaagaacatataaagaccccttgccgccgtattggatgatagtaggctgcctaagctacggaacgttgaaagggtatttttatcagggatcccctgattctgttaaaagaaagctagcagcgaagcttcatatttttaatccaaataccaatcccgaagtacatggagatatcaagattctctcaaattggttggaaacgattaggcaggtccgcaacatggttgcacatcatgatcgtttctggaacgagaccagtacccgtattgttccgaagctgcctaagcatcggagcggtttgcacgccaatgaatggtggggcaacgattgggacgctttcagaacggactctaccggccccgccgccttcctcaccatggaaaactacctgctgcaacaaatcgatggctccgcatggaagaacaaattcatcagtctcatggaccgctatccggaaattcttgcaacggaaatgggattccccgaggattggcgatcactcgcattgtggtcatgacgacaggcgcacgccgtccgtggttccatgctcccccttgatcatgatttgcaagcgtcctccggaggtcggcgaccgcgcggttgccgagaagctcaacgacaggcccaggaagacgctcagctaccggaaaccgagcgaggcgatgttggaggacgggttctagtgaacgtcgcaacaccatgatcccgaaaaggaacgaatcatggcatacgagttcgatggtgccccctacgagaaaagggccaacatgctggccacccgccacgccagataccccggactggattggcaacggtgtgttggacagttccttagaggacgagtccctgttcggtgaattccttcgggctccggtatccgagggcggagcggagccgctggttgtcggaccaccacacgtagtcgtcggggtcacgcctcagtcgctcgatcgtggtgcagtggttccggtacacgagctccttcttcaacagcctgttcgtcgactcgccacggcgttgtcgcaggggtcgcccttgcgcgacagcgaccgcttgacgccgaacacgcgaagcagctcgtcgattctcgtgttgtcgaactcgccgccccggtcggtgtggaacacctgaatatccgtcagcgggaagtcgagggcggcgaacgcggccagcaccaggcccgcgtccctggtccgtccgacggaatggccggcgatgcccctgtccgccaggtcgaccagcaggcacacgtacgcccatccgtccccgactctcacgtacgtcaggtcgctcgccggacgcgtgcgtggggcgtagccgtcgaacccgcggtccagcaggttcgcgagcttcgcctcgttgacccgcgtcttgtgcggtttgaaccgtctgcgcgtgtacgcgctcgtcatgtcccgccgtttcatgatgtcgacgatgcgccttctggaggcggtgacgcccctccgctccagcgcggccttgatcttcctggcgccgtaacgctcatggctgtcgcgccggaccgcgtgcacgtcgccggcgatcgggtccacccgctcggcttcgggatgcccggtcatccagtagtaggtagagcggagaacgcccggtattctgcattgcgctgatatcggataacgggcggcggcggcccgtatcacgtctaccttcgcgcgaataccggcgccgcctgttctgaaacgtccacctccatctccaaccgcctgttgcgtctcctcagctcgatcagctcgttccgctcgggcgtgcggttgtccgcggcccgggtggagccgctgttgcggatgccctggacccaacggtgcagtgtggaatgcgcgatgtcgtgctcggccctgatctcccgggatggcctgccgctctcgcacgactgcacgatctgccgtttgaacgcctcgtcgtagtggcggggatacttcgggccggccatcgtcggcctccaatcccatgtcattcgtccctcatcggactgtctaatacattgtagccaatccaccctcccggttccgcaattcgtcgatccggacatgttcctctgccgacaggtgggaatacgctttcatatcgagcgcgacactttctccggtcatgaacctgaacacttccaaccatagacaggtgttgcgcatctatttagaactcgggggttcagcattaataatgacgagtatcataatatccgagtggttacgccttctcgttgaagagatggtgcagggtgtgaaattcaaggagacggaagtcatgaaacgtacggttgccttttattggttatcccaaaggagctgtgacggatcttcatacaggcccgtggaaaacttaaattggtgggaacatctgtctgagctaaaggacacggcatgggacaataaagccatcaaagacattaggtatgacgttttgcttgacgaagagtatccgattctaagtgtctatgaagaatttgattcagcgtttatgaggcatatagacgataaaaacaaacgcgttaccgactacatggatgactatgtgggagacgatagtggcaggctagctaaatcttcggcctacgcgtttttccccaatgaaggaattgtgggacgaattggcggctcatccacaagccgtagcgtgtctcctcttgaaagagctcttgcaagatattggcctcttgaaacgggaatgaagtggaacgttgctcccgttgttacgattgacagtttagaaagattcagagaagaggttaagggattatcttctctgcacgcaaaattcacgacaaagcagacattgtcttcaattccaaacgagggcggcactgccggagagtattgccagaagttggctaatgaaattggagcggatattgatgttgatgtcaaaatatctatttcgaatgattctgttttttcaatgccgaggaaaagatttaaattatcggtctctgacttcgttccattcgtggctggtcagggaaagaaaatgagtgttagcggcgttgactttgccgataaattacttgagctcaatcttgtcgagcatccggttacggaacaggaggaaatcgtcatttcaaaaggtgaaacgcatcagtttacgaatcttataaaacatctcgtgaccgtttgcgagcagcaagaggaaaacttgtatcggataacacgggaaagacagtcatagaaacatgaagaaaacaaagaatgctccagatacacctgcgtcttccattgcgaatagcattgcggcacacccattcgtcgacgccgttgcatcattggtagttagcgtgtcttggtatatgtcggggtgtcgtacctttgatttcgaagagccctgcgcagaattgtttacttccttgtcttctgttttccggacttcttatggctgcggccacctttatttgttccatggtgtatcagtctggttcgggacgaatgaaatatgtgataaccaagtattctggtgaattatctagaaactggtcaagcatcattgtctggacaatggttacagcagttcttccgcttatctcgctgtacatctataaggagtatgcaagagtagctatagcggtttccttgtactcagtattgatgatgtttttcaagacaatcagaagtatgcactggctcaaatacactttgtttatgcaaaaggcgtcacagaaactccggggtgaattcactgacgatgatatgaagaaggctgctgcccgcagtgatcgtttctgaagaagctttcatacgacgagttgagcatgtcattcactatgctcaactcgaggttgaagaacggaagacatctcagttctccaacctccgaaaagaagtctgctgacagttgtattgaaccggaagagctttgcgaacatgatgcataattatgagcaggagcagagtgattaataaaatggtcatgaccaaaaggcgcgcggccttctgacactactatcttgcaacctatatctgcattatatatggcagatttggcttcttaacatgagacttctcacttatgcatggcacagcttcttgatatggcctgatttttgttccgcccttatagtggggcggcttgcgccgcttggtttgcataatactcggtttcggtccgttccggtgtcctgtagcccaaggactggtgcagacgctccgagttccaccacgagacccaccggaacgtcgccaattccaggtccctcaaatcccggaagggcttgcgtcgccagacgagctcggtcttgtacgcgccgtcggcgctctcggccatggcgttgtcgtacgagtcgccgaccgtgccggtcgagggaagcatgacgaattccccgaccctggtggtgcacacgaggctgatgtactgcgcgccatggtcggaatggtgcacgagaccgtccgtgccgccatgcgaggcggcccatgatatcgcctgtcccagcgcctgcagcggcagctccctggcgtccatggtggtggcgcacgcccatccgacgattctgcgggcgaacacgtcggcggcgaacgccgtgtagccgaacgagccgttggccatgcgcacgtaggtgatgtcggccacgtgcagccggttcggcgcctccgcctcgaacccgcgttccacgaggtcgggcctgccgcccgtgcccctcgccggtttggtggtgacgggcgtcctgccgcggcgcacgccgcggattcccgattcccgcatgacgttcatcacctggtcgcggccgatctcggccggatcccagccccgcgccaacaaccgggcgtgcgtcttgcggtgcccgtacacggccatgaaggaatcggcatggatctcgaggatgccgcgggccggcgcctcgtgcctggcggccatacggctgacgggcttggatctgaacatgcggtagccgcgcggcgtgatgaacccgcagtccagcgaagcggccagcaccctgcagatcggcccgaccctgaaacggtccttgaattcgtcgatgtaagcgaccatcaacgccgtgtcgggtcgagccgtgccgcgaaaaaagccgacgccgtcgtcaatatctcgttcgcccgcctcaatcgcgcgacctcggcccgcaaactcttcaactccgccatcgcgtcttcggccgactgcttggtctccgccgcgaccgtggcgtccgtcttgttgcgccaacggcgcagcgtctccggcgcgacccccagattgttttgcttcaatttttcttaagcaatttctgcactatttttccgcagcaggggccggtgccgttttgttggactcgtcattgattccatcaccaccaatcatgccacaagaccgagcccgcgtcgacggtccatgatgcccgtgtccgaactccgtcttgatcctcttgtcccggtaccagaccatgtactcgtcgagcatgtcgatgaacccgtccatcgaaacgcccgcgaagctgcgcttgtggaagaactcctgcttgagacggccgaagaacccttccgcggcggcgttgtccggactgcatcccttcgcgcccgtcgaacgcgtcaggttgttgtccttgcggatgcggatccattcgggccaccggtagtggcagccacggtcggaatggatgattggtttctccccgtccctgagcgtggagcacgcgtcggcgagcatgccgttggccaatgccgcgttcgggctggtgccgatcgtccacgcgaccggaagcccgtcgtagcagtcgatcacgggcgacagataggccttgcccgcgggaatcgagaactcggtcaggtccgtgacccacagcatgttcggacgctcggcatggaagtcgcggttcaccaggttcttcggggccttggccggctcgcccttgtacgagccgtaccgcttcgcgctcttgaacgacggcttgatcccgttcttcgtcatgagcctcatgatccgtttggccgataccctgatacccatgctttccggctccaggtggacccgcttgtacccgtagcggcgttcgctgttctcgaacgcctctcgcacgagctccagcaacggcgcgtccttgtcggggcgtttcatggcgttgagctggtagtggtacgtgccgcgcgcgatgccgaccacgggcaagaggcttccggcggtcacgcccagcgtctcgctaacggtcttgacgaggatcgtcttctctcggttggtcaggttttccgggtctgcgcccggctcttttcccaacagctccaacgtgcccttccggatcgcgatctggatgtcgagctcgcgctcggtccgtcgtctggcctcgatgccggcgtccagcccgtccagacgggcctgcatctccgcaagtctccgctccatcgacgccaccgcgtccgccaggccggccacgtcccgcggtccggcggcggccggcggcatggccgccggcgtaaagggctccacgccggttttcccctccccggccgtcgggggcttccttctgggtgtttgtgtcacgtgcgtctccttggatccggcgagcatctgccgtttccagtttcccgacgacggacgcctccacgcccagttcggctgccgcctcgcgcgatttcagccgtccggacgcgaccgcgaccaccgccttccgcttcagttcctcgggcacggggccgtgcctcagcttgcgtcggccgggcgccagctcgtcgatccacgccatgagcagttccttgcttttgggatatcccagcatccgcatggtgcggctgagccgtctgccgtattcgaggtagtggtccaccgcggcctgtttctgctcgtccgtgtaccgccggtaccgtttcccgcgagtggaccgtcttccggtgcgttcctcctcgaggcgttcccggtaccacaccggcagcatccctctgctgggatagccgagctcgcggatcacgtccgcggcgcagcactcgtatctgatgtacaggtccacggccctgtcgcgctgctccttgccgcacttcgccataagggggttctcctcccgatcggggagtccaagaaaacgtcaccacctcgaagcgtccacctcgatttgacgaaatacaccggttcacccgtcatgtcccggccggtctcaggtatcggcctgatgtgcgagtgccgcggcgacgtcaccgaccgcagggccggcgagcacgcgtgttcgagacgctgctcgggtatagcacctcgagaggcgcggcaccgccagcgcgggctccacgccctgatcatcgaaccgttgcgcggcgaacagcctcccgacgacgtcggcgcagtccgggccggcccgccgcgcccacttctcgcagcattcccggtcccactgcctccatacggtcttcccgggcgggtcggtctcgtttgtgctgtactggttggcggccgtggatggcaggagccggtgcgtgctgcagagcctggattgtgccggcgccgacgcgcaggtccacggtggccccggcgtacgcgtacgggacggaacaccagttgcgcgcgtacgcgacatggcagttgggccgcgccttcctgccgtagatccagtccgccacctcgtacgctgtttccggccggtcggcagcacgccgacgaacaggcacgccccggactcgtcgcccgtgaccgggtcgacgatccgtatggtcttaccggcccggtcgacctcgatggcctgtccggccctgtgctcgaccccgctcgtcacaccggtcctcgccgcatacgcggcgtactgcttgcggaaacggtcgcaacccatgcgcggtctgccggcgctggcttattcatcggcgtactcgccatgcaggatgcgcagcgtcacgccgacgcgggcgagctcgcggtgaatcccggcccagtcgggctgttcgtacacgctttcccgttcgcccctgccggggaacggcatcgaatacacctcgccgtcaggcttcgcggccacgtccggataggcgattcccgcggcggccgaggcggacggcacctcggccacgctctgtctcgcgattcccggagatctggctatcgccctgccggacaggccctggtcgttcaggcggggtatcgccttggtgtttatggtcaaataaacgtgtacggcgtcaccaccaaatctgaacggcataagcgttcatattggacacggacggcggacggaaatggcatcggcggaagaaaagcgccggtgccgtacggttcctgatagattcccgagtgctaacaaccaacacatggtcctcgggaggaaaggaatgacgacaccggtgcgtattcaacagagtatcaggcagctcgagacgaaaggcctgacgcatacgcagatagctagggaactgggcgtttcgcggacgaccgtggtcaagtacgcgacccgcgattattcgcccgttccgccgaccgggggaactgcgagccgttccctggtcgcgggcgagtacgcgcgcaaggccgacgaatggctcgaggccgaccggcgcatgccacgcaaacagcggcacaccgcccggcgcgtacacgagcggctcgtggaggaatgcggcttcgagggcagttattcgtcggtgcagcgatgggtcaagcgctggcgccaacgccaccgcggcgaggccgaggggttcagtgagctggaatgggcgccgggcagcgcgcaggtcgatttcggccaggccctggccgtggtcgccggcgtggaacggaccgtgcatttcctggtggtctcgttcccgtactcgaacatgagatacgtggccgcgctgccgggagagaccgcggaatgcgtgtgccatggtctgaacaaggtgttctcccatgccggcatggtcccccgcgtgctagtgttcgacaacgccaccggggtcggccaccgcagggccgacgggaccgtcacccagacgaggctgttctcgctgttctgcgcgcactacggcttcgagacgaggttctgcaacccctattccggctgggagaagggaagcacggagaacgcggtcggtttcctgcgccgcaacctgatggtgccgacgccgtccgcggagggatgggaccggctcacggacgcgtggttggaacgctgcgacgagatcgcgcgcggcgtccactaccgcgaggacgtgccgatccgggacctgttcgagacggacctcgaccacatgctcccgctgccgccgtccatgttcgacgcgtgcgactggcgcggggtgaaggccgacaggaccggaacggtcacgatcgactcgaaccgctacctcgcgggcccgaaatggcattccatgcgtctcatggccggcgtgcgggccctgcgggtcgagctgcgttccatggacggcgagccgatcgtcacgttggagcgcaggtgggggcgcagccccgacaccgcgatggacccgctgtcgctgctcgccatcatcgcacgcaagccgcgttcgtggggcgagagtcccatacgctccgacttcccggaggagacgcgcgtgctgctcgaccggatggagccgcgcgaacgcggcctgctggtcgacgacatccgccacgcggccgtggtgagtggcttccgtgcggccgtcatggccgtcgtcgagatcgtcgccgcgggcagaaggcccgacagggccgcgatcgaccagacggccaggcggatcgcgcagggcgacggtcccgaatcgagggccaggctcgacacgtacagcaggttcatgagggaggacggcgatgagtgagtcgacggacgccgcggcgggcggacgcaggggcgggcggaccgtgagcaagtccaccccggacgaggtcatggagctcgcatgcgggctgccgttgaccaggagcgtgctgcgttccgtggtcgcgggcgccacgcccggccagctcggcgtgctggccgacctgttcagggccgagaacgccagccggacggaatccaggcgcgccaggctgatcaggaacgcgggattcccgtgcgtcaagggcttcgacggatacgactggggcatggcgtcgttccccgccgactgggggcgcgagcagctcatggacctcggtttcgtggaccgggccgaggacctcgtgctctacggcgacgtgggatgcggcaagacgcacatggcgatcgccacgggcatgctggcgtgcgagaggggcatgccggtgaggttcttcaccgcgtcgtcgctggtgatgcgtttgcggcgggcgagggacgagaaccggctcgacgcggaactgcgcgcgataggccgcgccaggctgctggtcatcgacgagctgggctacctgccgatcgacatcgacggggccaggctcctgttccaggtcgtcgcggattcctacgagaagcggagcgtggtgttcaccacgaacctggagttcggacggtggggcgaggtgttcggagacggcgacatggccgccgcggtcatcgaccgcatcgtgcaccacggaaggatcgtcaggttccgtggcgagtcataccgcaacagccactccctgatgaaataaacgaaaagagcggaaccaacccggccgccggtgacggtgtccattttgaacgccgatggtgttcagattaactggtgacgacacgcagatttatttgacgaaagacacttggccttggtttccttgccatgttggcagcctcctttcaccacacgtgcctcgcatggtgaaaggagcctgacaagcggcggcctcgatacgcaataacgatggccttgaaccgcaataatcgtcaaaaagtgcgattggccttctcctgcaataacaatggcctcaaaacaagcaaatattcagtcaatatctcgttcgcccggcgcaattccgtgttctccgcccgcagccgcttcaactccgccatcgcctcctgcacggactgcttcgtctccgcggcggccgtcgcgtccgactggttgcgccagcgccgcagtgattccggcgctatccccagatccttggcgacctgttcgatcgccttcgtctccgacgaatacgacgacctggactccgtcagcaacctgacggccttcgcccggaactccggagtgtatcgagtgccccttgccatggttccatcatctcccatcgagttagagaggaaatgcagaacaaaaatcaggtcatatcactcgtttccagcgggatgattggtttcgccatatggccagcataccggggatccgccaccagccagcgttccaggcactgcctggtcggataacccagatgcctcaccacctaggccgtggtcatcggcgtagcggaatacagctccaccgcacgccgccgttccgcgggactgaacataccataatcctttcgttcagtctccaagaaagcgtccgcagccccctacccttaatgatatgccattccaattcttctcagaatgatcccatataatcggagtacaaaggagactattagttatgtcgttacagttatctgactgtaacgacataactaatagtcaaccctggattatcaattcgataaattcgaagcagcaaaacgctctccgaattcaattaggaatgacggactgaaccgaaatcgccaatagcccaccgcatatgacgctgaataaagatgtcaagaacatagcagacagcaatcgcagcgataagtgttaagaatccaacgagaagctgtcctcccaacggcaaagaagccacaggaataccaacagcggagaacaaaacaaacttgaccatcttaagagcaaaatcattcaaggcgtaaaaaaccaaactgtcccgaccgattgtggcgaagcaacgcgcttctggcaacaacaggctgaaagcgatagccatcgccatgccaaagaacgtggtaaacagtgcaagtgtggcaagcatcgcacctgtagccacaggctgtgctgcagagaaatgttccaaaatcagaaacgctacagtgaaaaccaaaaatgcgccaagtttgtggctgaagttcagccgatcccattttcgaatgtcacatgcctgagcaatgagatatccaaatcctacatacgcagtggcctcaaagattttcccaagctggaaaggaagcattgctgccacagaagtacccttgaggaagaaatcgatgatgagatacaccaaaaggactgcagccaacaccaatttgttgaatcgcacgactcgcactgtaagccatagacaaggtatggctacgaacaatgaccacaagaaccataatccagcattgccctgtgcaaatacaatggcgataatcgcgctcagaggattggaatcagcagtttttccagcagattcatacaatgacggtcggagtaatttcactatgggaggtataaatgcgaacactgagaataaatagtaagggataagcaaggtctttgctcgcttaatgatcaaattcaacagattgacagtcggtttgaagaacaatccgctcagtaagaagaacaagggcatgtggaaggtatatatggcagtcagcaatggttccaactgcggaaaccagctcgcaccgagatgcccggtaaaaacaagcaccatggctactgcgcgagcaatatcaacccatataatacgcgatttgcttcgatctggttcatacgacatgaatactcactcctatagtatcattcaagctttatttagaaaaaacattgcgacaaaatcttctattgcagctcagttccctgtttcttaatttaaaagcactgcaattaacgtctacgttagctaatattatatagcggaattatatggcagaatgccatttccattaactgataacgtgtgtaggaatataaaaagacataaagaaaaatataatatttttacaaaggttttcttttttcctgcaatatagtattcaagataatacggtatgctaagaaaattaagcaaatagaataatgcagaaactctctgacctagtggtatagacagaccaatcataatagctatggatcctacgaaatgcaaatttctaaaaaccgtaaaccaatgatcgccctctttagatttcgtaaacaaatagacaaagaagaaacctacaaacaataaagatgataacgaaaatactttgctaggatccggatagtagccggatatgtagttcccatactttgtccctttgagcaagataccaataactgcaacaaaggtaggtacaagaacagccaaaaaagcaaaaagggacaaatatatttttttgtcaagctttagataaaggagaggaatgacagcaaaataaattagagcagaataatgaaaacctaccgctatcgcaactaaggaaaaagccacaaaaagactctgtaactgatttttgccatccatatttcttttcacaaacaataacgcgcaacagaataatgcagtagctattgtctggcgaactacattcaatgagagtaagaaatacccaccacacaaaaaagaaacagtcaatagaacttttgaacatggcatattatatataacaatatatattaaacctatgaatataaagcttgtaacaataaagatagactgataccagctacctgcaaaatcaatacacagcccgttaagccatttaaatattggctccattggcggggggtgccattatatatctgtttataagttggaacatatgtaaaaaaataatctgttccaactccatagcggaatccagatattgtgaataaaatcaaaaaaacaatagcaaaaggtaaaacctttgcccttttattcaatttatctgccacacacatcaaaagtatgcagcagaaaacagatgttatataaacaaacattcttttccttattttgatacactatattcacaaaaggtatttgttcgagaaaaattatttcatagaacaaatacgtatatccagttgatcaaataagactaacgcttcataaaccatttccatgcgtgtctgaagacatccgcccctgagacaaagctgacagaccagatgcgaacagagctccgtaaactgcaaccaattctcggaatcgctgcatcatcagcaaggtgtgattcggatgacgaagaatcacatacacgcaagcagtaggttcaaggttaagagtaaaccaacaatctatgtcccacttaggtaatgctgtagtgacatataacacatccataaatacactcctagcgatttcactgacctcagcggggagcaaagcctgctgacttaccagaacttttcgttgaaaactaagttcttaccgaagagagagtttcgcaacaacagttgggctgataaatgtaagaaccgcaataatctttcttttcatggagatatcagcggcaatcataggtagggcgagactcctcctatgatgaatgcacgtgcgcaataggtcacgatacacatgttcctgatgagtagcgataatttggcgcaggcaataaccgtaggtactccacaaacgccagttataagccttgcgaacttttggattagaaagatcaaggtgttcacaaatatattgcattgtggtaatggctccaataccctgtcgttcaacgtcaggcttggttgtggcactggtcgcgttatccgtgcgatagtgataaacctttttctgtccgacagtcacacagttggctttgcttgccgctagggtgataaattgtaacccctcccctgcgcaaaagtcggtaataaactcaagattgttggcagtaaggaagctccgcctatacagtttattccacgctccaagctcgattgtgggatagaaaaatagctccattgcctcctgaggattgatagtagacacttcatcctgcgttctctggtggaagtctgtgctggtgaagcaacacagcgatgcaacgatatcagcgttcctcttagcttgaagctccagcatatattcgacgaagtcaggttcgatccaatcatcgccatctacaaaacagacatattcccctttagccgcatgaagaccagcatttctgctcgccgagacgccagaattagtcttatgcaacacatgaacacgttcgtccttatgctgccatgcatcacaaatcgctggagcattgtcaggagaaccgtcatcgataaggagtatctcaatgttgtgatgcgtctgttgtatcagtgaggcaacgcactgatcaagatacttctccacgttgtatatcggaacgataatagaaaccaacggttcagtcacagcattcatcccttcatcggtttattctctgagacatagctagcaacatttgtttgaaggaaaccaagcgaacgtttcttcgcttctgcaagcaactggttaggtctgtcatagtcgatgtcattgctcaacaattcttcaccgacgacatgcctgtccttcaatgtcagggaatccagcaagtcaagcatgcgtgagtttgtagtctgcttgacggtaaagaaatggaatggcttgttgtacacgatggagaacacggtgccatggaaggaattcgttaccacagccttggcgttacgaaccagattcacgaaggtgttaggtgaagcgttccagaagtatcgatcctgatccaacgtgtaatcttcgatggcagtaccgatggtatagactttcacgcctagcttcttggcaagtcgccgcgcataggcatatacgtccttctggcggttatagccgtataccagcacatagtcttcagtggggacgaaatcactggcatcggcaatgacatcccaatcgtttcgttcaagcaggaacaccgggtcaataacggattgcacattgtcaatgccaagatcctcaagcatcggtaccgacgatggctcacgtaccgacacagcatcgaaatcggaaatcaacctatgatagcgggtcttttggttattcggaatttccggcatggcaatgctggcagcatatgccactttccgagctttcgcaggcgcaaacgacaggaaaaacgcatcgtctttaccgttaagcttattcttacagttccaaatctgatcactgccgcaaatataaacatcggcttgaggcacatcagcctcgatttcagcaagagtgcgatatgtcttggcgctcatgggcacataatcttccaggaacttaccgaatactttgcgccccttggtcaagtcggggaaacgcacgacggcacggaccatacgaataggcaatggttgtgtggatgtgtagtagtacttgggattgtaatccagcacctttgcgtccacacccatcttgcgtagtgcggtgttcaaaccataggtttgcaaaacagcaccgtaattcgtcggccggctgcaggtgatggtgtaagaggtagtcataggaagttcctttccgatactgctcattgtgggtccgattcaacgtattcaagaaaagcctcatagccttcgaacataggctcactgcgaataaatgcccgctgcgatcgctccgtattgtcatcgaggcgaaatacatcctggaatgtttcattcagctgagcatcacgagattcgaatagccagaagaattccctgagcagctccttaggcggacgcttatcgtacacttcctcatatttacgcactaatagtgtcgcttcctccaattgaaggttacgccgcttgtctacatatacgtctagagaagaaatctttttcgccggtacgcctgcatatacagcgttcccctccaaatgaccggttaccacactaccagctccgatgatggtgttgtctccgatttcggcccccttgagaatcaatgacttctgtccaatgaaaacattattaccaatacgcaccattccacatgagcccaacacttctccggtaagacgctgcatcactgcccagctatagtcatgctgcaaaatagaacagtctgcagtgatatgtacgttatcgccaatctcaatcatccaaggtctctgagtatcaatcttgatagaccatggcgtatacagatgcacatgctgccctatatgcatcccttggctacgaagccacgatacatattgctccgacgaggacttgtgcccgtataccagttgcaagacaagttgtttaaggcccatcttcttacttgctccgttccggatggatacgtttataaatcaggaaagacacactgtagaggactggagataccgccatgagcttaagctgcatgctgcgtccacgaggaagatccaccgactcggcaacaagccctatgttgcgcctaacaaaggcctgcgtatcttttgcgaaacgtcgccattgttgttctttggaactcctagtgacaagagcctgatcataaaggcttatcatgctccgcatcaacccgtacaaggcaaaaggaagctgctcggggaacctccgacgtaccagttctaccatctgcttagtagcttcgtaacctgcccaattatagtttgtgtatgtatgagaaaggcttccctcagttgtccgataatggtacagaggcaccgaatcaaaagtagttcgtttacttgccgcaagtacttcataagtaaatctcgtatcctcaccattaacgcacccttccgggaaacgtatatcccccaacacagagcgtttgataagcttgctccaaggagaaatcgtcgagtagcccggtaggttaacatacttgaatgattctgaagtggtcatcactaaatggacattaggctggtagtgacagatttgtcgtccatcaggatattccataatgctggcggtcatagaaatatcggcatcattgtttttaagagaattaaaaagagcctcatacatggttggttccagccagtcatcggaatccacaaagcctatgagctctcccgtgctactttcaattccattgtttcgagcagctcccgatccctgattctcttgatgaataacacggattctataatctttagctatccaagcatcacacatgtctgggcaggagtccggagagccgtcgtcaaccaagatgatttccaaattccggtacgtttggtcaacgattgactgcacacaacgatcgagataacgctcgactttatatacagggacaattaccgaaatcaaggggaagtcttctggcgtggccccctcatggaagctagatggattgtcgctcatgctgtatattttctccttccaaacatcaaattaatcaaaggcttgagctcataacattgagcacctgcaatggataataggcaaatcaatgacaaaaacaagtaatggccacattggctcagagtcactacagattgagcagcgagcagccccatggtaatggcagtgggaaacggcctcatgtcgacacgcattaaacgacggatatcaattacacgaattacgaatatcgtcaaactgcccacaagtacaccaagcgctgcagctaaaataccccaactatgcacgaacatagcagtaaacgcaaggcatgatacagttcctacaatcgttgctataagcaatggctttgtacacatataggcctgataaattgtgccaagaaaattgttgatggcacctagatagaaagctaatacaaggatggaaattagcggccataccgagtaaaactgacgctgcatcagtaccttggcgatgaacggagataacgcaatcactaacgcgcttcctatcgacatcaaggcatgatacacacgccagattacatcatagaaatgcttgagcccagagctcttaaactcttggaacgcagaaagctgccaagcctgttgaacaatctgttgaagcacattaagcaaattaggaatctttgaagctgcagcatacaaaccagaagcggaaatacccagtacacctgtaataatgaaacgactaactgtcgtctgaatctggttgcacaatgaattcggagccaatggcagtgagtagcgccaaagttgcttacgaagagacgcgttgttacgccatactgtaaaatcgataaactgatattgcttaccggcaaaaagatataccagaatcgctgaaccattgcctacgatataagagtagaaataccccataagaccgagatgcattccggcaatcagcacatatgcgagcacgcccataataagcgcagacaacatagaagcgtaagcaatgagcttcgtctgatccatagccctagcgacagtacccatcacagagggaaaacacaacgccgcataggacaacaagaaccaaattttatatctacctagcccaccaaaaataggcaaatcaaatactggcagaataattgccaaaagcacacagcttgccaacataaccagcatggtttcggtaatataaaacgcggcttttgacttatcatcaagcgtaaaacggagcatgccctcgctgatgagcaaagttagtacagggaataatgtggtcaccatgatggtagccatgtccatgatgccgtattcctctgtagataggtacagggtatacaacggcatcagtatgaatgccatcagtttagtggctactgcgctgagtccgaagatgccgacattaatcagcaaattcttatacttattcacgcaatcacctcataagcccagacaactgcgacatgtacatttctttgttgagctccgagcgcaatgttaccgcatgagctcccatagccgctcgtttgcctgaatcttgggcaagctcaatcatggcctcagccaattgatcaacgagccgatcatcccgctcaaggatgatggcggactgattatccgcatattctggaatgcctccggagcgcgtggtaatcaacggcttgccggaaactaggctctcgattaccgccaaaggtgcaggatcatcccaaattgacggcagaacgcatacgtcagacatagcgtagatggcaggcatgtcgtcatagtccacaaaaccagtgaaaataatacgatctttcacacctggatttgatgccaaatcccgcagcttctgttcaaacggactcacaatattcgaattaaagaagaacgcgcctgcaactacaagcttcgcgttggaaatttcctccgcaacttcactgaaagctcgaagtagttcctccgctcctttttctggggtaaggcggcctgagaacaggaatacaacatcatttttatcaatgccatatttcttacggaaaatctgcgccttcttgtcggcttcttccgagccgaacctactcgtatccacgccgttgcgccatacggccttctgctcagacctaagcccaccctcaccatgcttgcgaagaaacttatcaagtgtgtccacaatgtaattggaaacgccaagtaccttcttaacctgagcaatctcgtgcttgcaaccgaaatcattggtcacttcattgtgcagatggtagtataccttgtccgcgtagcgttcagcgttaccatacttttgcatggtcatgaacaaagtggcgtgattttcgatcatgaccttatcgaatggagccttgccactcgtatcgtctttgctcagcgctttggccaccttgcggatgtaccacaaacgttgcgcaatataccggtagctcatgagtttcttcttgcgaagaatgtattttgcggcccagtaaatacaccgatcggcagcctttaccagcatcggcgtcttgataaagcgaaaatcagtgtgctgaaaagcaccatcacgaacgattttgtcaacgccaggcgcccaggaagagaaaactgtgaactcgaaattcgcggtcttctcattctctcggaccatcatcatgtccaacgcttcgaccgcgccaccaagcacgttaggaaccggcaagtaaccggaagtaataacagcaacacgtggattcatcttcacttcccattcctcttatttgcagataaatgattcatatttttttaccaagctgtttgcacatcgttggatatcgtattcttcgatgtcaccgctaatttgatctgaacgcttcgaggaatgcaagtttgacagcgtttcaatccaaggctttacatcagtaatctgcagaaaataagagctagcggttacatccgcttccgaaggaacaacatcggacagtaagcatggcaaatccgcgacctgagcttcaacagcaactatgcccaatccttcataaagactgggaagacagaacgcatcgaacgcctggtatagacgattgacatccgagcgttgaccgaggaatagcacatgatcagccataccgagttcttcaacatgttgttgaaccgcagtcctgtcaggaccatcaccgacgaaggcgagcatggcgtcagggcgtttaggaagcagccccgcaagcacatcaaccagaaacgtctgattcttctgtggcatgaaacgtccaacatgaccgatcaggaacgtatcatccgaaatgccgagctctttacgtgtttgtttacgcatttcagtattaaaacggaatttatccaattcgatagcattgggaatcacggtaaaatccgcatttttgccaaataaccattttcctgcataacgactgcatgcaaaacgaaccgttggatacacattggcgaacggacgcagcacaagtttcatcacgttctttgcaaactcgcctttgcccatggtcgaatgagaatgcgcgatacgaacaggcactccaaccttcttcgccgccgatagcgggaacacgctcaacgtattgatattgctgtgcacaatcggccactgctgctcacgcatcaagcgaatcagctcacgacggtagcggatcggatgctggtacggcggtatacggaatacacgaccgcccaaggaggtgatttcctcttcaggaacacgcgtggaatcctcgtcaacaaggaaatcgaactgcactttactgcggtcgatgtggcgatagtaattcatcactactgcctcaacaccaccgccaaccattttgccaacaatttgggccacccgaatcggtttttgcggattgtgcccgccggctcccctatctatgggatgagtatcgacatcgctcatatttcgtattgcttcccttgtacttctggagctccccaacaccagaaaaaactgccattgtttaacgaaatcttactgttataccttgtcttctatcagtatgcacccttgtgggttacgacggcgccgacagtacggaacagcagcacgacgtcacctaacatggaccaattctgcacgtaggtaacgtccagagcctcggattcctcctcactcaggttggatctgccggatacctgccacggaccggtgataccaggcttcaccagcatgcgagtggcatacgtctggttgtactgggccacttcctcaggcagcggcgggcgcgggcccaccacgctcatatcgcccctcaacacgttcaggaactgcgggaactcgtcgatggagaacttgcggatgaaccggcccactgtagtgactctgggatcgttcttcatcttgaagatgaaccgtcccttttgcccggtctgctccgccagttccgacttcatcttgtcggcgttcaccaccatggaacggaacttaatcatcttgaacggcttgccacggcgacccacacgggtctgagtgtagaaaataggccctctatcggtcaccttgatggcaatggccaccgggatggtaataatcgcggtgccaaccaatgccatcagcgacaccacaatatcgaacacacgcttcttgaacatggcccacggcgaatactgcggcaggctgatggtcatcaccgtggaaccctgaatcacacggatgttggtctcatggccgctcacatccaccgcggaggtaatcaacgccacttccaagttcatggcctccacgtccagcacaaacgtgttgaaattgtccgagaaccggtgcatcacatcagtaaccatcaccgtctgcacgcccatggacgcggcgcgttcggcaaaattcttgcaatatggcaacgtggcgatatccctaccacaaatctcacggatccgctgcttaaattcagcggtaacatcaacggcctttacatagccggtctgcgcatccagcccaatcgggcacaccgcaatggcatggtagttcagctggctcttccggctcaaaaactgcaaggcatgctcaatgccctccagcgagccgaccaccacggtgccatacgaatacgcgcccttctcacggctgaacagcacgcactgacgaatgatgaaacgttcgacaatggtgaccagcaacgcgcacagcagcgccaatccagtggtcaccagaggcacatacacgttgagaatggaattcaacgcgcaaaccatcaaacccgcgaacagcgcgcccttgatcaggaacgcattgagctggtaaccatcacccatcacatgacggtggtacacgcctacgctgtgcaggcaatatatccaaatcagcgacccaacaagcatatacgcccacaaagcaatatggaagtggaaacgcgtggaatataaatcaccggtattccgcaccacgtatacgatcgccgaagcgatgatgaaggcagccatatcgcacaacaccaacagggcgttgacgaagaaacgccagtaggcaacgctgagcacatgcctgcgtgaggtctcgctcagtttctccccactattgccactgtaagccattcttctttctctccaagactaaaagccattaccccccccctgatttgttgggggcaataaattagattactcgcacttccgtataaaagacactctccgcttggccgacacgctcacctgccttcgataagcggagtctggcggacggtgagggcattcttcgtgttcggagcggactgcacgtgcaaggtgatctcatactcctcccccggcttcaacgtgaccttgccaacggtgagcgtcaaaccgtcatgcacggtcacgccctggtaatcgttctggttctggaacttccaatccaccaagcggccattcgccggcgcgtacaggaacaaggccgtccggatatctccaggctcggttccatccgtgccaccggtcacataattcggagccgtggccagttccttggcggtcatcagattcttcatcttgatatgcaccgtgtactggttggcaccgttcgccgccaccttctggaattcggtggtcacctcgcgatgcagataccaatccatcttcgactgcgtctcgtcggagatgtacacgcccacctgcggcttggcgccttcggtaatcaagcggccggaaatgtcggattcggcgatcagatcctgctcgtcctcgtgcgcgctccacaacagcagatgcccctgcttcacggattgagacaacgcattgatataggctttcggatcgccggaattctgcgtgatatggtcgaacgcggcctgcgcggcatcagcgaaatacttgtccgtctccgccggagtcatcttcgcgtacacggtgttcaacaacgtctgcgcggtattcgtaccgtccaatacggagccgtcgggcatggtcacgccgccggtgacggcaagcatgttctgcaggaacagcgggtcgatggcaagcacgccatccacctgtacgccatactgcttggcccacatggcacgcacgatctcgccggtacgcgggaaatcgggagtgaagttcacatcgcgaatatccgtacccagcttgtcggtgaacaacattttctcctcggcagtgagtttcaccaccggctcgtcagccttagaaatatccgcgtccgagacaaacggttgcatgctcaaatggccgccctgcacggtgaccacgccaagcgacccggtcaggccgccggacggacgggcctccgcattggtctgcgccagaatcagatagttgcgcggagcgtcattggcatggctgtccgtgccgagcatgccgggcagcagctgggctacggtgttcagcgtatgcacggtgctgttgagctttacacagtaggtctgggccgagtcgagcgcatcggcgaccttgtgaatgtgtggccgtttcgccgccttgatctcacgggtgctgttgtcgatcaccttgtcggcaacgctcagcggctcctgggaatcctccaaaccaggaagggagaccgtgccattctccacgtggatattgctcagattgacgttcttggagaccttcgccaattgcggcaacgcctgcgaggaaatatcctccaacgaggcgaccgtggtacggaccgcggaaacatcatcccccacatacggaacatgcgatgcgaccgtccataggaaggacgacgtctgcttgtacgccttgtccacatggccggagaattcgttaaccttcgtgtcaagctgtcggctgtcggcctgggtgatggtgctctgcagacccttcgcgcttgccacggcctgctgcagttcgctcctggcgctcatgaccgaccatacgaacgcgacggcaaaggcggcgagcgccagcagcacggcgaccacggcgatcaggatgcggcggttgcggcgtttgcgtttgatgcgacggatgtgttcggcgctcatgcggcgacggacgcggcgggagtgcggttcggagtcggcgctgtctggggcatcttcattgatgtcggcgttggcgtaggcattggcatcggcgtgcgcttcggtttgatgctcgggctggtattccgcctggttttgagcctttccaatctggtgttcggcctggttcgctggctcctgccatgtttcatcgccatcgtgttcggacatatttcgttactctccccatcacaacgttgtttcacgtatcgctccgggtttccagtgtaattgctggagccgatgaactcgtactcccccaagaattcgacgaggacactcggcgaaggccgtcaacaagaagcggattaggcgacttcgagggtggcgaggagcgcgcggtggtcggaaccggggatgtgcttcgtttcgaggtcgcccacgaccacgcccttgtcatgcacgatatggtcaatctcggccaccggcagcatggccgggtacgtcatgtgcaaaccctcgccggcctgttcgccggagtccaggaagcggctgccaagaagataccggaagctggcatgatcccatgtggaattgaaatcgcccatcagcacgtacaggctgtcgtaatgctgcaactgggcgagtgaatcgaggctacgattccacaggccttggttgctgggacgtggcgagaaggggtggaccgagccgaaccgtactttcgtgccggcgaaatcgatggtcgccgccggaacactgctcgactccacgggaatcaggttctgcttgacgtcttccatcggcgccgcgctgtacagcacgttcacaccaccattgtcgtgccacgtttgctgcgcggtcacggaatacggcagatagttggcgattccggcgttggcgagccggtcgagcagactccatgacacttcctgcagggcgagtacttcgacatgctcagccttcacggtttcgacgattttgccggcgtcggccgcaccctgtttggtgttaagggtcatgatgcgtgcgtatttgtcggacgtgtcgggcagaccatcggtttccgtctgcgcgacggcttggctggcgttctcggaaatcgtctgttgcggttcgatatacccccaatgccagccgacctgcacgaccacgcacaccacgccgatgatggcgagcgctgcacgtcctccgatctgtcggacggcgagcgcgacgatcgcgataaccgcggacaggaaacccagccatggcatcagtgcgacgatgatcggcacgtagcgtttgccgtcgaggctgttggggagcatgcggagcaacatggccagcaggatgacggcggtggccagccagagtgcgatggtcaggatgcgcaggatggcgctgcgccgggacatgccgcgttgggcgtggtcgcggccgctgcgactggcgccggcagcgtcgagccgcgcgcccagatcctcgatctcgtgttcggcttcgttttcgttgccgctgccgcgttcgctggtgccttcaccttgttcgctggtgccttcaccttcgccggtttgccgcatgcttgcctttcattacgttcccgttcaccatacgcaacgcgatatggattcattgtaaacggtccgcgaggttcacagtgcctttacgtgctcaccgttcttcgcaccgtctttcccaccgtctgtacgccaccgcacgaacgtcgaaactgaatcatcgcaagaactcgccacgtgcagcatcactcaacgaatatcgaatcggccgttttccatgcgcttccagcaaacccaagtccatcaacgcatcgagagcggtgctcaccttccgctcccccacaccaagccattcgcgcatcaatcgccgtgatatggaattcgaagtatcgtcgaacagctcctcctgaagcaggaagaacagcatgtccctctgcagttcgggaacgtcatgcgcatcggcgtaccgttcgagattgtctttcgcggcatcgagcatggccttcttctcgctcaacacggaaatgatgttttcctgggctgtggcgacgaaatggatcatccgatagcagaacaaagaaacatcggaacaattcaatggatgctgcacttcatcaaaagccttgtaatactgccctttcgcttcagcgatggccgagctcaggctgaccgccgtcggtacggacaggcttttgcttaattgcagggcgagcaggaaccgtcccgttctgccgttgccatcgtagaacgggtgaatgcattcgaacgcgtaatggcacatcgtggcccgcagcaacggcggaatggtctcgttggaaagcaatgccagccattttgtcagctgcacctggatctctgattccggccatgcgcccttatgaatcaccctgtcagcaccgtcatagaccgaaaccgttctggctctgaacagcatgccatcaggtttttgatcatccttcaattcgccgtccatcacctgatcgtagatactgcgtatatcgttcagcgtctgaggcaaatcaaggcgtgctgccccctcgccggaaaggccgaggaacagtttggcgagttcgctcaaccgcttatgcggaccatcggccactgcggaatccaacgcgtctgcaatctcctcgcgcgtggtatgcacattttctatcgtgttcgtgttctgcatttccgcaccgatgagttccatcagatacgctctgcgagcgatcggaggcaacgtgttccacagcgcttcaacccgcacttccatacctcgcacggaatccatggcgttaagcagttccctgaacgccacggcgaacatctcatgaccatcgaatacgattcccgaccgatatgtcgaatagccgttcagcctgttctcatactccttttcggccgcatcctgtggtttgagcgtggatgatgacatcgccaacgtctgccgtatgctcttgtattccataatcaccatccctgaatcgtcattctcgcaaaaacgtaagtatgaaccgttttatccggcgttgacatacctgcgaaaagctaaaaacgtaggtatagaaatgaccacatagtatatctatacctacaaaatgtcaaaaatgtaggtataggaataggtgattggtgcgactatggctgcggaatggcgtaagcgtgggcatagcgcaggcatgggatagcgattgatgtcaggttacgacgtcagtcgcgacgccggctgcggcagccgacgtcgaccacagcagccaagccgcatcaatcggacagactcaggccgcggtgtgggcgtgcatgcggccaagggcgcgctggacggtgtcgcgggtggagccggcgccgttgccgcggacgccgaagaagaccatgaccaccatgatgaagcagatggtggcgctcacgcgcagcgcccactggatgccgaacacgttcgcggccgcgtacatgctcttcgcgccaccgattgcggcccaacgcagggcggtgaacgtttccatcagaatcaccagcacgggtgcgccgatggcaccggcgatctgacggaccgtgttcgtgacggccgagccggcgctcacctcctcgggctccaggcagttcagcgaccatgtggtgatcggcataagcacgaatcccataccgatctggcgcacgaactgccagatggacacccaccagatccatgaggtcatggaaatcagactcatcatgatggtgccgaacagcagggtgatcgagccgatcagcgccaccggacgcgcgccgagacggtcgagtgccttgccgccgaagaactgcgcgatgcactggccgaacgcgccgggcagcatcaccagaccgctgatcgtggcggaatagcctcggcaatcctgaatgtagagcggcatgatcaccatgatcgagctgaaggcgaagaacgacagcgcggcggtgacggtgccgacggtgaagctcttgtttttcagcacgctcaggttgagcagcggaggttgcttggacgggtcggccgcctgcctgcgagcgccgtggatctgccgcagcacgaaccagacgatgccgaccaggccgatgagtatggcgagccacaccatcggatgcgtgaacggatacgattcgatgttcgtgaagccgaacataaggccgccgaagccgaacaccgacaggccgacggagaagaagtcggctttggcggacgcgtcgcgcgtgccgaaattacgcaagccgaaaatcgccaaaaacagtgaaatcacgccgataaccgtcagcgtgaggaagatcgatcgccaaccgttcaaatcggtttgcacaccacccaaggtggggccaatcgcgggcgcgacgctcatggccatgccgacggtgcccatcgccataccacggcgggacagaggataaatggagaataccgtgatttgcaggaccggccacatcacgccggtgccgacggcttccagcagacggccgatcaaaaccagtacgaacgatgagccgagccaggcgaacaccgagccgagcgtgaacaccgccatcgatgcaatcacgatctggcgggtggagaatcggcgggtcaggtaggcggtgagcggcaccataacgcccatgacgagctggaaaatcgacgtcagccattggccggtcgtcacggaaatgccgaaatcggacacgatggtgggcagtgcggcgctcaactgcagctgcgtgaagttgccgacgaacgtgataaaggtgagaatggcgatcgatacgaacgcagcatgcgtcagatggtcgtttttatacgattcctcgccggtaagtggctgggacaggccgtgggtgcggccctgtttcgcgtttattttcttttccggcttcacttccgacctcttctccggtttcgacggcaaccgactgctctccatcattcatccgcgtatattcgcagcgtattgcgcaactcctgcaaaaactgactcaaaaagtctagtactgcgggtggtcgaacgtgaggtgaaactattcgaacgcgttcaattccaattcaatcgagaaaaattggcaaaacttcgtatttgttcatcttggggtggtatacatatgcgttggcagtaacggcacgatacaggaaaggaatacgccgcgcagggggttaggaagtatgaccatagtcacgttattcaacatagcgatggagctatggggcgttctcatctgcatcgtttgcgcaggtggcgtctacgtgggcgcgatacgtaggacgcggcgtacctatacgaaagtttccatgcagcttctatgtgcgctgatgctgctggccgacgtgtccgcctggtatcacaacggcggctgcgacaagcttgacttctatatgacgcgcatcggcaatcttggtgaatacctgatcgatttcaccttcatcgcgctgttcgccaactatatctggcaaaccgtcagcggcgacgacatgcttgaagacgtcagcctgcacgagtgggtggccagaacgagcggcggaaccaagcgtaaccgtaagaaccaacgttcggccaacgcccaatccaaaccgaaaaagccgcgttcgaagaagcttgacgtcatctacgcagcgtccgcgctcggcatcgtactgacgattgccacgcagttcaaccatatggtctactacatcgacagccagaactactaccggcgcggaccactgttcgctatcccgcagatactgggtctggtagagctcgcgctgattgtgatgctgatcatcgaaaaccgcaaaaacctcagccgaccgctgttcgtcacgtcgctgtcgttcttcgtgctgccgattgtggcaaccatcgttcagattctccattacggactggcgttgcagaccatcgctgtcacgatttccatccagctcacgttcgtggtcgacaccatcgaaatgaacaagaagatccgctcgcaggacgatgcctatcagaaggtcagctacgaagcgcagcatgacggtctgaccgatttgtggagcaaaagcgccggccgcgaacagattgagaattatttcgcgcacatgcaggaagacgaccaggctgttctgattttcgttgacatcgacgatttcaagcagatcaacgatacgtacggccataaagtgggcgatttctggattcgtgaagtggcgcagacgttgaagcggctgtaccggcatgatgacatcatcgtccgtttcggcggcgatgagtatgtggcgctgataaagaacaccgcgaacgagcgcgtgatcgaaagcacgctggacctgttccgccgccagttggcgcaggcgtccgcgcaatacgggcaggacgtgcattgcagtatcggcgcatgccgcgtgctgtccggcaagaacgtcgatctgagcctctgcttgggattcgccgaccatgcgttgtaccagtccaagcgtgaggggaaaggcatgtacaccgtggtcgattatgacagcgggaaagtgcaggcagcgtaggtttcgtggaaaaatccgcgggaaatctgcgggaaaaaccctagaaaatcagctgagaaactacgaaaaaagcaccgcaaatccgccggagatcgacgtaaaaatcacggaaaatcaggctttgccgagcattgtcagcacaatcagcaccacgttcagagcgacgatcagcgccgcgaccgcgatattgacgacgtgcttggccgggccgtccacgtactcccccatcagcgtgcggtcgtgcgtgtaacgcatcagcggaataatcgcaaatggaatgccgaccgacaacacgacctggccgacgatcaacgcttccgtcggattgttggcgaaccacagcaccaccaacgcgggtaccagcgtcaccacacggcacgcccacatcggcgctttgatgcgtagcaggccgtgcatgatttcgctgccggcgtaagtgccgaccgacgtggagctcaggctcgacgcaagcagaccaatcgagaaaatcgtgccgatcaccgagccgagcacatgctggatggcccgttgcgcgccttcgatggtgtcggtgccggtcatgccgtacagcgagttcgcggcgaggatgagcagcgcgaggttgaccgaaccggccagtatcagcgcccaggcaacgtcgattttgctgccgtgaagtagctttttgatgctcggcttcgcttcgccgggggcgtaatggtcgttgacgagcgtggaatgcaggtagatggcgtgcggcatgaccgtggcacccagcatggacgtggccatgagcacggtgtcggtgcctttgaagcgtggaatcaagccggcgacgacttctttcggatttggcggggcgatgaacagaccggcgatgaaaccgaacgtgatcaccagcagcaggccgatgatcagtttttcgaaaatgcgatgcgtggcgcctttttcgaaaatcagcagcaccgtcgacactgcgccgatgatgcaaccgccgacgaacagcggcagaccgaacagcagtttcagtgagatcgcaccgccgatcacttccgccagatcggtggcgatggcgattacctcagcctgcatgaagaacatgaaacggcccgcgtcgccaagccgttcgcccaggatttccggcaggcttttgccggtgacgatgccgagtttcgcggactggtattggataagcacgctcatgcagttggccagtaccagcacccacaccagcaggtagccgtagcgcgcgcccgacgtgatgttcgccgccacattgcccggatccacgtatgcgaccgccgccacgaacgcggggccgaggatgccggcgagcgcggggccgtggtggtacggccgggcggatcggtcatgctgcgcagtgatcgtcatattcttcgaatccatatcgttcttcatatccacgcaacgttatagtgcgttttccgcgcagaattgttacgtctgttacggaaagctgaacagctgccgaacatgcgccgattgtggggcggacaggccgcgatcacggaagccgctaaactggtgcagagaacatcgcatttcgactcaaggggttgttccatgactgttttccacactccgatgatcacgctttccgacggcaatctgattccgcagatcggcttgggcgtgctgcgcatcgacgacgagggcgttacccccgtggtcgagagcgcgctggaagccggttatcgccatatcgatggcgctgcggggtacaataacgaggctggcgtcggacgtgcgctgcagaacgcgggcttcacgcagggtgagaatcgcaagaacctgtgggtgacgacgaagctgcgcgattcggaacaggggtacgattccgcacgcaaggcgttcgaccgtcagcttgacctgctgcagctcgattatgtggacatgtatatgctgcattggcccaccccgttcaattggcgttccggcgaaacgtggaaggcgttcgacgagttccgcgcggagggtcgcgtgcgtacgcttggcgtgtgcaatttcctgccggagcatcttgagcggctgcataaggaaacgggcgaatatccggccgtcaaccagatcgagctgcatcccacgtggcagcagcgcgaggtggtggcgtattgcaaggcgcacaatatcgcggtcgaggcgtattcgccgatggcgcgtggcgcggatctcaatgccggcgatggtgtgatcgaacgcatcgcgcgggcgcatggcgtcaccgaagcgcaggtgatcctgcgatggcatatcgaaaacggcacgatcatcattcccaagtcggtgcatgcggaccggcagcggcagaatctcgacctgttcggtttcgtgcttgacccggacgagcatgcggccatcgacgcgttggatgggccgacgcgcgccgggcacgatccgatgacgttcacgtacgcgtaagactgcttagggtgcgatgacaaggcgcggatcgcgtgacggcacgcattttcgccgacggctgttcaatgccgacgggccggtggaacgcatactgatcctgctggtgatcgccgtggtggcgggcatcaccatcggcctgctcatgccgaaagcaaacccgaccgtcggcgaaataacaggcgaatacaccgcgtcaggcaccgccgcgcaaacgctgcagcagctgacggtcgacgataatcagcggcacgccggctacgatcgcgacctgttcggcttccgccaaaccgatgacgacggcaacggatgcgacgtgcgcgaagacgtgctggcgcgcgacctcaccgacgtgcgctaccggcagcatggatgcaaagtggaatcgggcacgctggccgacccgtacaccggcaaaacaatccacttcgtacgcggcgcgcgcacctcgtcggcggtgcagatcgaccatgtggtggcgttggagaatgcctggcggtcgggcgcgagcacgtgggaccaagccaagcggtaccggttcggcaacgatatgtacaacctgctcgcggtggacgggcccgccaatcaggagaagggatccgcgtcggccgcgtactggctacccacgaacggcgcgtaccggtgcgagtacgtggcccggcagatcggcgtgaaagccaagtatgggctgagcgtcaccaccaaggaaaagcgggcgatgctgtccgtgctgcatggctgcccggcgcaaagcgtgccggagcggtgaggcgcgtggcaggtggcggagcgtaggtgcgcggtgaagcgtaggtgagtggcggagtctcccgaaatgtgtcacgattcgaaatttcggctgttttttcgaatcgtgacacatttttccttccaaaaaaacaatacgggggtataaaacgacatattcccaaggaaaatgcctcaaaaacatacccccgaaccgaaagtgatgtgtcacgatccaaaattttggtctttttttcgaatcgtgacacaaaaaacaagcctcctatatcctgtgcgcaaccaaacgcatcggaatgccgcgcgacgaacacgattatcagcggctttcaaggattccagcgccgatcgccacaaaagaggcacaacaccgaggagtcgcgatcatgcggaaagcgggcggcctcacgcgcgcacccaacgaaaccgcatcagtcaagcagcctaagcttgcgggctttccgataacgcagcaccactttgcgccatggcaagggcgtggtcaccccaatcggccgaccgacgatcgaagacaacgcatgggcgacgttcatggcgaacgcggcgcgatgcaattcgtcggacaaatccagctgcgtgaccgaaaacacagtccaaccagcggccgcaagacgcgacagcttgttctgatcgcgccgatattgcgcacggtcagtacgatgatggtcaccctgatagtccaggccaaaacgatgctcggcatcgacaagatccaacgtcaccgcagcgccattcgcaaaattcacgccggggaccacacagttcggttgcataatcggcaggccataacacacaagagtcagcctcatttcggtctccttgggggaatcgctgcctgactgcacgagcgccaacgcatccagacacttgctccggtatgggacgctctcagttttaacaaactcaatcagccccttgcgagtggcgaatcgatggcgaatcaacgactccgcaaccatgacgatgtcctggataccccaccggccggcagccaaagaccacgccggaacgggcataagcaccggaactccagcaacctcacgcacgtgtcgcgcggacaagcccttccagacatgcacggtcacatcggccgacaccgatgtgcttttcttcacacggccgcgacgagccggcgattgggcgaccgtatgaagtttcgccggggattgcgggaattgggaaggctgagaagccgactgccgaagacctggaatctgattccgagaaacagcctgggaatccgggaaatattgaaaatccgaatccgggaaatcctgccctaagcggatagagtgctcggaatggccgaaagccggactttctccactccatccatagtccacgtccgtcccagcgtaaccgccttgcgacgaacgcagcgaaacaacggagcaatcactatctgcgggcagctcgacgccccaaatcgcgagcgcggtctcgtgacttacgggatgccgcaactccacggactgggcaatgcggagaatacgccagctggcttcggacagggtcgcccgctggatcggcttgtatgcatcatcagcattcatggcgtgcaatataaacgatggcaacggtttgatgtgcgtttttccaaagttgtggtcggagaacatgcgatttggggcagttcagcatggcatggccgtaattccaacgatttggagcgcaacagcctgtggataaccaatggagatggttccagctaccaccgcagcctttacaagggacgcggcctggcacttccggaagtgcggcaaaccggtatttcttttcgcttggggaatcggggatggatcagcctcagcccagccttcaaggcaattcggaccaattcatcacgaaccagcacaaactagtctcaagcgagccttgaaccagctttggagcggaatcttccgctataaatgtgtcacgattcgaaatttcggctgttttttcgaatcgtgacacatttttccttccccaaaaacaatacgggggtataaatcggcgcatttccaaggaaaatgcctcaaaaaacatacccccgaaccgaaagcgatgtgtcacgatccaaaattttggccattttttcgaatcgtgacacaaaacaagcgacacgggcagtaccggaagagtaggtccaaggcctgctctggaaagggcggagctggcgcacagatagcgtgggcagtgccggaagagcggaatcaaggcctgcgacggaagcgaggagggcactcaggggaggagaaggcatgcggaaagcgggagcactaggcggcgcgaaaccaaacacgcgacactaggcacgggtggtggcgcgggctatgatgcgggattgggtggtgatgagctccggttccaacgtacggctgccatcgatgcggttgatgatgcggctgaccgcggtcggcgcgatccagtcgaggcaggaatccatggtggtcagcggcggctggaaatatgcggcttcctcgttgttgtcgaagccgatcacctgcacccggtcgggcaccgcgatgccgttcgctgccaaagtgaacagtgcgcccaacgcaagctggtcgttgaacgccacgatgccatcgaaggggatgccagagtcgacgatgcgctgcgtcatgcgcgcgcccgagccgatggtccaatcctggccgacgttgggcactagccgtgtgtccaattcgacgccttggtcggcacacgcttcgaatatgcctcgcatgcgcagctgcgcgttgccttccacggcgtcgcgcagctcgaggatatgctccggatcggttcgcgagccgatcaccgcaagattcgtggcaccgtggtcgaacaggtattgcgcggcgagacgcgcctcctggacgtcgtccggggtgacatggtccgccttgccatgcgtggaccgcgcgcccacgcagaccagcggataatccacgtccaggtcctcgggatcgagatcctcgacttcggagatggacaggatcatgccgtccgacaccgtggcattgaagtttcgcaacagcgcgcgggcaccctgcgcggatccttccgcatacgtggtgatgtacacggaatagccgtagatgcgggccgcgtcgatcacccggttggccagttcggccaaatatggcgcggtcaggctcggcaccgcgagcgtgatgaagccggttttgccgcgattgagattgcgggccgacacgttgacgcggtagccgagcctgtcgatgacgtcctgcactttttcgcgtgtggcgtcggccatgcggccggaatggttgatgacgttcgacgcggttttgagggagactccggcctcttgcgccacttcacgcagtgtgacgcgtttcctgtcagacttgtccggcttcacttcggccatatctccccctaaccgcatccgtcatcgatattcgacttccgactttaccgccttaccacgagcacgccgttgcggcgcacggtgtacgagccgggcttttcctcccgatccgtctggaacaggatgaccggctcgccttcgatgccttgcaattcgaccgtcttcttgccacggggcaggtagaagtcgaaggtggcgtcggcggaggcgcgcacggtgtgcagcacgtcggcattctcctgcgacgaggccgcgagatatgcgcggaccagcttcgtcagatcggccacatccaggtcgcagccgacgaaatacgcttcgccggagccgtacggattacgggtgaccgcggccgtgccgtcgagctcccattcgtccgcttcctcgccggcgtacgtggcaagcacctgcgcgtgttcgccggtcacgttcacgtcgttctgccacaggcgggtcgtggtgccgtccagcgcggccgaatcgtcggcggacgacagtcggatctcgcccggctcgccttcggcttcggcgccgaggatgttgaattcctcgccgcggacgcccagcatcgagcgcaacaggccatcgcccgcgcccgggtatccgccgagccaagtgtggaaatgctcgtcgatcagtccggtcgcgtagccgaccaccacgcggccgccggcggccgcgaagtcggccaaccgctgcgtgtcggcggcgctcaggatcagcacggtcggcagcacgacggtcttgtacgagctccagtcgtaggcgagcggcacgatgtcggcgcgcgagcccgcgtccaggaacgcgcggtaccagtcacgcacgtcatgccagtggttgagtttcatgctcggcagggtctgggagcgggtggcccattccgattcggcgctgaagaggatcgccgtgtcggagtgcgccaattcggtgccctgcacgccggcgtcggcgagcgtgtgcaacgacgcgcccagctcgcacacctggcggaacagcttcgtgtcctcgccggcgtgcggaaccatggccgaatggaacgcttcggcaccgaacgcggacgcgcgccactggaagaagttgatggcgtcggcgcccatggccacatgggccagggagtcacgcacggtctcgcccttgcgcttgcgggtgttaagcggcttccactgcaccgccgaggtggagtgttccatgacataccacggcttgccgagcgcgagcgaatccatgagagcgtcggagcaggccagctcgtcgaggtgggattcgccctcgtggaagtagtggtcgttggatacgaagttcacttccttggcccaggcggcgtagtccatgcagcactggtcggtggagaccatgaagttcgtggtgaacggcttgtcggggcagatttcggcgatcgcgtcgcgttcggctttgtagaagtcgaggagcatgtcgttgccgaaccgttcgaagtcgagcttctggccggggttgaccatcgagtcggcgcccatgaaccgtgggatgagcacttcgtcgaagccgttcatctcctggccccagaaggtggtgccccacgcctgattgagcgcgtcgatggtgccgtacttgcggcggcaccatgcgcggaaggcctcgagcgcgttgtcggagtagtcctcgcggttgttccacccgtattcgttgcccatgtgccatgcggtcacatacgggttggtgccgtaccgttcggcgagcttgcggcacagggtcagcgcgtattccttgaacaccgggctggtcgggctccaggattggcgcgagccggcgttgaccggatggccgtacttgtcacgcggaaggacctccgggtggctttcgtacagccacagcggcgcggtcgccgtcgcggaggccaggtcgaccacgatgccggcattgccgagtttgtcgatgatgcggtcgagccagccgaaatcccaacgatcctcggtgggttggatgcgatcccagctgaagatggcgagggccacggtgttgacgccggcctgcttcatcaggcggatgtcgtcgtcccagatgtcctcggaccattggtcgggattgtagtcgccaccgaaggcgatgccgcggccatccgcggtcagcagttccggccattcgaagttgcgtcgcgcactcacgattatctcctttggtaattggcataaagccatggttttttgtatattacattcgttattcgcccaccggcatgtggtacaccggtgtagcatacacgtcggtgacgtcagcgacgcacgcatcggactgctccaggcgggccgccatcgacgatgttaccttcacgcggaccccgcgcctcagcggcgtgacgaccagcgtcagctttccaccagcggcatcgatggcatccgcgtaatcgcgcaatccgacctgccatgtctcgccgttgcagaaattatcggcgatcagcacatcgccgcagaacagccagccgatatcgccctggtatgcgatgttcagcatgacatcggcgacctgccgttgatcgcggaaaagccgtcccatgccagccggcaaagcgatttcgtaccgatcggcgtgcagtcttctcatacgcgcatacaccgatacgggctccaccggccgcggagagccgagcaagccttccggatatgcggcgatcccgttttcggcgcggggcgattccagcgtccacccatcgccgtcctcgtacagcaacgcgttgtcgtcgtcgacgaaggcgaggcctccatccaacaccgtcatccgcccggcgagcgctcgtgtgacgcatacgatctccgccgcgtcccggaccatgaagcgttcgaaatccgccttgccgacggtgacgtcctggatgtcgccttcgaaatggaacgtcagctcatccatgccatcgggcttgaggaacacgaacgtgcggaacggtcggcccggcacccgcagcacggtgaccggctgcaggttggcgcggacgagccgcacgccgtccagatccatgttgaacggcaatatgcagttctccccctcggcgaggccgatgccggtgaaccgtatgcgctcaccggtacccgtcgtcacgtcgatttgctcaccgtgacggctcggcacgcgcgcatggtcctggaagttgtcgatggacacgaaaccccgttcgccatcgctgcgcacggcataccggagggtctcggagtcggacggatcgatgcggtcctgcccgtcctgcaacgagaccggcattccggcgagttccggcccgaaggctttgacgaactcgtgcagggtgcgcagccgccggtaggattcccgcacctgtccgaatttgccaaggggcgcttggaaatcataggagcgtttcggggtctgcccctcattgaggaatccggccgcgcccttcgggttggttccgccatggaacatgtagtagccgaggaaatcgcaccccgagccgagcttgatgttggccatcgcgtcgacggagcgcttcggcagcacgaaacggtaatcgtacgaattgaacatcccgccgcccatctcgcagcaggcgtacgggcggctgtccggatcgtacgggggatcgaagccgtcgcttgtgctggagccatgcagcctccggtatcggtactcgtcggtggcgggatgctccgtcatcccctcggcaccgacgccgtcgtagaacagccacggccggtacgcgtatccaccccacagcggcagcatgtcgtccggaaccggtgactgccagccggtgcaggtgaacatcggcgggtcgatgccttcctcgatcgcgatgtcgcgcagccgttccaggtagccggccccatcgtggccggacggcacccattcacggctgatgccggtggtcatctcccaaggagccgacgacgccatgtactcgttgtcgacctgggccgcgatgatcggcccgccatccttgaaatacaggccgcgcagctgctgcgcgatatgcgcgcagagaccgcgcaccgcatcgaggaagccggcgtcgagggaacggacctcatacgacttgccgtacagccagtcgggaagtccgccgttgcgcacctcgccatggcagaacggtcccagccgcacgatgacgtgcagtccgtgccgggcgcacaattccacgaatcggcgcacgttcctgttgccggagaaatcccactccccctcgcgctcctcatggtggttccagaacacgtaggtggatacgacgtcgatgcccgccgcggccatcttcgcgagttccgtgtcccaccgttcggcggcgatccgcgaatagtgcatctcgccggcgatggggatccatggcgatccgtcacgggtcaggaagcggttcgtggcgcccagggtcccgccatccggcccgcatgcggctgcggcgcggatgacggggatcccgtatgcgggcgtccgcgcgaacttgctggcttccgaaagatcaacctcatagcgcataacgctgctccttgtcgaattcccgcaagcaggaggaccggtcagcccttgaccgaaccggcgaccaggccggccacgatccaacgctggcagaagatgaagaacacgaacaccgggatgagcgcgatggtggtgaccgtcatgaacaacggccagttcgtcgtgaaggtgctgatcgcgttgaacacctgcagcacgatggtctgtttgttggtcgacgagatgtacacgctcggcgtcatgaagtcgttccacgtgcccatggtctggaacacgatgacggtggtcaggatcgggcggatcagcggcagcacgatcgtccagaagatgcggaacggaccggcgccgtcgatacgggcggcctcgatgatctcatacggcaggccgcgcatgtactgcacgatcaagaagtagcagaaggtcgcgccgcccgtgtaaagcacgatcaggccgagcagcgaatcgacgagacccacctgtgcctccatgcggtactgcggaatcagcagcgtctggccggggatgatgaaggacagcatgagcagcacgccgatcacggcggtgaacttgctcttcttcaggatcatgccgtatgcggcgagcgcgccgaacagcacctgcaggccgacgccgaccaccgtcacgatgatggtgttcttgaaggcgttgacaatgggcagatgcccgaatgcatacgtgtagttctcgaaattccatgtctttggtaacccaatcgggtccatggacatctcggcgctgcttttgaacgtgttgatgacgatgacgtacagcggcaccgcgcagatcagcgcgatagcgatgacgacgacggaacggatgatcgagccgatacgctcgcgttgctgcagagtcatgacagcctcttttctaccagattggtgattacctgctgcagggcgaccaacagcgcgcagcagatgaagaagatgacgcccagtgcggagcccagtccgtaccggctcgaaccgatgcccgtgaggatgatggactgggtcacggtgtaggtggagtagcccggaccgccgctggtgaggccatacggcagatcatagaccttcaaaccaccggtaagcagcatgaagatgctcacacccatggccggaaccatctggggcagtgtgatgttgaagaactgctggcgacggtttgcgccatcgacggcggcctgttcgtagatatcggcggggatagcctgcagatacgccagatacagcgtggcgtgccagccgatctgagcccataccgctacgaaaatcacacagaatttggcaagttcggaattcgacaaccacggaatcgcatcgatgccgatcttggcgagcagcgtgttgacgacgccggacttcagcggggagaagatgtactgccagaccaagccgagcacggccatggacggcaccgagaagaagaagaacagggaacgggcgaagttacggccgaagaacttgcggttgagcaccacagccagcggcagggcgatcacggtgatgagcacggtggtggccaccgtgtacagcagcgtgaagccgaggcccgcgagcagcgtcggatccttgaagcactgcacgtagttcgcgaaccccacgaacttcgcgtccgcgaaattgtaaccggagtaatcggtgaagctgaacaccaggctttgcaggaatgggatgaggatcaccacgatgaacaccaccatgatcggcagcaggaagcgtgccgaggcgaagttctccatgaagttgcggtgacgacgctgcttgagatgcaacgcctctacctgatcagcggaatgtggacgcgccgctgacgctgttgatactgacatgttggttgctttctacaaaacgtgagattggcaggtccaggcgtggcgcggacggaagggtccgcgccagcctgccgcgatggatgtctgttcgcgatggatcaggagagggtcttgagcttggaatcgaggttctccgcggcctgcgtagggctgatggagccgagggctacctgctgcagctgggtgaaggtctcggcgcgcagcgcggtggtgcccttgctccagtgggcggaattcaggtacacgttgccggtcttgatgtacaggtcgtaggcgtccttgaagtggtcgtccaccgtggcgttgaagcccttgacggacgggatcaggcccagctgcttctggtacagcttgaggccctcgtcggaggtcaggaaggtgaagaacttctccgcggccttgagcttgtctccggagatcttgttgttgatgccgaaggccggatcgatggagcccggcgcgtacggggtgtcacccttcttcagcatagggatctggccgaaaccgtagttgaggccggtctcattgaagctgtcgatgtcccacgagccggaaggatagaccgcaagacgtccggcggtgaattccgacttgacctggtcgccgctcaggccggacacgtcggagctcatcaggttctgcttgatcagcttgtcccattcgccgtagtacttgccatacacgttcttgaacgtgtccttaccggcgtcgatcttggcgtcgagcgcctcgccctgcttggcggattcagcgccgatccagccctcgacggcgttgcccagtccatccttcggctcaaggtatggggtgattcccgcggctttgagtttgccgcacatggtcaggaattcatcccacgtcgccgggatggagtcgtaaccgaccttcttcagcagatccttgttgtacacccaggcattggtccaggtgctcacgcccatggcgtatactttgccatccacgctataggccttttttgcggcatcgccgattttatccatgaagctttcattgctcaggtccttggcgtagttgcctttgaccagatcgctcaacgcctccggaggaacgatgtagacgtcggccaggtttccgccggagattcgagtctgcagcgtctgctggtagccactctgggaaccggtggtggtgctgtagtcgatcttgatgtccgaattggccttttcgaacgcgtcgatgatcggctggtacttgtcctgcgaattgttcgagaagaacgacagcgtggtcttgccgtcggcggcgtttcctccaccgcacgcggccagcggaacaagcatcgccgcagcggccaccgccgcaatcatcctgatggatttcttctccatgatgtactcctccttgtgtcccatcgttggcacccgctttacgtgcgttcattcgtcgaacccactccagctgcggtagatacacgtcaatatgtcttcaactgaccattcagttgattcgggatatttccttccctttttggtataactgtgtacctgttgaaacagtataggttttccggtgtaccatgtcaattcaaacaaggaaatttgcatcccatcgaccgctacccctacaaaacatcggcgtgtcgtataccggcagcaccgtcgacagcggacgacgacccgcccgcaccatccggagacgcgcagcccgaaagcgtattgcgagtgggcaggacgcatgtggacaagtcggtgtattacgggggattatttttccgatgaattccccagtattagttgggattgaaaagatgctgaaagtccacagataaaaaatcggcggctccaaggaaatatccttggaagccgccgatatgcttgcgtgcgtcgcgctacgggctcaagcgagtacacagcgtgctacgcagaccgtgagcaacacagaccgcgcgctacacagaatcgcaagctacaaactcaggaacagctcgtggatgcgggtgtcgtcggtgagctcgggatggaacgccgtggcgaggatcttgccttggcgcaagccgaccacattgccgtccaccgacgtttcgacggtggcggccggtccgacttcggccacgaacggcccgcggatgaacaccagcgggaaatctttgagcacgatgtcggccggggcgtcctgcggaacatgctcgcccggtgcgaccacgacggcggaatcaccggaagaggagccgaaatcggcggtggcggcgaacgagccaagctggcggccgtatgcgttgcgccgcacgacggcgtcaagcgcgccgaagtagacgttgtcgtcgttatcgagcttgcgggccagcagaatcatgccggcgcaggtaccgaacaccggtttgccggcggcgatatgctctgcaatcggctcgaacaggccggtggagcgcagcagcttgccctgcgtggtgctctcgccgccgggcagaatcacccggtcgatcgaatcgtcgaaatcctcggccgcgcgcagcagcttccacggcgcgccgaggtgatccagcatggcggcgtgctcggcgaacgcgccctgcacggcgaggatgccggtcacgccatgtttcgcggcttcgacgccggccgattcttccttcgaaatgtattcaactgctacaaccattaccgttcctgtgctttcggatatgccggctccgcggtgcttctcgctgcccgcggagccggcgtcacgcatgcgccgtgcgggccgtcactcgccgcgggcggccatgatggtttcgatctcatcttcgttgatgccgaccatggcctcaccgagattctcggaaagacgtgcaagcagctcggcgtcctgccaattggcggtagcctgcacgatggcggcggcacgcttagccgggtctccggacttgaagatgccggaaccgacgaacacgccttcggcacccagctccatcatgagcgcggcatcggccggagtggccacgccaccggctgcgaagttgacgaccggcagacggccattgtcgtgcacgtacttggcgagatcgtacggcacggccagctgcttggcggcctcgtacacctcgtcgtcgcgcagggagacgagttcgcggatctgcttgttcatggtgcgcatgtgacgcacggcctggatgacgtcgccggtgcccggctcgcccttggtgcggatcatggacgcgccctcggcgacacggcgcagcgcttcgcccaggttcttcgcgccgcacacgaacggcacgtcgaaccggttcttgtcgatgtggtacacgtcgtcggcggggctgagtacttcggattcgtcgatgtaatcgatttcgatggcctgcagaatgcgggcttcggcgatgtggccgatacgaaccttggccatgaccggaatagacacggcttcctgaatgcccttgatcatggccggatcgctcatgcgggaaactccgccggcagcacgaatatcggccggaatgcgttcgagcgccatcaccgcgcatgcgcccgcgtcctgtgcgatcttcgcctgctccggagtggtgacgtccatgattacgccacccttgagcatctgtgccagattcttgttcagttcgttcctgttgttggccatcgccagcctttcgtcgaaaataatcgtttgctatcgatactaacgatttcccatttcgatttcacgcgaactgaatcttataacctaccaaaaagtcggttttgctaaatttgcaaccttattttcatgattgtttcattggcttatgatttcgattccgtcgacatttcatcggtttcgtccgtttttcttgctttacctgcgaccatggctttcgattcgtccgcttccgtacgccgtcgcgcgcgctataggaaacacgaatgacatgcgattttcatacgaccacattgcggacgtgcgacgcgtccgtatgcggccgcatgggcatgggcacctcaccaggccccgcattacgccgattcacacactagttcgcacgcatcggctcgccgcatcagttcgcaatccgcacgcgccagctcacatgcgcacgatgcggtccgcgatgcgcatggtggaatcgcggtgcgagacgagcagcaccgcgctcccctgctgcgccaacgcgtcaatcgattgcagaatcacggattcgttgtaggcgtcgaggcgactcgtcggctcgtcgaacaacaccagcgacgcgttgcgcaggaagacgcgagccaggccgatgcgttgccgttcaccctctgaaagccgcccgcccaactcgccgacgggggtatcaaggccctgcgggagcgagtcgaccagttcaagcgcggaagccttggcaagcgcggcgcgcagcacgtcatcaccgacagaaggggtcgaccgggtggaaagcgcggaatcagcggcattccacgaaacgggaggagcgggcggggtaaggagcgctctgccggaagttgcggaatcgtccgaatcgccagcattaccagccctatccgcatcgcccctgtcgcaggccataagcaggttttcacggatagtgccgtcgaacaggtaggtttcctgccccatcatcgtttgcacgcgacggcgatgatgcgcgtcgatctgcggcagtggcacctcggacagggcgactaagccggattgcgggtcccagtaacgcatgagcagcttcagcagggtcgatttgccgcggccggacgggccttggatgccgaggatgccgtgttgtggtatgtcgaacgagacgtggctgaggattggctcggcggacgactcgggggcatccgcatcgcttccggaagttggagcctcgcccgaattgccgtagccgaacgtgacgtcgtgcatggacatgccgtggtagcgcggcaggaaatcgccccgctcctccactgcgggggtttcgtccatcagcgcgaacaggcggcgggcggctgcaaacgtttgcgtgagattggccggcagcgcgctcaacgcgagcgtcggaccgaacgagctggccagcagcacgaaagcggcggtcaggcgggcggcgggcgcggaaaggacggtctgaatggttgcggcggcagcggaagcggcggaagcgatgggcatcgtcgtaccggacgtgaccatcgccagcaatgccgcgatggcagtgaacagtacgaccagcaccgcgccgaagcctgcgaaatcgccattcttggcactcagccgggcacggcggctccagagcgagcgcgtgcgtgacgcgatgccggcaagccgcgcatggccttggccgaatcggatgatttcgtcgagaccgcgcatatcgtcgagcatttcgtcatcaagttgggcggattcgcggcgaatatccccaccgagaccgcctaccgccgtggcgaagagtttcggcagcacgatgccgacggtcaggtgcgcgatgaccagcgtgacagcgatcgcagggctcaacgtaagcaatgcgaccgtgtaaagcacggtggtcgcgatggcgatgacaaccggcgaaatggtgtgcgcaaagaagatttccagcagttcgacgtcggtggtgaccagcgcgatcaggtcgcctttgcctttgccggacagtttggcgggcgcgaggcgacgcagcgcggcaaacgttttcgaccgaaacagcgcgagcaggcggaaggcgacattgtggttcatgtactgttcggcgtagcgcatgccgccgcggatcagtgcgcagataatcatggctgcgattgccgcgggaaggctgagattccagacttttgcgccagctgcggcaaacagcgcggcgacgccgaaaaccggcaggaacgtggcggcgaggtggccgaggatgccgcacgcgcaggcgatggccatgggtttgcgcagtgggccgacttcgcgcagcaagcgggcgacgacttgggttgttggcatgtccgatttgacgccactggcgttcgattcggcggaaccagacatccgagacacggcaaacgcaccagacgcatgagtcatacgcgatacgcgcggcgcgacgcgaccagacaatcccacccgttccacgctttcctgcgcccggaacagcttggcatacgtgccgtccgcggccatgagatcgtcatgcgcgccctgctcgacgacgacacccccatcaaacactacgacatggtccgcgtcggccgcgttcgccatgcggtgcgtggccatcagcacggttgcgccggcgtcggcgagcgcgcgaatcgtttgcaaaatcaacgtttcgctgtccgcgtcgacgctgctggtcgcctcgtcgaaaatatagacggccgacctgcgcaacagtacacgggcgatcgcaatgcgctgtttctgcccgccggacagattcgcgccgtcctgcgtgatcggcatatcgagtcctcgcgattgcgcgcgcacgaaatcgtcgatatgcgcggcttccagcgtctgccacagctcgttgtcggtggcgtcggcgcgggccatgagcaggttgtcgcgcagggtgccggcgaacaggtggctgtgcgcggagacgatggagatttcgcgggtgagcgatgctgcggtgaggtcgcggatttggtgcgatttcagggtttcactgtcatccggcgccgcactgcttaacatagcgcccagcacttcgtcctgcattccggatggcatttcggacagcagcacatcgccttcatatccgacaagcgtgccggcaagcagctggacggctgtggatttcccggaaccggatggcccgacgatcgcagtgacttcgccgggcagcgcacagagggccacgttgcgcaaggcgtagcgcgtttcgcgcgcgtcacccgcgccgccgccctcatcaacgctgtccgcatccgcgttccgcatatcggaatgcgatgtggacgatatacgacggggactcgcaacaccggcacccgcagacccggcagcgtcaggccccgcaccagcagcacccccagcatccacatccgcgtccgcataccggtacgaaacaccacgaaactccacgccgacaccacgcccggaagccccgaattccggcagttccttgctgccatgctccggttcgggcacgtcgagcagcgcgaaaatacgtttcgtggacgtcatgccgttcatcgcaacgtggaaatacgagccgagctgtcgcagcggaatgaagaaatcggcggctagcagaatcgtcagcaataccgcggcgatcggcgtcaaaccaagcggcagcacgccggacagcgcgaaaacgccagacggcgagagcgagccggatacaaatcgccatatcgcaacgccgatgccggcggccgcgccaccgtacgccacggcatccatcgccgtgagcgaacgcagttggatctgcagcacgttcatggtcatcacgcggaactgttcggccttctcgtccatgactcgtgcggcgcgctcgtccgcgtcgaaggttttcagcgtctcaagtccctgcagattgtcgaggaacgcggcgcccatatccgtgtatttgccccagtatttcttgaatacgcgggcagcacgcatcgccaccatgccgacgatgagcacgatgagcggcgcgcaggcgagcagcgtcgcggcggtgggcaggtcgatcggcgcaagcacggcgaacagcgtgatgggggcaagcacggcgtagcacagttgcggcaggaacagttcgaagaagctttggatttgttcaatgccttcgcccgcggactgcaccacgccggcggtgcgcacgcgctgcgcgtaggacgggccgagcgcgagcatcttattgaacagtttctcacgcagcgcgagtttgacgcgttcggcggcctcgctaccgaaacgtgcggcggcgcgaatggtgacgaatcgcacgaccgcggcaataagaataatggcgatgcagggcgcggtggcggacggtacgggcgcgaacagcggttgcagcatacgcaccacagccacgacgaaggcgatgttggccacgaggcccagccattggcaggcgactttcgccgcgatcaatcgaccgacgccgtcagccaaggaaaacagccgcttgtcgaacatcatgccccttttccaatcgtttgcaatcccgccatccgctccaagcgtatcgggcataccgacgaaaggcaatgacggaacggcaatcgcagaaaatcgtcggaaaaatctagaaaaccatcagaactcgcaagcaaatgcacaacagcaaaaccacagaaaaccaagggaacggcgaaaagtgaggcggctgaatgttcgccgttgagcaaacagcctaggcgcaaggggtagttgcgccaaacttgagtgtacacggaacatgttgtggttcgcaacgtcactccgcccagttttgccgcattttccaccgttttcgcccgtaagggcaaccccctctcgaacccgtcgcgcaacccgttggacaccctgcgatcgaacgcgtcaaacctttttttcgagatgacgcatccgtgcaccaatcccccgttccattgacgtttcgtgccactttgtcagttcaaacaaacccgtcgccatatttcttgttgtttcttacaatgcggacttacgtcaccgtaacttacgatatgcgaggcgcgacacaggacgcgaaaagcacgtcatcgatcaccgcaatcgcagcgatcgcatatatcgcaaaacccacgaaaaccgcggaaacgcaagaaaagagaacacttcatgctcaccgagtacacgaccccgggcgcatccgtcgaagtacgcgacgacgaatccatctactccctgcttaccgaacgcatcaagcgcaccggcgaagacaccgtgatcgcggaacgcaaaaccgctccgggccagtggaccaaggtgacgaccggcgaattccacaagaacgtgctctccgcggccaaaggcctgatcgcgttcggcatcggcaagggggatgccgtcaccctcttctccaccacccgttacgagtggggcgtgcttgatttcgcactggccgcaatcggcgcggtcaatgtgccgatctatgacaccgattccgcggctcaggccgaacgcattctcaacgattccaacgtgaagctcgccatcgccgacgatcgcgaacgcttcgaccgtcttgattccgtgattggccgctgcccgtctctgaagcatattctgatgctcgacgccaatgccatgggcgcgctggagggattgggcgtcaccgtgtccgacgaagagctggacgagcgtatcgcgtcggtgcgtgccgacgatctggccaccatcgtgtacacgtccggttccacgggggcaccgaagggtgccgagctgtcgcatcgcaatttcgtgtcgatcacgcgtgccggcagccttgcgctgcacgagatgattcttgaagaccatccgcgtctgctgctgttcctgccgctcgcccactgcttcgcgcgcttcatccagtacgcgtcgatcgcttccgatgacggcgtggtcggctatctgccggacaccaagacgctgctgccggatgtgcgttcgttcgagccgacgtacctgctgggcgtgccgcgcgtgttcgagaaggtgtacaacgcggcttcccgcaaggccggcatgggttggaagggccgcctgttcctcaaggccgccgagtccgcgcgcgactggtcgcgcatgcagcaggctggcgagaaaccgaccatgaagcagaccgccgaacacctgtcgtatgaggcgtccgtataccacaccgtgcgtggcgcgttgggcccgcgtatccgttatgtggcgtgcggtggcgctccgctggacgcgtcgctggcgcatttcttcaatggcatcggcctgccgatgatccagggctacggtatgacggaaaccgcggcgccgtttgccgcgacccgcgtcacggacaatgtgatcggtaccgtcggccagcctgcgccgggatcgtccgtgcgtatttccgacgatggcgagctgcaggtcaagggaccgaacgtgttcatgggttaccacaatctgccggagaaaacggccgaggtgttcaccgaggacggttggctgcgcaccggcgatcttgcgtcgatcgacgatgagggtcgtattacgattacgggccgcaagaaggacatcatcatcaccgccggcggcaagaacgtgtcgccgattccgatggagcaggagattgcgaagtgtccgattgtggagcatgccgtggtggtgggcgataatcgtccgttcatcggcgcgctggtcacgcttgatccggaaggattggcggcctggctgccgtccgtgggcctgtccgcggatacgccgcttgaccgcgtggcggctaccgccgccgttcatgacgagattcagaagtatgtggacaaggcgaacgcgacggtttcgcgcgccgaatccgtgcgtaagttcgtggtgctggatgcgcagttcacacaggagaacaagtgcctgacgccgtcgctgaaggtggtgcgtccggcagtgaaccgcgtgttcgccgacgtgatcgaccgccagctgtacgccggcaagcgctgagccgcacataggtaaacaaaaacagcacggcggggaacgctgcgtacaaaagtacgtcaacttccccgccgtgctgttttttaagcgcaccccgtatcgctgagataacgcgtgcggtaacagtgcggcaggaaacgccggcgtacgaaggtacgtcaagtttcctgccgtgctgttaacgctccgttatttcagtgacggttgttgaggcggtggtacatttcgctcagctccagctccttctcgaactggcgggcgttggtgttctcgtcgatgacggcgagttcgacgccggcgatgcgggcgaagtcctcccaagcctcacgaccgacggacgtggtcatgcaggtgtggtgggagccaccggcggtgatccagcactgcacggcggtcttcaggtccggcttcggcttccacacggcgcgggcgcacggcaggttcttcagggagccctgcggttcgacgatggtgacctcgtccatgagcaggcggaagcgttcgcgctcgtcggccatggagaccacgacggcgtcggccggcttgccggagaacaccagacggaccgggtcggacttgccgccgatgcccagcgggtagatggccagcttcggcttggcgatggtgccgatggacggggagacttccagcatgtgggagcccatgtcgaactcgttgcccggcacgaagttgtaggagtagtcctccatcagggaggcgccaccctcaaggccgtagcccatcacggcgccgatgcgcaccagcacggaggtcttccaatcgccttcggcggagaagccccagccgtactcggacgggaagcgctgcgggccgacgcccggcagctgcggcagggtgccgaggtcttcgaagttgtcgacgccggcggtgcaaccgttctcacgcatcatgttgaccatggcggcctcttccttggctgcgatgaacagctcatcgtagcgggaatcaagcagctcgggggccacgtcatacttggccttgtagtcttcgatgaggtccttgacctggctgtccttgaccttctcgtaggcggcgacgaggtcgttgacggcccaggtgttgatcgaagcgccgaacacgcgctcggcttcggtcttgtcgccttcggtgacggccacgttgcgcatgttgtcgccccaacgcatgaccttcatgttctgggaggcatcccagccggcgcaggcgcgagcccaggtgccgaccttttcggcgacttccggatcggtgtagtggccgacgacgatcttgcgcggaatgccgagacgggacacgatgtagccgaactcacggtcgccgtgggcggcctggttcaggttcatgaagtccatgtcgatggtctcccacgggatttccttgtggtgctgggtggccagctgcagcagcggcttggtcagcacttcgaggccgcggatccacatcttggccggggagaaggtgtggcaccaggtgatcacgccgatgacgttcgggttggcggaggcttcggtcatgaaggccttgacgccgtcggaggacttcagggtcggcttgagcacgatcttggccgggatcttgccggtcgcgttgaggaagtcgaccatctcgccggtctgctgggccacctggcgcagcgcctcctcgccgtagaggtcctgcgatccgacgccgaaccagatttccttgccttcaaatgggttttccattgccatgttggattattccttacttcgttgttgggtttgtcgtttcagtttccgtcgcgtcagtgctggccgtagacgttggtgtagcggtcgttaaggctatcgatgtcttcctgggagatcgggatgatgtctccgagctgcttggcggcccacatggtgtgcgccacctcttcggtcatggcggcagccttgacggcggcttccgcgtccttgccgatggtgaacggaccatggttctgcatgagcacggccggggacttcggatacttcttcagggtttcgaccacgccttcgccgatggcttcggagccgatgaggcggaacgggccgaccggcaccgggccgccgaactcgtcgcccatcatggtcaggccgcacggaatgttctggccggtggccgcccatgcggtggcgtaggtggagtgggtatgcaccacgccgtacacgtcgggcatgtggcggtagatgtacgcgtgggacgcggtgtcggagctcggcgcttcggcgccgtcgaccacgttgccgtcgaggtcgcacacgaccatcgagcttggggtgaggtactcgtagcgcagtccggacggcttgatgaccatcaggtcggcggtgtgcaggcgctgcgagacgttgcctgcggtccacaccaccagattccacttgatgagctgctcgtgcagggtggcgaccacttcgcgcacctgcttgacttcagctcgtacttccgggccgtaatcagccaacgttgccatattgtgttcctttcgtcaggcttgctgttgttacgatggacggttatttggtttccagcgggatgctttcgatggcggcatgctcgatcggcagccccttgcggaagcggtcgaagaaggcttcgaagccggccacgtcgttggcgtccggcgcttccgtggtggaggccgcgtcggcgaagacgcgggtgtcgaggtagtcggcgagcggctggtcggcgtgccacagatagtcggcgagcacggccatgccccacgctccgccttcggcggcggtggccatgaccttgatcggggtgtcgaatgcggcggcgaggatcttctgcgcgaccttcggcgtggtgaagatgccaccgtggccgacgagcgagtcgacggcgacgccttcgtccttggtcatcacatccatgccgatcttgaccggcgagaaggcgctgaacagctgggttctcatgaagttgccgaggctcatgcgcgcctccgggctgcgggcgaacagcggtcggccttccggcaggccagccaggaattcgccggagcggaacggatagttgagcagaccaccgcagtcggcgtcgacatcgtccgcgatcgcggcgcggaacagcgtgccgtacagcgtgccggcatcgaccggctggccgatcgcggcggcgaactgtccgaacaggccgacccaggcgttgagatcggaagtgaagttgttggcgtggctcatgccggccaggtcgccggctggggtggtgacgaggtcgacttccggatgcaggcgcgccagcttgtgctcgagcacgaccatggcgaaaatcgaagtgccggcggagacgttgccggtgcgcacgcgcacggagttggtggcgaccatgccggtgcccgcgtcgccttccggcggggcgaggacgacgcccggctgaagggtgccggtcgggtcgagcagtttggcgccttcggcggtgagcgtgccggccggggtgcccgccacgagcggacggggcagcaggttctcaagcttccacggctgcgcggcgacttcctcgatcgcgtcgaatcgcttgatgaactcggtttcgtaggtatgggtggccgggtcgatggggaacatgccggaggcgtcgcccacgccgagcaccttctcgccggtgagcttccagtgcacgtagccggcgagtgtggtgatgtagtccaccttggagacgtgctcctcgtggttgagcactgcctggtagaggtgtgccacggaccagcgttccggaatgttgtactggaacagctcggaaagcttctcgtgggcttcgtgggtgttggtgttctgccaggtgcggaacggcacgagcagttcgccggacttgtcgaaggcgaggtagccgtgcatcatggcggagaagccgatgtgccccacgtgggtcaaccgttcgccataggcggtttcgacgtcgccggccatgcgggcgtatgcggtctgcaaacccttccagatttcctcctgggtgtagctccacagcccgtcctcgagatggctggcccactcatagtcgcccgccgcgatggtgtggtaggcgtcatcgatgagcaccgccttgatgcgggtggagccgaactcgatgcccaggctcgtcttgcctgcgcggatcttctcggcggtcactgcgacctgctcttgcgtcatagttcacgaactccttgcgtccgagcgcctcgcaaccactctgtcaactgaatgttagcgctcactgttaacgctcactattgtaggcaaaaacccgtgacgcaccaaatccgacgtgtcatcggagcaatgaatatataaacaaatcgagaagaagcagcgccttagcgacggcggacaggacccagggagctgcggttgaccatctgcgccgacaccagtccgacgccatgctgcgatgatccgaaggagttctcctcccccgcgcctagcaggtacagcgtctcgcgcatggcggcgacacccagctgctcaaagccggggcggaccgtggtcagcggcgggaacatattgtccatggcaggcatgtcgtcgaaacccaccaggctcacatcctgcggaatgcgcacgccatgctcatgcagcgcgcgggccacacccacggcctggctgtcgttggcgcagaccatgcatgtcggcagattgccgccggtgcggccgatgttgtcgaggatgtggttcatcttgccgtacgcttcagaggattcccaggtctcacactgcaccgtcacggaattgaccgcattggccgcgcatagcttgttccatgccagcaggcgcgtcgccgcgtcgcgccactccttgggaccggcgaaatacagcaccgaacggtgcccgtattccacgactagatgcatcacgtcggccatcgcggaccattggtccatgccgacgacggatacgcggcggcggtcggcggacttcatcagccgcaggccgtcctgcacgtcgatgccaccgtgcgtggatgtgacgatcacacgaggctgcgcgatccgcgtccggcatgccgcggaaaacatgacatcggtgggcgtgaggaagatgaacgcatcgacgttcatctcgtcgaaggtgcggcacaggtcgtcgaattcctcctgcgagcacagcgcctcatgcaccatgctcaccgtcacgaacaggccatgctggcgagccatcgtctcaatcgcggaaatcgtggaaatcgggccatagaaatgctggccgccggcgatcaggccgatggtgcgggaccggtgcgaggcgagcgcgcgggcggagttgctgggacggtatccgagctggtcgatggccttctgcaccttctcgcgggtggcgtcggagacgtccggcgaatggttgatgacgcgcgagaccgtctggtggctcacaccagccagcttcgccacttcgaacatcgaaggacgcttattgcccgcatcgcgtttgcctgccatgccccgtcgcctttcgcacacaactgttggtacgttcgcctattgtacacgcaacttcagttagcgctaacaaccctcatgctccaaggatgcggcacactgcgcgcaggctaccgcacggccgccaaagcacgcagacgcgccgcgaagttgggccaatcggtgcgcatggcggtcagcagcttgcggttgggcacgtcatcgaccggcacccattcaatctccatgctttcgtcgtcgttggccttgggttcgatgcggtgccccggcttttcgaaggcgaacaccgtggtatacgaccatgggccgtggtcctcgcagtacgatccgaccacgtcgatgtcctccggcgtgatgttggcttcctcgtacgattcacgcaacgcgccctcgatcgggctttcgccgtcggcggtggcaccgccgggaatgccccacgtgccgccttccgcgctccataccgcgcggtgctgcatgacgacgtgcgtcacctcaccggtcgtctcgctgcggcgggccaagagcacgccggacgcgccgttcgtaccccaatgcttgcgaccgcaggcgcaatcgacccagccgtctcccggctggtgcacgttctccttgggcggcagcggcttcgcggcacccgttttcgcatcatattcggcgtccggcgcaaggtcggagcgggtgacgttccacaggtcggtccattcgacgcccaattgcgccgccagacggcgcgccaacggcaggctcaggccgatgatgccgtgcggatcgccttcgatcgagtcgatgaacgcgccgccgaaaccttccaaagtgaacgatccggccacttccagcggctcgccggtggcgatgtagcgttcgatatccaggtcggaatattcgcagaagtgcagggtcgctttgctggcgccgcgcaccatgcggcccgacgcgaagtcgatgaggcaatggccggtccacagctcgccggtggcaccgcgcatggcacgcagccgttcgcgcgctacctcttcgctatgcggcttgccgtagcattcgccgtccagcaggaacatggaatcgcagccgagaatcagcgggccggccttcgaacgggtcaggcttggacggccatccacgaaatcggcgatcggctcggcgacggtgggaatggcgatgccggagaaatcgcgggtcttcgtctcgtcggcggactgcgcgctgtccgtgcgtgcggctgtgcccgccgaggatgcgtcgcgatcgtctgctgcccggagcgggaagccgaccacgcgctccccgcgcgcgtgcgccgcggtatcggcgatgttgcgatacgcctggtgcacggcctcggccttcgccgtggcgagaatcatcacacgctgttcgacgctcaggtcgttcacggtgacgccaagcgcggccgcctcgcgttcaagcgcggcaggctcgtcgacgtgcgagacacggatggtcgggcagatgccggcggagaacagcacgtcacggcgtggacgggactgggaggcgagaatcagcgggatgctcatgcgcgttccacctgcacacccttggtgtcgaccgcgagatgcagcacacgccaatggccggatgccagctcttcggcggcgatctgttcaagctcctcgtgggcgtcgccatggtgcagcacaagcacgcatgggccagcgccggacacggtggaggcgaagccgtgggagcgcatcttctcgatcagcgcccaagacggctccatcagcgaggcgcggtacggctgatgcaggcggtcctgcgtggccgcgaacagcagtgcgttggcgttctgacgcgagccggaggccagcatcgcggggttcatggcggccggcagcaggctcacacgggagacgttgtgcacggcgtccttgaacggaatctcagtcggcaacgcctgacgggccttttcggtggacagctcgtagtccggcacgaacacggccgcggtcagatcgtccgccacacggtaattgatggtgtggaagccgttgtgcatcggctcgccgcctggaatcggcacggatccgacaccttccgcggtctccatgtcccaagacatggtcaggccgccgtacacggccggggccacgttgtccggatggccttcgatggcggcggccagctcgaacacggcgtcgcgattgaggtcgtcgtcctgcgcgaaggcggccgcggcggcgatgccggcgacgatggcctcggcggaggagcccatgcctcgcgcctgagggatgttgttgtgcgcctgcaggatgaatccgacgcgtcccagaccgaaggtctggcatgcgcggcggaacgtggagaccaccaggtgcgtctcgtcacgaggcaaggtgtcctcgccctcgccttcgatcatcacctgcgccgcggtgttcaccgggtcggcgctcagcgtgaattcaagctcgtcatggtaatccaaagccaaaccgaccgtatcgaaaccggagccaagattggcgctggtggccggaaccttcacacgcaccttgcgggtaactggagtcatctctcgtcgtccttcgtcacatcttcattacaaatcaagcaccgtataccgtggcagtgccagagtcaaatttcagggggaaccgcacccgtgcatcgtattcgggcccatgacggcggcttggcatggcttgcatgccaatcgcatcatgggcccgaatcgcatccgatatcagttcagcacgcgcaggatcgacggctctccgcacacgcaatccagctcgcacacgtccttgacggtttcgcgcagagtgagctcatcggtcatgtgggtgaccagacgcagctgctgcagctcgccgtcatagcccggatccttcagcgtcggcttcagatcctggttcacgccgttgatggacacgccatggtcggcgaacttggctgcaatcgcggcgagcacgcccggattgtcgtgaatcacgaaacggaccgcgaactcggccttggaagcctcgatcggagccttcttcagatccttgtacagcgggatggacggaccggtgcagccctgtgcgatatggcgggcttcggtgaccacgtcgccgacgaccgcggaagcggtcggagcgccgccggcgccgcggccgtagaacatgaggtcgtccgcagcttcggccttgacgaacacggcgttgaaggaaccgtgcacggaggccagcggatgggtgttggagatcagtgccgggtagacgcgcgcggacacgccggcatcggtgttctccacgacggcgagcagcttgatcaccttgttttccgcggtggcggcggcgatgtcgtcggcggtgatcttggtgatgccttcgacggagacgtcgtcgatggtgacggaggtgtggaagccgagggtggccatgatggcggccttgttggccgcgtcgtaaccctcgatgtcgccggtcggatcggcttcggcgtaacccttggcctgcgcgtccttgagcacgtcaccgaagtcgaggcccttggtggtcatctcgtcgaggatgtagttggtggtgccgttgacgatgccgagcatgctcgtcaccttgtctccgacgagggattcgcgcagcggcttgaggaacgggatggcgccgcccacggaggcttcgaagtagatgtcgacgcccttggcttcggcggccgcgtagatctccggaccatacttggccagcagcgccttgttggcggtgaccacggaagcgccggattcgatggcggcgagcacgaacttgcgtgccacgccggtgccgccgatcagctcgatgacgatgtcggaattggtggccacgctcatggtgtcggtggtcacgatggccttgtcgatccacgggaacggatcggtttccgccgggtcaaggcaggcgacgccggtcagctcgatcggtcgtccgatacgtgcggcaagctcgtccttctgctcgaccagcaggcgtgcggtctgggaaccaacggtacctgcgcccagcaatccaacgcgaatcggcgcaacatcttcctgtgccaaggcatcctcccttgaatgtgaagtattggtgtgaccttgcttattgtacggtctcaatatgacgtaaggccgcggaatatcaagaaaatggacggtttccgaagctttccccgcaaggaagcccgaaaaccgtccataccgtgagacgcaatcgtggactattcgctgacgtcccagctcagcagatcgtcgatcgtctgccggcggatcatgacgtgtgcgccggcctcgccgacgccgaccacggcgggaatcagcgcctggttgtagttgctggccatcgtgcggccgtatgcgccggtgaccggcaccgcgaggatgtcgccacgcttgatgtcggcgggcagccgcacctcgttgacgacgatatctcccgattcgcagtgcatgccgaccacgcggcacagcttggtctgctcgcttcccttgcggttggccagacgcgcggtgtagtcggagccgtacagcgccggacgaatgttgtcgctcatgccgccatccacggacacgtacacacgttccgtcaccggattgcctgacttgtctttcgcctcgccggaaagctcgaccggcttgacggtgcccacgcggtacagcgtgacgccggtgggggccaccgtccagcggcctggctcgaaggagatgaccggggacggcatgccgagcgcgcggttcacggtgctgaccgcgtcggcgagcctgccgagctccacgtcgatgtccatggaatcctcgccgtcggtgtaggccacggaataaccgccgcccagatcgacctccggcagggtgtacgcatcggtggcgtagaaggtcttgcgcagcagcatcatgcgcttggccgcctggatgaaggcgtccgcgtcatggatgttggagccgatgtgcgagtgcacgccgaccagttcgagcacgtcctgacggcggtagatgtccttgagcacggcgagcgccggtccgtcggccaccatggtcatggcttcggcgagcttgcggtcgccttcggagaccttctcgtggctcaaatcgtacgggtatttgatgtcgtactgcagctcgcgttgcgcatggacttcggaggcgtgttcgccaagtcgtgcattcgagccggcgggcgtcacgtcggtgaggtcgtcgagcacgccgagtttgcccgcgtcggctccggcgggcagcagggccacgccgaatttctggtcctcgtgcgcggtggacacgaattcgtggccacccgcgtggatgccggacgtgactcgcagcatgacgcgtgcgcgcttgccgagacgcttggcgatggtggcgatacgctccggctcgcccggctcgtccacgacgatcttgttgaagccctgttcgatggccagctcgatttccgcatcggacttgttgttgccgtgcagcacgaggcggcggcctgggacgcccgcggcgagcgcgatgcgcatctcacccatggtgcaggtgtcgatgagcatgccggattcggtgacgatgcggcagatttccttgctcagcagcgctttgccggcgaagctgacgtgggtgacggtgttgttgaacgcgtgggacgcggcatgcacgaatttcgtggcgcgggcgcgcacgtcatcggtgtcgatgacgtagagcggcgaaccgaattcgtcgagcaggcttgcggcggtacgaccgtggaaggtgatctcgccttcgtcgttcacggccgagccggccggccagattgggcttacaggcatggtttgcgtatctccctttttcgtggattcgcttcacatcttgtccggagcggtgacgccgagcaggtcgaggccttcggcgatgaccgtcttgacggcgtcgttgagcttgagtcgggcggcggcgcgggccggttccggagccttggcgatgcagatggcgtcggcctgttccccgcgggcctccggatcggtgagttccatcggcacgacgcgctccacgttgtaccacttgtggtaggtggcggcgaggtcctccaggtagtgggccacgcggtgcggggcgcgcaggtcgcccgcttcgcgcagcagggcgggccactgggcgagcgcggcgagcacttcgccgtcggcggtggtgtcgagcaggctcacgtcggcgccttcgtaggtgatgccggcggcggccgcgttgcggtccacgttgcaggagcgggcgtgcgcgtactgcacgtagtacaccggattctcgttggaatgcgaggacagcaggttcaggtcgatgtccaccggggagttgtagtcggtgcgggccagcgaatagcgggaggcgtccacgccgatggcgtcggtcaggtcgtcgatggtgacgacgttgccggcgcgcttcgacatgcgcacggccttgccgtccttcatgacgttgacgagctggccgatgaggatctgcatgttctcgcccggcttgtcgccgaaggcctcgcacatggccatcatgcggccgatgtagccgtggtggtcggcgccgagcatgtaaatcgccacgtcggccgggttggtctcgcggtggcgtttgttgcggtagtaggcgatgtcggcggcgaagtacgcgtagttgccgtcggacttgatgatcacgcggtccttgtcgtcaccgtgcttggtggattcgaaccaggtggcgccgtccttttcgaagatgtcgccgcgggcgcgcagatcggcgatggcctggtccacttcgccgtcggaatacaggctgttctcgtggaaccacacgtcgaaattgacgcggaagttcttcatggaacgctggatttcgtcgaacatcatcggcacggcgcgcttgcggaactcctcgcgctgttcggaatcgccttcgccgagcgggttgccgtcctggtcggcgccgccgtcgacgcgcggcaggctcagcacgtccacgccgtccgcgttggcttcgtcgatgacacgcttggcgatttcgtcgatgtacgcgcccttgtagccgtcgatcggggtttcctcgccgtgggccgcggcgacgagcgacttggcgaagcggttgatctgctcgccgtggtcgttgaagtagtattcgcgcaccaccttggcgccgttggcctcaagcacgcgggccatggagtcgccgacggccgcccaacgggtgccgccgatgtggatcgggccggtcgggttggcggatacgaattcgaggttcagggtcttgccggacaggtggtcgttcttgccgtagtcgctgccggcttcgagcacggtgtccaccactgcggccgcggatgcggagtcgagcgtgatgttgatgaagccggggccggccacttccacggacttgatgccgtcggcattggtcagttcggcggcgaacagttcggcgagatcacgcggcttcatgccggccttcttggccagctgcatggccgcgttggacgcccaatcgccatgtgcgcggtccttcgggcgcatcacggcgaacttggcctgcggcggaatcagatcggcggtcagggtgcctgccttgccttcggagacaagggtgttggcaatgttgaaaatcagttcactaagggcttctggactcattcttccaagaataccgggcacgctgacagaatcagtcttcctgtccatcctcacgatggggttgcgatacgtcctgcggaacgctttgcaaggcgttctgagcatcgtcctgcccgccatgccgtttcgtacgccacgccacggacgcgtagtagcccgtgtagcacagcgccacgaacggaatcatgtacagcagcgtggagcgctgcgacggatcgcaaatcaccagaaccagcgcgccgacgcacatcacaatcgcgacgatcggcacgaacgggtagccaggcgcgcggtacttgagctcgccaaccgtatgcccctgcgcgagccattggtggcggaatcgcaagtggcagacggaaaccgacgcccacaccaccagtgtggccaggccggaaaccgcgaccagcgcgaggtagacggtcgaagcggccaccacggaggacagcagcgccagcagcgagccggccatgctgaacatcaccgcgaaaacgggcacgccgtggaagttcgttttggcgagcttgcgcggaatcataccctcctgcgcgagcgaccacaccatgcgcgagcacacgtacaggccggaattcgcggcggacagcacggccgtcagcaccacgaaattcatgatgtcgccggcgaacggcatgccgatcgactggaacacgagcacgaacgggctggtgtcgacgcccgacttgcgccacggaatcagcgccgccatgacggcgatcgagccgatgaagaagatcgccagacgcagcacggtggtgtgcacggccttcggaatcgccttggacgggtccttcgtctcgccggcggcgacgccgaccacttcggtgccggagaaggcgaacacgaccgtcagcagcgtggagaagatcggcagcacgccgttgggcagccagccgtcgctgtagaagttctcgaacatcggcgcatggctatagccggcgatcggaatcgcgccgaacatggcgagcaggccgatgataatgaacgcgatgatggcgaacaccttgatggacgcgaaccagaattccgattcgccgtacaggcgcaccgacaggatgttgagcaggaacacgaccacgatgaacgcggccgaccagatccatgcgggcgaatgcgggaaccagcgttgcatcagcaggcccgcggcggtgaattcggaggcgagcgccaccgcccaattcagccagtagagcacggcgatggtgaacgcggtgccggggccgatgaaacgcttcgcatacaggtggaagctgccggcgtacggcatggccacagagagttcgccaagactcagcatgatgaagtagaccagtacggaaccgatggcataggcgataatcgcaccgagtggaccggcttggtggatggtgtagccggagcttaaaaacagtccggttccgatgactccaccaagcgaaatcatggtcaggtggcgcgtctccattttgcgctccagcccgccctgctcgtcgttctgctgggcttgcgccgtgggatccgcggcggttccggtcgctggctgcggctgccgttccttcgtccgcgtcggttcgccggcgatctgcgcctgtgcctgctgctctgcttgcgattgcgccatgcttgcctccggcttcctgcgcgtttggttgggtgcggcgtgtgttttggctggccgcacaatcgcaatactatacggcaggctcacggcaatgcgcgagcatcgtcggatcgaccgcgagcggaggaacgcccggaacagcgacggcccgcagccgggaaggcatgcgggccgtcgatcgcgctactcgcggtatgcgcggaacgctcagagcgcggcgatggcgtcgatctcgacgagcgcgcccttcgggatgttgttgccgccgaacgccacgcgggccggcttgacggagccgatgaagaccttggcgtatacgtcgtcgacctcgtggaagtcttcgacgttcttcatgtagatggtggcgcggaccacattctcgatgccagagccggcggtgtcgaggatgtgcttgatgttcttcagcgcctgcgcggcctgctcgcccgcactctcgccggccagttcgccggtggccgggtcgatgcccaactggccggagacgaacacgaatccgttggccttcacggcctggctgtaggcgccgagtgctgccggggcttcggaggtggccactgcttccagcttttcgctcatactgttctcctttgtcgtaaggtatgttgccgcaaggtatgtaaacgcgcgccaagtatgtgccaatatgcccgtacatgcgctatttgcgtcgcacctgaaatcatacttttccgatgggtggaagcgggaaaaaccgttcacagaacgatatggccggagttggcgccacacggcgcagcaggcacgaaaacggcggaatcgcaaggaaaaccgcggaaaaatacaacaaaacgagcaacaaaaaggctccagccgttcgactggagccttgcccggtgggcttgatggggatcgaacccacgaccttctgttccggagacagacgctctatccgctgagctacaaacccatgcaacgcactactgtacacggtctgcgcccgtttgcgacacgattcggcgaaaaacgtgacgcagaccttgcaatcgttgggaaagtcagtacgcgcgctcaatgcatcagagtgctcggcgcaaccagcacgcgctgcacgctcagtacatgagggtggcgaggcgacgacgtgcgcgcttcagacgctcgtcggtcggctcggggatcgtgaagtattcgagcagacgctggcgcaccggctcgatgtcggccttgtggcccgccgccacgaaatcaagcagacggtcgaacgcgtcctggatctgcccgccgatcatgtcgatgtcggcgacggcaagctgcgcgtccacatcgtccggcttgtcggcggcagcggcacgcaccacgcgcacgtccgcattggcggaacgggccagcagcagcgccttcgcacgttcgcgggcggcgcgcgtatcgttcggatcggcttccaaaaccttctcgtacgcggcggcggcaccggcgtaatcgccctgctgtgccagcatgtacgcttcctgatgttccggcggcacctgatcctgcacactgccggcggatgcggaattggccgcgtcggaatccggatcgcccgaatacggagcggtgccggtcacgccggcctgctgtgcggcggcgataagcttcggcacgaccacgtctgtgatctgctgcagttcctcgtcggacggaaggccctgcagaatcggcatcggacggccgccgatcaacgcgaacagcgccggcgcaccctgaatctggaacgcctgtgcgatggagggattggatgcgatgtcgatgcgggacagctggatctggccgttgagcttgttcaccgcgtcacccaatgcgcgtgccatggcgaacagacggtcgtcggtcggcacccacaggaacagcagaatcgggaacgtggcggaggtctgcaccatggcctggaacgtgttctccgtggtgtcgatgacatatccgccagccgccggagcgccgcccgcctgccccggctcggccttcacctgatgcttgagcgcttccagatcaacggctcccgccaatgaaacacccggatggaacgcttgctgctctgccatacttgcctccaaaaacacgaaatcgttgctggcaccaactataggtgccaacaacgatttcccggttttcattcccacggatgcgcgataggcggaaaaccgccgacgatgcgcgtccaaggacccgtcgttttacagcgcttcgaccttcaccggctggcgttcggaaccgaccgcggtgattttctgcccggaattcgccggcggaacatacagcgcgatgacgttcacatagctcgtcttcatggtgctggtggccttgccattgccgaacagcgccttttccgcgtcagaggccggctgcgattcacggccagcgccggcggaacgcgtccattcggagttgatctgcgccaccaccagatcgccgccgtccgcggaacgcatgacgctgatggctccattgaccggttcgaaggtctgctgctgcgtgccttcgttaagctccatggccttctgcacctgggcagtcagatcggcaagcttcgatcgcagatcatcatccgcgaatttgctggcgtacttgctgttcgccccgttctgcagcaggtccgcatacgcgtccaccgccgctttcggcgtcatgaccagaccggtgtccgtaggcgttccctgcgcgctgccggttttggagatttcgaaactcggcatcttcacgccggagaacagtcgcgccacaccccacagcttgtagttctggcgtgcggaatcctgcctgaacaccagcagacgcttggactgctggtccttggttgtggacgtgatggagaacacggaccgtggccagccggcatccgtggagatcacggcctgggccagatccgtggggatggtggtcttacggtcaagattgcccgtggctttcgctacgttcagctcgctggtgcggatgtccagttccggaccttcgagaatcgtcggcaacgtatcagtgtcacggttctgattgcactggtcgagcgttttgagaatcctcgtgcggaccttttgctcctgcttggcgctcaagttcggcgcatcctgccgggtggtggctttcggggtcggcagctggccttcgcaaccgcacatgccgacggccattcccagcgcgagcatggccgcgataatcgcctgactacgcttcctcatcactggtcctcctcttggccgtcttcctgcgtttccgtctgaacctcctcttgggcaagacgagcgaaatacgcggcaagctcatcctgcgagatcacggaagtcgcctcgtcgtcaacagacgattcgcccgccgtcgattcaaatacggtcgattcggacacagtcggctggctttccgcaatcgtgttctgctggtcggcgaccaggttacgtgccacaggatcgacgatgacgggctgttgcgtttcctcgaacgacgacgtacgaccgccggtgcgatgttccgcatggcgacgcctgccgtgacgcgacctgctccgtgccctgttgctggcggcggtttcggcgttcttcacccaagccgaaacctcgttctcatcgccttcgttgacgccaacgccttcgaccatggcgaaagcgcgcttgttgcggcgcttatgcggcggcatggcgaatacggaagcggaaagcacggcgagaatcgccagcagtccgccggcaagatacaacggcatggcgaaattcggcaggttacgacggtcccaattcagagtgaccgtatctcccttgcggttgccgaaatcaatcaacgccacaacatcctcggcgttattgctgttcgatcctttgacctgcatatcaacggcaccgtcattgcacttgatggtgcgccacatgtcggagtccttgaaagccacctggttctgggaattgtccgcggttccctgcgcggagaccttcatggtggaaagcgtcgtccaatcggacagaccggagacgcgcatgtacttgcttcccgcaatccatccggcaacgtcgcgcgcggaacctatggcgatgcacacattggatttcttgtcacgggatttggccgaaatattgacgcggctgtctaccagctgcagcacgttcggatcggtgaccacgtattccgaaccgttcaccggagcggcggcggtgatctcattgtccggtttccagacggttgaattcaacacgccaaacacgacgcatgcgatggcaagcaagccgaaaataggcgtgacgatgccacgcatgatcttcgcatgccgggtagggcccgtctcgatctgcggcttctcttgttcttcctgcaatacagtcatagcttttccattctacagtgtccgtttgcacaagcctgaaaaaaacatgaaaatcatgctttgccgctatggttggccctatgcgtaaatcacttctttccaaggccgtcacggcagtctgcgcaacggtcatgtgcttgggcgtcactgcgtgcggcggtaattccagcgcgaaatccgacaagtcgaactcggattcttcctcatcttccgaaaaaatcggcatgcaccaaatcgccggcgtgaccgccaagggcgagctcggcaagaagccgaccgtctcgttcaaaacgccgatgacggttgaggacaacagctacgtggtgctgcagaagggcgacggagcccagatcgaggacggcgaccgcgtctgctcgcagggcatcgccatcagcgtcaaggatggttccgaactggccagcacgtgggagaagaacacccccgactgctccaccgtagtcacctcggataccagccagatgaccgagaactactacaagatcttcaagagcctcaagctcaattccaccgtggcgttcggcgtgaacgactcgaattcctccggcacctcgtatctcatggtactcacgctggtgtccaagtcgaaggacctgaagaaggccaccggcgagaaggtcgcgggcgttccggccgacctgccgaaggtaacgctcgccaaggacggcaagccgtcgatcgacatgaacggctataagggttccgattccctggtttcccaggacctcatcaagggcaagggcgctgtggtcaaggatacgcagtccgtggtggcgcactacaccggctggctgctggacggcacgcagttcgattcctcgtgggaccgcggacagtcctccgccttctcgcttgacagcgtgatcaagggctggaagcagggtctggcaggccacacggtcggttcccaagtgctgctggtggtgccgccgagcctcggctacggaaacaaggatcaggagaagattccggcgaattccacgctggtcttcgtggtcgacattctcgccgcctactgatccgccgaaccgactgataggttcctccaaaaacaaaatagcctccccctcgggaggctattttcatatgcatgcaagtcctaggggaaatcgcggcaacgcgtgcggtatcgaggcgtaccgagggaaggcgtacgaaggtacgtcgaccgaggaacaacgaagataacgctccgttgccgcgatttccagagttggaaccgaaagaatcagaacaaccgtaaagaatcgtcctcagtgcccttcatctcctcgtaatccaaaagcaggcatttgaaaccgcggtcctgcgcgagcacgcgggcctgcggggtgatggtctgcgcggcgaagatgccgtgcacgggggccagcagcgggtcgcggttgagcagatcacagtagcgggtgagctgttcgacgccgtcgatgccgccgttgcgcttgatttcgatggccacgtgctcgccgttgccgtcaatcgccatgatgtcgaccggtccgatggctgtcgggtattcgcggcgcacgagcttcgcgcctttgccgatgcgttcgatctgttcggccaggtacttctgcagatggtcttcgacgccgtccttgatgaggcccggatcctcgccgaggtcgtacgattcgtccgaatagatgcgctgcaacgtcacttccagcacgtcgttcgatttgtcggccgacgcgcggatcaccttttgcggcacttcagtatcaacgtcgtcatcggcgtggtcgggggtgatgtccctgatgctgcatggcgcggacatccagttgagcggcttgtatgagccgagttcggagaagatcagcaggctgttgtccgccttgatgagcagcacgcgcttggcgagcggcagggaggcgttcaatcgttcggaatattcggcagagcagtcagcaacaataattcgcacgaggcactaccctaccatgcgcgtcgccgtacgtacggcatacgtattcgcggcggcggaaagccacgtaaaagacaaaagcggcccggtaatcgcaatacaaaaacatattgcgattaccgggccaccttacgtcaagcggaaacggcttattcggcgcgcttcacgttggttccacgctcgaccgcgacggtgagcttgttcgaatcgaaggagatgaagccgtcagtcacctcgaaggagaggcgattgccttcaggatccaccacaacgatggttccttccttgatcacggtcagcacaggctcgtggtcgggcaggatgcccattccgccttcggaggcgggaatggtaacggacttcgccgtgccgtgccacacagggtggtcagcggcgacgatgttcacctgcatagtcgatccggccatcacgcaccgtattccttctgcatgtcgtgccacttcttctcgaggtcgtcgatgccgccgataccggagaatgcctgctccggaacgtcgtcatacacgccgtcgcagatgcgggtgaatgcttcgatagtctcgtccgccggaacgtaggagcccggacggccggtgaacttctcggcgacgtagaagttctggccaaggaactgctcgatcttacgggcgcggttcacagtggtcttatcttcttcgccaagctcatcgataccgatcagggcgatgatgtcctgcagctccttgttacgctgcagaatcgccttgacgcggtttgcacagtcgtagtgcgcctgacccacgtaacgcggatcaaggattcgcgaagtggagctcagcgggtcgactgccgggtagatacccttcgaagcgatgtcacgagacagctcggtggttgcatccaggtgggcgaaggtcgttgcaggagccgggtcggtgtaatcatcggccggcacgtagatggcctgcagcgaggtgatggagtgtccacgggtcgaagtgattcgctcctgcagcgcgcccatctcatcggccaggttcggctggtagcccactgcggacggcatacggccgagcagggtggacacctcggaaccagcctgggtgaaacggaagatgttatcgatgaacagcagcacgtcctgattctgtacgtcacggaagtactctgccatggtcagtgcggtcagcggcacgcgcagacgggtacccggctgctcatccatctggccgaagaccagtgcggtcttctcgagcacgccggcttcgtccatttcgccgatcagatcgttaccctcacgggtacgctcgccgacgcctgcgaacacggacacaccgccgtggttctgagccacacgctgaatcatttcctggatcagcacggtcttgccgacgcctgcgccgccgaacagaccgatcttgccgccctgcacatacggggtcagcaaatcgatgaccttgataccggtttcgaacatctgggtcttggactccagctggtcgaatgccggcgggttacggtggataggccaacgttcggtaaccttaacggtctcgtcggccttcttgttgaggatgttgccggacacgtcgaatacgtggcccttggtgacatcgccaaccggcacagagatcgggccgccggtgtcatacacggtggcgccacgcacgaggccgtcagtcggcttcagagcgacggtacgcacggtggaatcgccaagatgctgttcaacctcaagggtgatcttcttggtggtctcgccctcttcgtggacaccggtgttggccagttcaacggtaagtgcattgtaaatgtcgggcaggtggcccaccgggaattcgacgtcgataaccgaaccctggatacgcgtaacgcgtccagcggtcggctctgcagccgtctcgggagccgctgtggtctgattctcagccatatgcgttcctactcttccttcttgttcagcgcatcagcgctgccgatgatttcggtaagttcctgggtaatcgatgcctgacgcgaagcgttgagcttgcgagtcagttcatcgatcaggctgcgagcgttgtctgtagccgtgtgcatggcgttctgtcggcttgcagtctcggatgccgctgcggtgagcaggcattcatggatacgggactggatgtacttcggcagaatcgcgtcgagtacttcgtcaacgcttggctcgaacgcatacagaggagtcgcagcatcggcatcggattccggcacaggaccggattccggctgttccggaagcacgagctcaacgggtagcatgcgcagcacacgcaccttctgaaccaccatattcacgaactcggtgaacacaatgtagagttcggagactccaccttggtccgccggcttcatataagcgtccaacagtgccttcgagatggactctgcgacttccacgccgggctggtcggtatcgccttcccaagtgccggcaaccggacggttgcggtacttgtaatacgtcacaccgcgacgaccatacacatacagttccggctgcttgccctgctcatcgagtcgggccaacagcgattccgtttcgcggatgatcgaggaggtgtacggacctgccataccacgatccgaggtaagagcgaggacagccacgcgagggttgtcctcgttctttttcacgatcggatggtcgatatgggtatgggccaccagcgcttgcacggcgtcgaaaatcgcatcggtatacggcttcgcgttcaaggccacgtcacgtgccttggcgatatgcgaagacgcgatcatctcctgcgcgttgaagattttctccagcgacgcggtggaggcgatcctagatttcaatgcgagttgcgagcccatgaatcacttctctcctgcgacgatcttttcctgctcgaccggagtggtgtgcttctcgtcaggcttcttctcgaccagcggcttgcccgcgctggtcacgaaggtctcacggaacgcttccacggccttgtcgagggcagcctcggtgtcggcggtgaagtcttcggtctcgcgaatggtcttgaggatatcggtgttgtgatccagataatccagcatgcccttttcgaacggcaacacgtcgctgattggcaggtcatccatcttgccatgggtgccggcccacacggacacgacttcctgttccatcgaatacggggagaactgcggctgcttcaggagctcggtcaggtgggcaccacggttcagctgagccttcgaagccgcatccagatcggaagcgaacatggcgaaggattccagcgaacggtactgcgccagcgagatcttcagcgtgccggagaccttcttcaaggccttcgtctgggcagcgccaccgactcgggacacggagatgccgacgtccacagcaggacgctggttcgcgttgaacaggtcggactgcaggaagatctggccatcggtgatggaaatcacgttggtcggaatgtaggcggacacatcgttcgccttggtctcgacgatcggcaggccggtcatcgagccgccgccgaggtcatcggaaaccttggcgcaacgttcgagcagacgggagtgcagatagaacacatcgcccgggtaagcctcacgccccggcggacgacgcagcagcagggaaatcgagcggtaagcctcagcctgcttcgacagatcgtcgaagacgatgagcacgtgcttgccgttgtacatccagtgctgtccgatggcggaaccggtgtacggtgcgatgtacttgaagcctgcggaatcggaagccggggaagccacaatggtcgtgtactccatagcgccggcctcttccagggactgcttcaccgatgcgatggtggagcccttctgaccgacggccacgtagatgcagcggacctgcttcttcgggtctccggattcccagttgcgcttctggttgatgatcgtatcgattgcgatagcggtcttaccggtctggcggtcgccgatgatgagctggcgctggccacgtccgatcggcgtcattgcgtcgatggccttcaggccggtggacagcggctcgtcaaccggatgacgatgcataacgtcaggtgcctgggcctcgagaatacgacggccttcggtcttgatttcaccaagaccgtcaatcgggttgcctagcgggtccacgacgcggccaaggtagccgtcgccgacgggcacggagagcacttcgccggtacgacgcacttcctggccttcctcgataccggtgaaatcgccgaggataaccacgccgatttcgcgggcgtcaaggttgaacgccaggccaagcgtgccgtcttcgaaggtcagcagctcattggccatgcaaccaggcagtcccgtcacgtgcgcaatgccgtcgccagcggtcgcgacataaccgacttcctgggtcggagtgtccgacggcttgtacgactcgacgaactcatcgagcgccttgcgtatcgtggtgggatcaatggtaagttctgccatgatcactccttattgttgtttttaaattcagtcaagtcttgtttcaggcttgttcaccgtgtggcgtgccgtcaggcggtcgccttcaccgtgcgctgaagatgttgcagctgtgcgaccaccgtgttgtcggtgacctcgtcgcccacctggatgcgcataccacccaggacggtcggatcgaccaccgagttgatgtgcaccggatggccggtcttcgccgaatagatggcgacgagcttcttgacctgctccttgctcagtggcgttgccgtggtgacggtgaccatcgattcgcccatatgacgggagaacttgttgatcagccactgaatggtctgcagatagcggcgattgcgcagattgcaggtcgcatgctcggccagacgcttggtcaccacattgaagtcggcattgccgatcaggctgtacagcagcttgatacgggcttcggcggggacggttgcgtcatacagcttgctgcgtacgaccggaaggttgagcagtgcggaatgcagctgggcaagctcgatggagacctgcagagtagcattcgtgtggtccgcgtagtacatcatgccatccacaccgaaatcctcggcggcattggcgatgtcggacacgcggctccaacggcgggccaccagatcggacatgatttccatcgtcaacggatgggcttcatctccaatgagggtcttgactaccgcaaccttgtcttcgactgggcgcgacgggtcggtgagggcacgttcaagctggatgttgtggtcgagcacgttggtgatcgtgaacagttcgttcccgatacgccatgcgtcctcgccgctgtcacgcagcttgggggccagcgagtcacgcgaaacgcggtctgcgatacgcgatgcttctcctcgcattggtcacctccctttcttgaaggtttcgatcacttcttgtcgctgtccagttcggcgatcatctggtcgatcatcgtcgactgcacgtcgtcgctttccagcttgctgcccaggatcttgccggccagtgccgttgccagcacgccgacctcacccttcaggctcaccagagcctgctgctgctgggattcgatggaacgctgggcggtggcggtgatctgcgccgcatcagcctcggcacgggtacgtgcgtcggcgatgatgtgcgatgcttccgcgcgagcgtcgtcgcggatcttggaagcctcgacgcgtgcgttgctcagctgggcatcgtacttcgccttggcttcgtcggcatccttctgggcctgttcggccttggcgatgccgccttcgatcttggctgcgcgctcatcgaacacggcctggaacttcggcaggaagaacttgtagaagaacacggcgacgatgatcagaatgaccaacgaccagaaaatgtcgtagcttttcggaaggaacagttccatctcgctagctgcggtcaccatagtgtcttcctcctttcacgttcgtttgcgtcttcggtgtttaccttggggatcaagccttacttgatgaaggcgagcacgaagccgagcagtgccagcacctcgacgaatgccaggcccaggaacatgagggtctgcagacggctgccgagctcaggctggcgagcggtgccttcgatggtcttgccgatcaggatgcccagaccgatgccagggccgatggcggcgaggccgtagccaacgacgttcaggttgccggcaacctcagcgagggtaacgatatccatgattgtttcctttctggttattgcttgacaagaagcaacacttaaaaagccggcggtcagtcgatctccggatagctcatattgatgtacgcggtggtcaggatggcgaagatgtaagcctgcaggcaggcgaccagcgcctcgaacaggaacatgaacatgccagccgcgaaggtgatgatgccgaacggcatcatcagcttgttcaccacatcaacgaggaagaactgcgtggccgagaggcacaacgcaaggatcaggtggcccgaaaccatgttggcgaacagtcggatcgtcaacgagaacgggcggataatcagcagctcaagcagctgaatcggggacagcagaatatagatcggggccggaacgcccttcgggaagatctcgtccctcaggaagtggccaaggcccttttcacggatgccggcaatccagtactggcagaagcaccacatggcgaacaccagaggcagcgtgatggacgcgcttgccgcgatgttgaagcccgggatgatgccgcacagattgaagaccagcaacgtgcagaacacggtggtgatcatcggcacataacgcttgccacgcagctcgcccatcacctgatagacgatgttgtcgcggacaaactcgatcagccattcgactgcgccctgccaacggccagggatgagctttgcacggcttgccgtaattccgagaaccagcagcatgatgacggtcgcaagaatacgaacgaggatgatgcggttgatggcgaacggcgtgccttgaaaaacaaacggatcgggaaggaagtcattgatgctcggcatctctggaccatcggcgatggtcatgatgccctctcccaatgcactaatcattcacgcctcctgctcttgtgtcagctgttagtctagcccaacagctgagtcgaatgtgacattccggttaccaaaccagaacatccttcgggttctatgttaacgcgcccataaacgcgttcgcataccagccccgaatggctgcaaaggattatcagaccgtggctagacaacattccgcaccgggagctttcccctactaccgtatagcgaaaaccggcgtttcgcacgttgcggggactattagacacaaccacggccgttgtcgattcggcctatttcacccccattcacaccaaaatagacatcgtttgcaacactgcttgataaaacgttttacttaacatatcgcaccataatatatgacggcgaaaatgaaacgatgtcgcagcaggcaacaaaaaccgcgcaaaaagcccacgacaccgcgcaaaagcggcaatcgtgggacaatcgccaatacttgtcagtactcgccgatcttcgtgaaatcagccgcgaatgacaccgtatccatcgtgcgagaacggcgtgaacgcgtcgacacgcggagaaccgggctcgtgccggatcgaacggtcggtgccgaggcgcttctcctcgcgcagctgcggtacttcgctcaaatcgtaaggcgtagtctgatagacccagttgagccagttgcgccacagcaggttggcgtgggcgcgccaggcgaacagcggttcgagcttcggatcgtcgtgcgggaaatagttttcggggaacggcacgttggtcatgcccttcttcatatccctctcgtattcctcggcgagcgtgtacttgccgtattcccaatggccgagcgcgaacacttcggagaagtcacgcgtggcgatgagccccgggccggacttcggaccccacgtgagcacctgcagctcgggattatgggcgatatcaccctcgttgacccccgccaggcgggaatgcggttgcaggcagatctcgtcgaaaccgttggtgaggaagcagtattcgtcctgcagatactgggggaacactccaaagagcttctccggcagcagctccttgcgcacgccgtaccgatagttgagcgcgcccatcgcgccccagcacaggtacatggtggagaagacgtgggtggatgcccagtcgagaatctgcttgaactcgtcccagtagtcgacctgctcgaaatcgaggtgctcgacgggcgctcccgtcaccacaagaccgtcgtaatagttgtctttgaacgcatcgagcgtctcgtagaacttcaccagatggtcggcgctcacgtgcgtggcctcgtgggtggaggtcttcatgaagtcgacctcgacctgcagcgggctcttggagatcagacgcagcagttgcgtttcggtctcgatcttcttcggcatgaggttcagaatcaccagcttgagcggacgcacacgctggcgctccgcttcgggcttttcaagcgcgaagatgcgctcggagtcgagaatgtctctggccggaaggccgctgggaatcttgataggcatgtttcctattatggtgcggacccggatatggcgtattcggcggttttcatcgacggtccgcagcgttatacgaaaaaacggataacgcgttatcggatatgcgattccactagcagcgcaatatgcgacacgccgatttgacttattagccaacatccgtaaagtagttaaagctgcctcaatgaaggcaagccgacgcggggtggagcagctcggtagctcgctgggctcataacccagaggtccatggttcaaatccatgccccgctaccaattgaaaccggaagccttttggtttccggttttttgtttttctaggacgtctcgctccttttatataaagtccccatacatatcgaacgcaaccgacgcgcacaacgtatggtcatgccgctgtagccttcataatcgaacataatcgcaaaacatgtattaaaacgctttaccaaaagtatttgaagaaagcacttgtagccgcatcgccgtaatcgttacgaaaagggaaatcacaaaaagaacacaactacctctataatcggctatatgaatgaagcaacatcatcaagcgcgacaccgcgcacaaaggcaacagcaaagacaacagctaaagcagcggccacaaagacaacgaggacagccgcgaaatcaaccgcgaagacgacaaccaaaaaaccaaccaccaagcgcacttccaagccgaaaaccgcaacgaagcgaaccgtcggcgaaactccagcacctatcatcaaccgcaccagcccggaacagttcggccgcgtaaacgttcttgacatcactccgtccgccgaaaacggcctgtacccggcccgcgtggagcttggcgaggcattcaaggtcaccgcgcaggtgttcatcgaaggccgcaccaaggccggcgccaccgtgtccgtgcgcaacacgcgtggcaccgagaagggccgcttcccgatgatctgcaccaaccccggcctggaccgctgggaagcgatggtcaagatcggcgaccacagcgacctgaagccatgggaagacggctacgccgacgtcaagaagcagctcggcgaatggcacatcgtggtcgaaggctgggaggatacgtacgcttcctggctgcacgacgcgcaaatcaaggtcgaggtcggcgacgatgcggagaacgcgctggaatccggcgcgcagctgctggaacgttgggctggcgcacgcgattccaagctgaccgccgacgacaagaagacgctgcgcgaagcggcgaaggccgttgccgacaagtcgctcgacgcgaccgcgcgtcttgccgcggcgaccaccgacgcaatcgcaagcctgcacgaaaccaatccgctgcgcgacggcctgagcgcgtcgaatccgcagcgcttccgcgtggaacgtccgaagtcgagcttcgccgcatggtaccagttcttcccgcgttccgaaggcgcgtatttcgacgccgacggcaagatcgtgcagggcacgctgaagacggcgctgtccggcctcgaccgcgcgaagaccgaaggcttcgacatcgtgtacctgccgccgatcttcccaatcggcgtgaccaaccgcaagggccgcaacaacacgctgatcgccggaccgcacgatccgggctccccgttcggcatcggctccgagctaggcggccacgacaccgtcgacccgctgctcggcaccatggacgatttcaaggcgttctgcgattacgcgcacaagctgggcatcgaagtggcgctcgacttcgcgctgcagtgctcacctgaccacccgtgggtcaagcagcatccgaactggttccgcaccaagccggacggaacgatcgcattcgccgagaatccgccgaagaagtaccaggacatctacccgatcgatttcaacgccgacatggaaggcatcgaagcggaaaccgaacgcatcatgggcctgtggatcaaggccggcgtgacgatcttccgcgtggacaacccgcataccaagccggtgcgtttctggcaggacgtgatcgccgccgtgacgaagaagcatccggagacgctgttcctggccgaggcgttcacccgtccgggcatgatgcgcgcgctgagctatgccggcttcacgcagtcgcactgctacttcccgtggcgcaacaccaaggaggagcttgaggagtacttggaggagaccaacggcgacggtggtttctaccagcacaacaccttctggccgtccacgccggacatcatgaccgcctacctgcgcgacaacggtatcgccggtcacgcggtgcgcgcggcgctcgccgcgatgggctctccgagctggggcatctacaacggctatgagctgatcgagaacaagcagcgtccgggcttcgaagagcagatcgacaacgagaagtacgaagtcaaggtgcgcgattgggacgaggccgacaagtacggcatctccgagctgctcacctcgctcaacaaaatccgttccgagcatccggcatgccgcagctaccacaacctgcacgtcctgccgagcgacgatgcgggcgtggtggcgttcctgcgccagaccccggccgagcttaccggtaccggcaagccggatacggtgatcgtggtggtgaacctcgacggccacaacgcgcatcagtccatcatccacatcgagctgccggacttcggtttcgccaccgacaagccgctcaaggtgcgcgacgagctgaccggacgcgagttcgagtggagctgggacaactacgtctcgctggcaccgtgggccgacgtggcgcacgtgctgacggtggtcgaggactgatttttggtcccagccgactttaacaaggagcgcgggcagaccattcaaatggctcacccgcgcttcacatgcacctcgctattgatagctccgtggctctatcagcaatcggcatcagaggaagacagcaccccgtctgacataaggtatagatgatccgcgatttgagacagctcatcgctatgatgactggcaatcaatacggttcgacccatatcacgctgacgcttcatctcctccagaaacaccgagacagaatgctcatcaaggccattagtcggttcatcgagcaaaatcaaaggttgatgttccatcaatgcctgcacaatcgccagcttttgccgcatacccaaagagtaagatcgcacttgttcttgcgcgtggttccgtaaaccaaataagtccagcaaacgcatgatctcatcctgatcaaaggcgtggttgatgtcggcaagataccgaagattctccatagcactctggctgggaatgaatccaggattctcgataattactcctacggattcaggtaatttcttattgaattccacgggtttaccatcaatgctcaccgtaccattatccggccggataaaaccgcaaatcgcgcgcaacagcattgtttttcctgacccattaggaccaacaatgccgtagatgttaccccgttcgaattcagcattcacgtcacgcaataccactttgcgtttgatggtttttgtaagatgacggatcttgacatacattttgtcattcctcctttgcattgcgccatattgcaatcaacactttgttttactggaactcaatacatttccacatgctcaaaaacaatgagattcaccatagcgagcgccaaaaaaagaaccgtcaaaacaggtacccaacatgggaggatgccaatccacgaggatatcaaccatcgtcgaaccccatctaacgaaagcaaggcagtatacagcgcagcagctgtggcatagcccattacccggcaattcagcaaataaccaatattgatgatgagcatcagtacggcaagcgtcaaagccgcacaaatcgcagtcatcaacagacattcctgccgatccctagaaacaatcattaccgcgataattaactgcacaccagtgaacagggcacagtagcacagcagcagcgcacaatatcgacaaaaatgagaccatcctcgacgacttctgacatacaccagataatcaggaatcatcagatattcagagcactgttccaaggcaagcgctattcccccgaccataaacagcaacggatacatattcaaggtaagatccggatgactcattgcaggagcaatgcgaaacatccccataaagatacctgtatcctgcgcactgtagtaaaagcgtgaagcgaatatggcgtaaatgacgaatatcagcattcgcagaccttttttacggccacaaacctgtccgatgcgacatatagcatgcattagtttttcagccgatctctggagttgaacgccacgatacaggccataatgagcaatgagcagaatccaaagcatggaatgacttggcagataacaatatctgaccagtctggactgatcgggtaccaaaaatagaacatcatacgagctgctccatcaaccaacggagtcaataaccactgcgcaatagcaaaaagcgcaatcagcaccgcggcgacatgttccatgactaatcccatgtagctcagcaataactggaccaagcctattgaaatattcatcatcaagcattgaactactagcattgcagtcaaagacccatgcagaacagatgcagattgtcttttaatgacaaattccatgacagcaaaaacgaggccaccatatgcggcgcatatgcaagacatcatgttcagccatataacattttcaccaagctcgtcacggggattccgacgcaccaattcaaacgtcctaaatcggacacggcccaaacacattgccatcaaacaaatcggaagtactgtggccgaagctccctgcttcataaatccgatgtagtcagatacgaaatcgtgagggtcgaataataatgaaatgccatacgcaaatcccaccaccataaccaatatggcactgattctcataccaatggtggaataccgtacggaagcaaaaccatcacaaagcatcacgatacctttccacacacgccagtacggtagacaatgcaagtaagagcgccgtcgaaagcacaatgcccacataattttgccaacgcacagaatggtctgcacctggagcaaagtccagaaagataacatggctccactggtccggtatcttaccccccgtaagagaaggaagcatccaccatacaagactcagtacgaacggaaccaacacttccgtatatttgcgttgcatgaaaaaggacacgccaacggccaccgtggagaaaagtccggcaatcacaaatatcaacaacaccacgcatagtatgcataacacctgattgaactcatacaacggatatatccaagaatcagaagaaatcaaaatatatttgctgctatacacgcgccctcgcgcatccgccgatacaccatcgataaaattcaaatgaggattgcgcatagcagctattgatagattcgcaatcatcggcattattccacccacaccaccaagtacgaatccagatgacatcgcagtcgttacaaaacgtcctcgtccttctcgaatcacgaccatggggagccgcccggcgtgccgttccaacgatacgacgctacctcctaagagagcagataggaaaggcagcaacagcagatacatgccaccgcctgtcccgtattgactgaatagcatcacatcccgtagcaatgtagattcgctcgagggagtgacataactcgccctatacgtggttagatattggacagcgaccaacatacaggatatgacgattacaccaatcatccgggcacttcgcagttgcccaaccaactgatttctcatcaaccgccaatccatcaagaccccttcgtcttcccgaatccaaacagcgtggcgtagaagagcaatcttctacgccacacaaccatgctcagttatcggggctccatttacccgatgtttccgttgcaccagagtacgcatgcgccgcttgcaaacgcatatggacctgtttcttaccgaaattcttatatacttggttggtgacccaaccctcttggcctgaagtaagagttacaacgccggattccacatcttcatttgcatacccaagcatccacgcacgtatcgtccgatcaccagacacatgatcagctttaatatagccatttgaagcatcttgtttttgacgatttggcgtatctgccgtattccaacctgtaagatatgcgctccatgatgtttttcctacattcccagcaaacgccggtgttataaaacaacaagaagcagccacagctgctgcaactgcaaccactcggcctgcaatacgtgatttcatcgttgaaacctttctctgctatgtcaataaagacaaaggcaataataagataattcaaggaagccagttcatcttatgtaatgaaattctttatgcattccacaaagaacagatccacttaggaattccagatgggcaattcacaactctagaaacagacaaatatgacattcgcccatcccaactgttgaacacggaaacattgtcgacattccctcccatcaacatcacagccatcattcctaatgcgatctctctcatctatatatcttttctcataattgtgttgaatccacttaaagttttaatctgtttccgcaatagcaaaacaaggcaatgtaaagattttcatcacatggcactatggatcaattggcccacgactacactcacgttatatgactgaaggtatttccatcgccgttctggacaatgactcatggagcttacgggcaatcgcgcggtggattgacggcagctcacctttgtatcatgtcatctggcaaaccacttctgcggcagaagcgatccatcgatgtatatacaccaacgacaagccaaatgttctcttgcttgacatggcgttgaacgatgctactggcatatccgtatgcactcagatacgaaaacgaaccgccgacatcggcatcatcggcatcactgcatatgatcctgaacggtacaagactgatttagcgcttgccggcggtcaagctcttatcgccaaagaaaacttggcacatgtctgcaataaagtactgcccatcgtggcacaaggcaaatccgctgaaccaaattcgttcccaaccgcgaaacaagcgcatgacatactggcagaacaaccttcttcattctctcagatcaagcagctcagcccgcgagaacttcaagtgcttcgcctttacacgcaaaataacaatacttcagaaattgcttcgcaacttggcatttcttccaataccgtattttcttacattcacagagtctcgaaaaaaataggcacaaagaatagatcagagataattcgactatgcaaaaaatacgacattttataaaatcaatcaaagaattatgctacgacatgaatcgtagcttgccaaaaaaattatctttatacatagcttttccattgtttctattgtattctctagaacttatcagtggatactatcatcaatttacagtattttccattgtttttatctgcatagaactatgctcaatcgttctttttattcaattcccctatacaggatcaataataatcatcatattgtggattactgcagttagcataaaaccagtactgccctactcctttgtattcgcgggactgtccgccacggtaattctcggatatatcaatatcccttcagcaatcagcatcctcttgttcgccacaagcatcttatttttccaacctcatacagacaagagcgcactcgtcatgttcgatactacgttcttgaccctagccataatcgggtgcgccattcgtctccatcagaatcaaaaacgcgccatcaatcaactgaccatccacaaatggaaggaagaaatcgcagaagagctgcacgacatcgtatgcaacgatcttacctacgcaatccaccaaataaaccttttaaagaatgaaaatccaaacagtcagagaaaccctgagatcgcagaaaacatggcattacttgacatcagagatagtctcatagaggcattgagttgttcaaggaccgccataaccacactccgcaaagacgatggcagttgctccacatccgaaatcgatatcaccacaatcaacatcatcgaactgctagaacaagaacgtatgaaactcgccaaggctggtttcgacggcattattgcagcggacggatccgacaacctgacaacaacacctggcaaaagcattatcatcaagcaactcatcaaagaaatcttcggcaatatactcaaacatgcggatccctcacatggctatgtcatcactgcgtatgtcaacgccagcacattacatatcagcgccagcgatacgcctcttttaaagaacagcacctcaaagcatccgcaagacaatgccaccaacaatcaatttggcaatggcacaggcatacgctcatatcaaacacgactcgcggcattagacggcgaattatccgcctccgcctccgatgaccagtggacgctggaagccgccatacctttaatggacaccgaccacaccgatggccaccattcagctggacgaatgcgaattcggttggattgagcaaccaccttgccaaccgacgacgcactatatacccgcccaacgatggcggaatatccgcaggacggtcttacagcataccgtgataccgcaatgactacaatcgctcacctaatcactcaggcttagtttcaacgtttgtaagattacggagttttctaccataagcttatggtaattgcatcatgtctatcaaccccgctcgcgccttatttttccgatgaaggcaaaagacttatcaaaacgtcgaaaatgcactttcatgatacgggctgctctgctatctcctgaaataacaaatcggcaacagttccttgccagtccgcacctaggtgcgtgacgaactgaccggacgcgagttcgattggggctgggacaactacgtctcactggcaccgtgggccgacgtggcgcacgtgctgacggtggtcgaggactgagtgagtttggatgctaggcactctgcctagcacccagccagcgcaaaacacatagatcaagggcgggttgaagacgtttctcacgttttcaacccggctttgtgcattccgtaggtggttttttgattccgtaggtgctctccggtcaatccacgcaaacagaatggctgaaatcaagcctttttgccgcagggataccagagccaaccacctacggaagagcaaaaccacctacggaattgttcttccaacgttccaaggcaggatagtcaatcacaatcggccaaaaagatgttgaccagcgagcgcatcacgccttatctccccagcactgagcaccattcatataggtatccggaaaatggtgccgatatggcgcgaaagcgggtattctaagtaacgaactactgctgatcattcgatcaaggagaaaacaatggcagaaaccttcaacgtcgtggtggagatcccgcgcggttccaagaacaagtacgaagtggatcacgagaccggtcgcgtgttcctggaccgtaccctgttcacctccatgggctacccggatgactacggctacatcgacggtaccctgggcgaggacggcgatccgctcgatgccctggtcatgattccgaactccgtgttcccgggctgcgtggttgagtgccgcgccgtcggcctgtatcacatggtcgacgaggccggtggagacgacaaggtgctgtgcgtgccggccgacgtccgcttcgacgacatcaaggacgtcgacgacgtgtccgagtaccacaaggctgaaatcaagcacttcttcgagcagtacaaggctctggagccgggcaaggaagtcaagccgggcgactactggaccggtgccgctaaggccgaggaggaaatcgtcgcagcccgcaagcgcctcgctgaggcgtgaagctgacagcgcggtgcgctgtcagtagccgaagtgagcagctatgcggcgaagccgcatgcgcagcatgcggaagcgagaagtgagtcgaaataattccgactcgacgatagacgataacaagccgctcttgtttcaagggcggcttgtgcgttatagtggtggcttgtaatttacggcatgcgaacagtattcgctgaattcaaagcctgcgggacaccatcgatccgcgtgcggcagttctgtgtcggtactcctaggcgtaggcggaacgcaatccgtcgaggcccatcccgtggggagaccggcgggatgaaccttttcaccagctatgctcattcagattctgcttattggcgtgtccgtgtccatggacacgttcgccgtctccatcggcaaaggcctgaccgtcaagaagctgcgcggtctggacgcgctcaaaaccgccctgtggttcggcggattccaggcgctgttcccgctgctgggctatttcgcggccagcacgttcagcaaatacgtgaccgccgtggaccattggatcattttcggcctgctcgccctaatcggcggcaatatggtacgcgaggcgttcgaagaggacgaggagaacgccaaggaaacccctgaattcgattggaagcacatgctgccgctcgccgtggcctgcagcatcgacgcagtcgcggtcggcgtgagcttcgctttcatgacgctcaacatctggctgtcggtggtcatcatcggcatcaccaccggcctgttctccgccgccggcctgtatatcggccgcgtgttcggctcgcgttggcagaagccggcgcagatcgcaggcggcgtcgtgctgatcctcatcggcctgaaagtgctgttcgaacatctcggcttcctcggctgacgctacagcccacagcagcgcacgcagcgcaacggaaaagcccgcaatcgcaatgattacgggctttttaaatacgtgaattatggcgattacgcaaccgccaaatcgtcagaacgtcacgacggcgagcgcggcgatgcctaccacggcaccggcgatcatgaccggcagtatcgcgatgccgatccacggatcgcgcgcggtcggttcggggtcggcgtcgcgatgccagaagtacgagcagacggcgagcgccacgatcaccagcagcgccacgacgaacgcgaccgtgccgatcgccttcagtaccgtcggcaggaagcaccagcctgcgctggcgatcatcgcaacgccttcgaccacgctgtgcgacagcgagcggatgaggtgcgtgcggttttcgcgggccatctggcgtccgaaggagatcacgatcagcaggatcagcaggccgccgacgccggcgatccagccgtcctccatggagaagtccttgccgccggtcgcgtcggcggcgaaaatcgcccgtccgagcgtcatcgtcgtggcgcacaccaccgacagcaggccggcgatgacggcgatcacgtgtccggcggtgccgtcgcggaacgggctgaacactaccagcagcgcgatcatcgccagcgatccgatgatgatgaacggcaccacggcgggattggcggaatcgccgtatgcgatgccgggaacgagcgcgagcgccaccaataccacgtacgcgacgatctggatcgccaatactttgccgaaagcgaccttcgacgggttttgctgggaaacggcctgcggagcggtcatctcggaccccctttttatattgtggtcaatacgtatgcaatatgaataaatgtagccgtatgtgtccacatacttcagttacaatcgatgaaacgccgataatacattttgcgtgtacaatcgcggcatcagtttagaacaaaagggagctgacgtgacggatcttacgcttatgacgttcgctagcgatccagctaccgttctcccctcgttggcgctgctttcccaccgcgtgcgcgtgttgccgatggatgcggccagcctggtgaaaatgccggagaacaccattctgtttcttgatgcgcgtgacgacctggccaccgccaaaacgctgtgccgtctgattcacgcgtcgggactgtccacgccgatcgtgctcattctcaccgagggcggcttcaccgtggtcaattcgcagtggggcattgccgatgtggtggtggctacggcgtcccccgccgaggtggaggggcgtttgcgcctggtttccgaacgtggcaacgcgccggtcaacgcggcgtccggttcgggcgagcagggcgtgcagaacgaggatggtctgatccgttccggcgatttggtggtggatacgaatggctatacggccagtctgcacggccatccgatcgacttggcgtacaaggagttcgagctgctcaagtatctggtgcagcatccgggccgcgtgttcacgcgcgcgcagctgctgcaggaggtgtggggctacgactattacggcggcacccgcactgtggacgtgcatatccgtcgtctgcgcgccaagctgggcggcgagtacgagcatctcatcggcaccgtgcgcaacgtcggctatcgtttcgatccgccggaagaggatgagcatgaggccgcggccaaggatgcggctcacggcgagtccggcgaaagctgactttttcttgcgatcattccgttgatgttcgacgggtttcgtttgttttcgttggcctttcgctgatttcctgttgttttttgctgatttcctgttgttttttgctgattttctgtcgttttttcgatggattttcgctgtttttgccgattgcgacgtttccgcaggtttcccgcgttcgtccgcatgcgaggggtaggctgggaggcatgcctcgggaatcgaagaaggcgcggatcgcgcgcatgcatcaggaatacgagcagttgtgcgtggagattcccgatccgaaatgcgcgttgaacttcaattctcctttcgaactgctggtggctacggtgttgagcgcgcagaccaccgacaagcgcgtgaacatggtcacgccggaactgttcggcgaatatcccggtccggcggagcttgccgccgcgaatcccgagcacgtcgaggacatcatccgcaccatcggcttcttccgtacgaaagcgcgcaatatcatcgggctgtcgcatgagttgtgcgtgcgattcgggggcgaggtgccggccgatatggcttcgctggtcagcctgccgggcgtgggccgcaaaaccgcgaacgtggtgttgggcaacgcgttcggcgtgcccggttttcctgtggacacgcatgtgattcgtgtgactgggcgattgcggtggcggtccgactgggcgagcccctcccctgacccggtggccatcgaacgtgaggtcaccgcctgcttccctcccgaagaatggaccgatctgtctcaccgtttgatattgcatggccgtgccatctgccatgcgcgaaaaccggattgcgccgactgccccctcaacgacacgtgtccgggcgcgttcgccgcgtgattccgacgcatgccagccgccacgccggcactccgtcgaatcgcacccggccatcgggcgtgtagcacgcgtcaactagactcgggtgcatggatgaaaacgggcggaaacgtaatctgaaagccgaggcgacgcgctggctgatcttcttcggcgtcgcgatcgtgctcagtgtgctgctgtggctgggactgtcgctgacaggccgcaagaatcccatcacatccttcgacacgctcgtctccgactcgtcggtgaccgtcggtatcgaaggcgacgcgccgaaatcgcttgacatccgcaccgaacaaggcaccgccgtggagcaagcgctgctcggcaacgtatacgaaacgctggtgtcacgtagcgaaaccaacaagctgcagccgggaatcgccagctcctggcaggcttccgacgacggtctcacgtacacgttcacgttgaacggcggcatgacgttcgccaatgggcacaaactcgactcgtccgacgtggtctggtcgctgcagaacgccgtcaacaaccattacgtgggagccgaccagcttggtgatctgaaggaaatcaccaatcccaatgcgaatacggtggtcatcacgctcgccaagccgaatccgcggctgttgcgcgcgctggccggccgtgcaggcatcgtgtacgacgcggaaagcaaaaccaactatgcgaaatcagcggtcggatcgggaccattcaccgtgtcaaccgcggaccaatcgcaaatcgtgctgcaacgcaacgactcgtattggggcaaaaaagccgcatcatcgcaagtgacgctctactactacgccaacgaggaatccatggccgatgccatgaaagccggcaaaatcagcatggcgctgccgctgagcgcttcaaccgcctcggaactgggcaaaaccaacggtattaccgcggacagcggcatcagcttcgacaaggtgatgctcgcgttcaacaacgacaacaacagccccttctccgacgagcagatccgcaagatgacgcgatacgccatcgatgcgaagaccatcgccaagaacgcgcccgacgcgtacgcgccgctgggagggccgatcagcccgctggaagacgggtatgaggacctgagcggcctgtacccctacaaccttgaacaggggcaacggatgcgcacgtatttcggagtgaactacatcgcgccaatcgacattctggtgccgaaggaatacgaaagcatcggcaacgacgtgaaaaccgccatcgaaaacctcaatatcaacaccaatctggaagtgctcgattccgccgcggacgtgacggaacgcatgaacgccggcacctataacatcgcgctgaccaccatgagcgacgaaggtgacgcaagcgtcttcgacaacggccagtccgtgttccatttcgagaacggcgacgcgcagcaggcttacgccaatgccatggccgcgaccaacgacaacgattatcaggcccgcatgcgcgattacgcgcgcgccgtcagcgaaaacgcggccagcgactggctgtacacgcgcaagaacttccttgccgtttccgatgggctgcaggggtatccgaagaatctgaccgatcgtctgctgccgttgaacagattgacgctgcactgatttttccacggttttttatgtggattttccgcgatttgcctgcgattccggcattcggttcgataggcgctgatacgacggcagttgtcacattcgctttctagactagcgactatgactgaaagccaagataacaccatcaacgcgaacctcacgccgctgcccgacaaggtcggcgtggacggtctcgaagacaagtggcgcggagtctgggacgagagcggagtctacaagttccagggcacccgcgaccgtaaggccgtttattccatcgataccccgccgcccaccgtttcgggccacctgcacgtcggccacgtgttctcctacacgcacaccgatgtgatcgcacgtttcaagcgcatgaacggctacgacgtgttctacccgatgggctgggacgacaacggcctgccgaccgaacgccgtgtgcagaactattacggcgtgcgcgtggatacgtccctgaagtacgatccgaatttcgtgccgccgttcgagggtacggacggcaagaagatcgacgccaaggaccaggtgccgatctcccgtaagaacttcatcgagctgtgcgagaagctcaccgcccaggacgagaagcagttcgaggcgctgtggcgctccctcggcctgtccatcgactggtcgcagacctaccacaccatcggcaagcatccgcagcgcgtggcccagaaggcgttcctgcgcaacctggcccgtggcgaagcgtatcagaaggacgctccgggtctgtgggacgtgacgttccagaccgcagtggcccaggccgaactggaatcgcgcgaatatccgggcttctaccacaaggtggcgttccgtttcgaagacggcaccccgatctatatcgagaccacccgtccggaactgctggccgcctgcggcgcgctgatcgcgcacccggacgacgagcgttacaagcagtatttcggccagtacgtctactccccgctgttccacgtgaaggtgccgattctggcgcataaggcggcggaaatggacaagggcgccggcatcgccatgtgctgtacgttcggcgacgtcaccgacgtcgaatggtggcgcgatctgaacctgccgctgcgttccatcatccagcgcaacggccgcatcgtcatggacaccccggattggatcgaatccgaggaaggcaagcgtatcttccaggagaccgcgggcaagaccacgttctccgcacgtaaggtcatcgtcgacgagctgcgcgctgccggcgatctggacggcgagccgaccccgaccaagcgtatgacgaacttctacgagaagggcgacaagccgctcgaaatcgtcacctcccgccagtggtacctgaagaacggcggcaccgacgagaagctgaacgccgagctcatcgcacgcggcaaggaactgaacttccacccggacttcatgcgcgtgcgttacgagaattgggtgcacggcctcaacggcgattggctgatctcccgtcagcgcttcttcggcgttccgttcccgctgtggtacccggtgaaggaggatggcaccgccgattacgaccatccgatcaccccgagcgaggaccgtctgccgatcgacccgaccgacgatgtgccggaaggctacaccgaggatcagcgtgacgtgccgggtggcttcaccgccgagccggacatcatggacacctgggcgacttcgtcgctcaccccgcagatcgtgacccgttgggaggagccgggcgaagagaaccaggccattttcaacgccaccttcccgatggacctgcgtccgcagggtcaggacatcatccgtacctggctgttctccaccatggaccgcgcgcacttggagaacaagtgcctgccgtggtccaacaccacgctgtcgggctggatcctcgatccggaccacaagaagatgtcgaagtccaagggcaacgtggtcgtgccggacaagccgatcaagcagttcggcgccgacgcggtgcgttactgggccgcggccgcacgtctgggcctggacgccacgtacgacgaaggccagatgaagatcggccgtcgtcttgccatcaagctgctcaacgccaccaagttcgcgctggccatcggccgtgaggacgagaaccatcacgtgggcgctccggcagtcgccgcatggaacccggccgacgtgaccgagccgatcgaccgttccgcgatgtccaagatggccgccgtggtccgcgaagccaccgacgatctcaacaactacgagcattccaaggctctggaagtcatcgagaactacttctggcagttctgcgacgactacatcgagctggtcaagaaccgcgcctacggcaccgccgattccaccggcaacgtgccgagcgaggccgcggtgaagtccgcacgcaccacgctgggcctgggtcttgatgcgttcgcgcgcctgctggccccgtacctgccgtatgccaccgaagaagtgtggagctggatgcatgagggcgaaggctccgtgcaccgcgcagcatggcctgtggccgacgtgtacgcggccgccgccggcgacgcatccgccgatctgcttgctcatgccggtgaggctctggccgcgctgcgtggcatcaagtcgaaggccaaggtttcgatgaagaccccaatcttgtctgtgacgcttgccgttgccgacgatgtgcgcgggtccatcgaggccgcgctgggcgatatcgccgaagctggtcgcgtgaccggaccgatcgccttcaccgcaccggctgccgccgagggtgaggacgaggccgccgatgtgacggtcgccgaaagcgagctaggcgaaccgccggccaagaaaccgaagaagtgagtctctgaggtgagccgccagcggcttttgtagcgcagccgctcacttcacccacatacgaggggcctttcctttgcatgaaggagaggcccctcgtatatcccgtcactgtctgcaaccaaccgtgcccccttttgctcatattcagtcaaaatcgcgggaaaaatgctttcgtgagcgaaaaggggtataaatcgcaggcaaaacggtcgaaatcatatccccttttgctcacgtccgtgcagaatcgccctaaatcgcaagacgtgcgcgcatagaaccgtccttatcccgttctcggctgttctcagcgtacattcctgccccctgcgcacaaacccgtacgcgaaaaatggtttttatgggcgtaatctcaacgaaggcacaagcggaggcggaaatcgcaatcaaaaaccccgaaacgtaccacgtaagcgacggagcactatcggatttagcgcatcgcacaaaccgcgtgctctacagcaccggaacggacaggaggtactgcgggccagcggacgaatttccggaaccgttcccacccaatccagcctgcagcgcatcgtcgaaaacttccgcagcggcggccaattcgaccgtctcgtcaatcaaatcgccattatccggcgtgaaaccggttttcgccaagccatagccggtaattggtagcgagctggcggacgaatccgccgaaccgtcggacgaatcgccaccgctgttcttcgaagagccgtccactcccccgactttcgccacattcttcgacgtggtgtccgctgcggcgccgaacgacgggcgtagtccgcccgcgtagctcatcacatcatccatgctgatggcgttcttgtcatcgaccaagctggtcgaatcggcggtgttgttcttcgcctgcgcgcgttcggccttgcgttgcgcacgggaccgccgtttctcggctttcgcgcacaacgattggctggcagaggcggaacgcaacgtgtccagcacagaagcgtcatcggcagcgcccgattcggacgtgtcgtcatccgaatccagctggtcggcgaatcgcagcacgatctggtggaatgcgctggcctgtccggtgtgctcgctggcgtccgccaacgcggtcatcgccgcggacaccttgtcggacgcggttttgagcttctcattgtctttgatgccgacacgcacgtcggcgatcgcctgggtttcgtagctgccagccgtgcctgcggtggcgcccagttccttaagccgagccgtgtatgcgtcggtgaaatccatcgaatacgggatcatggccgcggacagctgcgattggccggcactgtagtctttggagccgcgctgttgttcctcgccggcgcgcttggtgagctcgttcaccaagccggatgtgccacgctgttcgatggtgcgaatcacctcgtcgacggcgtcggccgcgccgatatgccggtatgcggcgctcacgtcgttgacggcgttggccaggtctgccacggatttagctacggaggtatcgccgttcagttcggacgcggtgccgagaatggcgggaagctgtgtggcgttgccgatcgaaccggacagatgcgtggtgtatgagcccacgtacgcgtcgatgtagccgtcgaacgcctgatcgtgcgctttggaacgtacggcgatggtctgtttggcaagcgctttctcgttgtctctgagctgttccagttgggcgatgagcttgcggttgcgttgcgagccgacgttggtcagaccgtccaccaaggtggttgcgcgcttggtcaggtcaggcagtgattgctgaacgttgccttccaccgcggcgatggacagtgagctcatggtgaagtgcttcgccgtcacgtaggcgttgaaggtcaggtcctcgcccggtttgccgaccgcagccaccagggtcgaggtgttgtcggatgagacgagcacgccgtcatcggcggtcacgtcactgccgacgcgtccgggaatggtgaaggcgacgattggcgtcagattggcggtcacgtcgggtttcgtggcatgcagggcgatgcgtatgccgatcatgccggaagcgccggaaacgtcggaaacgcttacgtcgggcccgttgagggtgaaggaggcggatattttccacggcaatgcgacaacgcctttgggaacgcgtttcgacgtggaggatccgctgttggtcaggaaaaggcggcctggtttgtcgatggaggtgtaggcgctcatcacgtcatcatgcgatgcatcggccgcgtactgcccattctgttgcaaggccgatatcgcgtcgttcacgccgactgccgcgacgggagcggcggtgatgacggcgaccgcgatcgccgcggcaagcgggcgtcgggcaccggatggacggttcgcggtggcgtggcgcatgccggacctctcaatcgcaatcgaaacaactttccaaggcatttaatgtagtgcccggcatgcccgtcggcaatggacgttcgcgcggggcgcgcggaaaacggacggctcaggcgaaaacgtcgagtacgcccgggtctcccccgttttcggcgatgcgcttgtggcggcgcttggcctcggtcaccacgaattcgcggtacatttcggcgatttccggatccagtccggcttcgtcggcaatgcgatgcagacgctcgatctgggcatgttcacgctggtaatcggccggcgcgaagcccgcacgcgccttgagcacacccacctgcgacgtgtatttgaaccgttccgccaacagcgagacgatggcggtgtcgacgttgtctatcgattggcgcagcgaggcgattttagccaccacatcggccacttcggggttgttctgcgcggtgcgcgcgtcgatgatggtttcggattcggtttcttcttctggccgaagccagtcatgttcgctgtcgctcatgggtataagcctaccgcgcaccctaccgcggcatctgccgaacagcggtcacttcgcgaagtaacgctgcagcacgatggtggtttcggtgctgaccgacaccgtgcgatggatgaggttcaacagctcttcgagcttgctgggcgattcgacgcgaacggtgagcatgaagctgggcgaaccggcgacggaatcgcaggacatgatgccgtcgatgtttttgagcttgtctggaatctcggcttcctgggagtaatcgatgggcgtgaccgcgatgtaggcgttcaccgcaaggccgcggcgctcgtcgtcgataaccgccttgtagccgcggatcacgccgcgacgctcaagcttctgcacgcgcgactgcacggcggacacggacaggcctgtcgcctcggaaaggtgggacagcgtggctcggccatccttttcaagcatgtcgaggattacgccatcggtcgcgtcgagctggctcgcaaccgtacgtgcgtctaccggaccattgtcactgttggtcattcataccccttttccaacaatccactgcaccggccgcaatcgaccgtccccactgcagttccatgttctttttcttccttaccatacccactaccgcgcacataccgtcgcggaatcgccgcagtttatccggacggcgcaacgctgtcatgaaatatctttgttttatttagctcatacccccatatcgaccatatatatttttcccatttatcttttctcgtcgtatttttacctattttttaattgacaacgttgtccaaaaagtggccaatttcacgaaattcgtcgaaacgtacgcataggaaaggggctacacggcgattgccatgcagcccctcaaaccttcagattcgcttgcagccgacgactcagttgccgttggtggcgttgccgctctgctggatgagcgacgccatgaaatcgcggttggtcgctgtcttcttcaggcgtggcacgagcgtctggtaggcctgttccggctcgaggccgcccagcaggcgacgcagacggtagatgattggcagttcctgcggatcggtgatgagctcctcgcggcgggtgccggaggcgttcacgtcgatggccgggaacaggcgcttgtcggcgagctcacggctcaggcgcagttccatgttgccggtgcccttgaattcctcgaagatcacctcgtccatcttggaaccggtttccaccagcgcggaggagatgatggtcagggagccgccgttttcgatgttgcgggcggcgccgaagaacttcttcggcgggtacagcgcctgcgcgtccacaccaccggacaggatgcggccggaggccggcgcggcgatgttgtaggcgcgggccagacgggtcatggagtcgagcagcaccaccacgtcctggccgagctccacgagacgcttggcgcgttcgatggccagttcggcgacggtggtgtggtcggaggccggacggtcgaaggtggaggagatgacctcgccctgcaccgtgcgttccatgtcggtgacttcctccggacgttcgtccacgaggacgaccatcaggtggacttccggattgttggtggcgatcgcgttggcgatgttctgcagggtgatggtcttgccggccttcggcggggacacgatcaggccacgctggcccttgccgatcggcgccacgatgtcgatgaggcggccggtgagcttgttcggcgtggtctcctgcttcaggcgttcctgcggatacagcggggtgagcttgctgaactgcggacgatgctgcgcttcctcgacgctcatgccgttgatggagtcgatggactgcagcggcacgaacttctgacgctggttgcgacgttcgccttcacgcggggcgcggatggagccgtgcacggcgtcgcccttgcgcaggccgtacttcttgacctggcccatggagacatacacgtcgttcggtcccggcaggtagccggacgtacgcacgaacgcgtaggagtcgagcacgtcgacgatgccggcgaccggcacgaggtcttccttcggctcgtcgcgatgctggtcgcggtcagcgcgatccatacgatcgttgcgctggtcgcggtcggcgttgcggtccatgcggtcggcgcgatcgttacggtcgttgcgatcattgcgatcgcccctgccgcgacgctcgtcacgctcgtcgtaatcgcggtcacggacacgcatacggcggccacggcgatcgttgcgtccacggctgtgacggtattcgttgtcttcggtctcgtcgcgacgcttatcatcgtcggcgtcttcctgcgacggcagcgtggcgaggatgtcatcaaggtcgcgcacgacgtcttcgttcttcggcccgtccgccacgcgacggcggcgacgcggctcgaaatcgtccctacggtcgtcatcacgacggcgacggcggtcatcctgcttcggagcggcatcgtcaaggcccagttcggcgagcaggtcggcgccggcttcggcgtcacgatggcgacgacgcttcggcgcttcatcgttcggcttcaacgcgtccaccgctgccacggcatccgcgacttcggaggattccgcggacttggcctgcttggcacggacggggcgttcctcctgcttggcttcatcggccttcttgtcctttgccgatttgacctcagcgtctgcggcgggagcggactttggcgcgcgcacggtgacgccggccggagcctggccgccggaacgggcggcttgaagtgttgcgatcagttcggtcttgcgcatggtggagacaccacgaagtcccatctgcttggcgagctccttgagctcgggcagtttcatatcatcgagattagggcttgttgccactggtagctgcctttccttggcttccacaggcatgcgcccgcgacagctgtaaaaaagaattgcggaaaatttccgtcgaatgaaaagtccgccgcgaaacatcgcggttttcgaactgtcctaaccatacaacgcaacccagaccaacgcaaagcgggcacgcgcggtccgcccgtgcggttcgcgcaccgcgcaatcgcaataaaaatcgcaatgaaaaagcccatgccaaaaagcatgggcttgatcaaagttacgctgcgaaaaataaataacgcgtgcgaagacgcccgtctgaggccgaaggcgtacaaaggtacgtcgagcgccggagaaagggcatatacgcacgcgttatttatttttctacttttcttcgtggtaggacttgtcagtgttgaccgaccacacgttgtctttcgacgtttcgccgctcttgatgtccttgacggcttcgatggcggtggccatggagtggtccatgttgttgtaacggtgctgtccgttacggccaacgcagtacaggttgccgaaggagtcgaggtagtcgacgagttcgggcatgcggtcgtaggtgtcgaagtaggccgggtaagccttcttgacgcgttcgcggtgggagtcgagcacgtcctgcgggccgttgatgacctgcatgcgggtgagctcctggatggcgaacttggtggcttcctcgtcggtcatgttccagaaggagtcgccttcctcgcagaagtattcgaggccgatccacacggtgttgtcgacgtccttgaccaggtacgggctccagttgttgaagatctgcagacggccgaccttgtagcccggatcctgcacgtaaatccagcaatccggcacgatcggcgggttgccgagggtcggaatgtcggtggtgttggtcaggcgcaggtgcttgacgagcaggccgacggtgacgaaatcgcggtacggcaggccgttggcgatttcggtcatatccttcggagccggatggtcggaggcgtccacggcgttgacaaggtccttgaccggcatggaggaaatgaagtcgtccgcggccatttcggtgcggttgccttcggaatcctcgtacacgacggatgcgatcttgccgtccttctggcgaatttccaccacattggcgtcggtgatgaccttcacgccggcggcttcgcagttggattcgacggtttcccacagctggcccgggccaagcttcggataccagaattcctcgatgagggaggtttcgacttcggagttgtcgcgcttcttcggcaggagcttctggaaggcgttcttcagcacgcccatgatgctcaggcccttgacgcgctgcgcaccccagtcggcggagatttcggacgggtgacggccccacagcttctcggtgtagccctcgaagaacatggagtagagcttacggccgaaacggttgatgtagaagttctccaggttggtttccggcagcttgtgcaccatggacttcaggtagctgaagccggcgaccatggtgagcttgaagcccatggccttcagggtgttggcgctcagggaaatcgggtagtcgaggaagtggcggttccagtagatgcgggacacgcggtggcgcttgagcatcaccttgtcttcgatttccggatccgggccgcccggctccatatcatgctcgcggtggagcttcttgtcatcatagctgggtgcgccctgcagcggcagaacgtccttccaccagtccatgatgcggtcgtccttcgagaagaagcggtggccgccgatatccatacgattgccgtcatgcttgacggtgcgggagatgccgccgaattcgcgggtggcttccagcacggtcacgtcgtactgttcggagccaccgtccttgacgagctcccaagcggcagtcaggccggcagggccgccaccgatgatgaccacggattgcttttgcgtcactttgaagtctccttacaaacaaaatcgaagatattctacccgaaggtagggaaacgcacagcgcacctgtgcgcatgcacacaaaatcaccgccaagtccgacagcaatcgccctgatagaaggaaaaccagccgtacggcttccgccgaagactggttttccgtaggtccgctacatgctgtcgggaatgtcgatgtcggttttctgcacttcctcgacgttcacgtccttgaacgtgacgatgcgcacgttcttgacgaaacggctggaacggtagacgtcccacacccacgcgtcggtcagccgcacgtcgaagtagacgtcctggccggcggaacgcacgttgaaatcgaccttattggccagatagaagcggcgctcggtctccacaacgtaggtgaacagtttgatgacgtcgcggtattccttgtatagggacagctcggcgtcggtttcgtagttgtcgaggtcctcggcgctcatcgtctgccttccgtgtcgcgcttgcggccacgtccaagcgtgcgccaccaagcatccttcgaggttttgcgctcatccgagctgtacggccagttgttgtcggcatcgccggccttctggtccgtcttcgccgttccggatgcttcgttcggctgcgattcctgcgatggcgcggcagacgtctcgtcggcggaggtctgcgccgtgtctccactctggcctgccgctgcggcatcgtccgcatcgcccttatgtacggagttgagttggatggcgatcgagtgttcgcgggcgctcaacgcctccttgacgcccggattgtcttcgatcacgtgcatgccgaacgcgtcgagcgagcggatcgggtcgaattcgtcgacgagcgtgtccatgacgatgaggtcctggtaacggttctccgacgcgttccacagggcatcgcgcgaacggccggacggcacgaagccgagcgactggtagacggatacggaacgcgtgttctgttccggcacggccacccaaatgcggtgcatgccgaggcccgccggttccggcgcgaagccgtacgtcatcacgcggggcatgatgtctcgcgagtagccgcggccgcggtagtccttgccgagcaccacttggatgcgggcggaacgtgcccagccgtcgatgtcgatgaggaagatcatgccgatcacgttgtcggaagaggccgcgtcaagctcgccgtcgccgtcatggtcggtttcggtgacgatggaccatgcgatggtacgacgagattccggatcccccacgccggattcgttcgatttttcgccattggaccatgccacggaacgacgcacccacgcgttcacagcgccacgttcggccacgcggtccttgccggtgatgccggatgcgccgacgtacgcctcaatgacctccatgcgtgcgatgtcgtcgatggtggcggggcgcaagtgcaccatctcgcccttgatgggcggaatgacgatgcgttccggcagctccctcgcccgctggtccgtcgtctgttccttcgctgtggtttcagcgtactctgacatgattatcgtttcctatgtttctcggcgcggtccctcgccgcacccataccgacggtattgtacccgactgaacgccagctgggagttttgttaggcaaaatccccgtgaaacctccccagccgacgcgtgaatcgtacgaaaaggcatgtaaaagcagataaaaagcaacaaaatgcagaaaggcgtgcgtttttacgattcctctcatcgcaaaaacgcacgcctttcgatgccatcaatcaggcaacgttcggcaatcgccggaatgtcacttgatcttgcccatcacgatcttggtgacggccttcgcgtcggcctggccgcgggtggcgcgcatgacagcgccgataatcgcgcccatcggcttcatgttgccgctcttgagcttctcgacgatgtccgggttggccgcgagtgcctcgtcgacggccttttcgagcgcgccgtcgtcggaaacgacctggaagccgtgcttcttgacgacctcgtccggagtgccttcgccggcgagcacgcctgcgacggtctgcttggcgagcttgtcgttgagcttgccgtcggcgatgagcttctcgacctcggcgacgtcggccggggtgatcggcagctcttcaaggctcacgcccttgttgttggcttcgcgggacagctcgcccagccaccacttcttggcgcccgaggcggaagcgccggccttgacggtgtcctcgagcaggtccagagcgtcggcgttgagcacgtcgcgcatctccagatcgttgaagccccactcgcccttcaggcggttgcggcgctcacgaggcatttccggcatctgggccttcatctcctcgatgtgctccttggtgatgtgcagcatcaccagatccggatccgggaagtaacggtagtcgtcggcgtcggacttcacgcggccgccggcggtggtctgcgaggcctcgtcccagtgacgggtctcctgcagaatctcgccgccttcggaaaggatggcggcctgacggcggatctcgtactggatagtcttctcgatgccacggaacgagttcacgttcttggtttcggaacgggtgccgaacggatcggacgggctgttgcgcagcgacacgttcacgtcggcacgcatgttgccctgctccatgcgggcatgggagatgttcagcgcacgcacgatgtcgcggatggcgcgcatgtaggcgcctgcgatttcgggggcgcggtctcctgcgccttcgatcggcttggtcacgatttcgatcagcggcacgccggcgcggttgtagtcgaccagcgagtggtcggcgccttcgatacggccgtcagcgccaccgacgtgggtgttcttgccggcgtcgtcttcgatgtgggcgcgctcgatcggcacacggaagatggtgccgtcctcaagctccacgtcgaggtagccgttgccgttggtcggcttgtcatactgcgagatctggtaatcgcgcggcatgtccgggtagaagtagttcttacgggcgaactggctccattcggcgatttcgcagtgcagggcgagacccagcttgatcgcgtaatcgacggcggtcttgttgaccaccggcagggagcccggcaggccgaggctcaccggggtgagctgggtgttcggctcgccgccgaagtggacttcggccgggcagaacagcttcgtggtggtggacagctccacgtgggtttccagaccgatgaccgggtcgaacttcttgacggcatcggcgtacttcatcaacttttcagccattttgttttctttcctccgatgcttcctacttgtccagtccgtcgagccacggggtcttcagggactgccagatcgggccgttccagctttcctcgagggccgcttcgagagcggcggcgggcttgtacatgacctcgtcgcgctgctgcggggcgaggaactggaagccgaccggcaggccgtcgtcgctcaggccggccgggatgctcattgccggcacgccggcgaggttggccggaatggtggtgatgtcgatggcgtacatggccatcgggtcctcggtcttctcgccgaacttgaaggcggtgaccgggctggtcgggccgacgagcacgtcgaccttttcgaaggccttcttgaagtcgtcgatgatcagggtgcggactttctgcgcggagccgtaccaggcatcgtagtagccggcggacagggcgtaggtgccgaggatgatacgacgcttgacttcgtcgccgaagccggcctcacgggtgtaggccatcatgttggccgcggtctgcggaacgcctgccggcggcatgacgcgcaggccgtagcgcatgccatcgtaacgggccaggttggagctgacctcggacggcatgatgatgtagtaggcgccgagggagtacggcaggtgcggcagggacacttcgatgacctccgcgcccatttcctcaagcttcttgacgccttcgttgaagcgggccatgacgcccggctggaagccttcgccgccgagctccttgatcaggccgaccttgaggcccttcagatcgcgcttcatgccttcgcgggcggcggcgaccatcggacgcgggccttccggaatggaggtggaatcgcgcttgtcgtgtccgccgatcacttcctgcagcagggccgagtcgagcaccgtacgggagcacgggccgatctggtcgagcgaggaggccatggcgatcgcgccaaaacgggagacgccgccgtaggtcggcttgacgccgacggtaccggtcagcgagcccggctggcggatggagccgccggtgtcggtacccagggcgagcggagcttcgaatgcggccactgcggctgcggaaccgccgccggaaccgcccggcacgcgctcggtatcccacggattgtgggtggtctggtaggcggagtgctcggtggaggagccttgcgcgaattcatcgaggttggtcttgcccaacagcggcatgcccgcggccttgagcttctcgatgacggtggcgtcgtacggcggcacccagccttcgaggatcttggatgcggcggtggtttcgatgcccttggtgacgatcatgtccttgatggcgattggcacgccggcgagttccggcatctgcgacttgtcctcatcggacttggcgtcgaaggcgtcggcctgttcgagggcctggtcggcggagaccttcaggaaggccttgacgctcggttcggcggattcgatgaccgcaaggtgggcttcgaccagctcacggctggaaacttccttggccttgatcttggccgccatctcggcggcggaaagcttgacgagttcggtggtgctcatatcactcctgtcccagaatgcgcggtgcgacgaacatgccggcctcggagaccggggcgcctgcggtggcttcggcctgggtcagcggggtctcgggtacgtccggacgcaggtaggcttccagcgggaccgggttcgcggtcggttccacgtcgtcggtggcgacttcctggaccttgttgatggattcggcgatgacgttcagatcgccctgcagacgggtgatttcctcgtccgtgagtgcgattcgggccagatcgcccaaatgcacgatttcttctttggtgaaagtaggcatgaccctaacagtaacgcgtctgtgtgacgagcgtgtgccctatttcgtgccccgttcgcaacccggccgcgactggccgccatccgttcgacggccgttccgtcgcctggtcggcgagcacgcatccgctattgcggcaaagcgacgcttaacggcttttcttgccgcgtgccgatggcgcgatcaggcgtgcggcgcggcgtgctgggcgatccaggcgtgcatggagaccgcggcggcggcgccggcgttgatggaacggaccgagccgaattgggagatgtagaccacgtcatcggccagttcgagcgctttttcggacaggcccgggccttccgcgccgaaaagcatgaggcagcgtttggggaaatggtaggtttccatgggcaccgcgccgggaatgatgtcgagcgcgatgacgcgggcggcttgcagttctgctattttcgcgtccaaggcttccagttgggccatggtttcgcttgtgttcggggcagtgccggaagtgccgtccgtcgcggctgcggagccacgcatatggaaggcgatggcggcggcttgcgattgggcggcggcgatttcgccggcgatgcgcagtttccaacattcgacgagttccgttatggatggatggttttcgacgtgctggtacagctccgtcatgagcgcgcccttgcgattccatttgtgcgggccgacgatgtgcacgcggcgcgcttggaacgcgttggcggtgcgcaccatggagccgatgttgaaatcgtgggtccagttctccacggcgacttcgaaatcgtggcgcccgcgggagtccaggtcggctttgatggccgcgaccgtccagtagcggtagcggtcgagcacgttgcggcggtcgccttcgtcgagcagggtggagtcgaagcggatgtcgtaattgggggatgacgcatcgtccgggcgtggttcgcctggatgggtttgcgaccacggtcctacgccgacctcgcggaacgtcggttcgccggatgcctgtgcggcaacatcgatgggattgggatcgtgcacgttctccccttcataggaacagcaatacaaatatgtcaaaggcccgcgcatccgtatgcatcatcatgcttgtcatcgcacattcgacgacgtcaacggcagatatgtttgcggtcggtcggcgggaaactcggtgttcagtggagttcggattccttgaacacttcgacgaacggcagttcggattcctccgaagtgaccgggttgatgaccttgatggtcgggtcgaccatgtcgacaccgccgatcagcgaggcaacggccagcactttggcgccttcgttctccaccacggagaagtcgaggctcagctcgttgccgttgcgcagggtgaccagcgatgaggtctgcacatacgatttttcagacagccaggagtcgatcagcaccacgcgtttgccggcaatcgacggacccttgatggacggatagacgaagtccatgacgaaaccgtccaaatcctcaccacgggaggcggcggcctggatcatggcggagaccagcggcacggccgcggcggtcaatgcgccgaccgcgtcgaaatcgtcgacggaatagccggcttcctccaacgtgtcgagcaggatatggccgacgatggaggctccacgatggtcgaacagcacggaggagagttccgagaaaggcttgtccttcatttcggcctgcagcagcgtcttgagctggtcgcgaggttcgagcatggcgaaatcgacggtggattccgtcgaagcggaaacagactggcccgcagcggaatcatgcgtcggaaccggtgtcgtcttgcggaaagtgttctcttcggtcatggttccagcctatcctttcggctcgtcattcaccgtgcggtatgggtgatttatgagcgataaacatggttattcggcgttggtctcgggagcggacaactcgcggatatcccctttttcgggcgcgatcatgtcgacggtgccgatgaccttgctttggtcgacgcgttgcagtttgcgcgcggtgaccagcacgcgcgattcgagcgacgcggcgaacgagttgtatgcgccgaccgttttggtgatggcggaacccagtttggtggcccgctcccccaatactgcaaaccgttcgtacagctctcgggacaggtcgaacagcattttcgcgtcatcggtcaggctttgctgctgccatgcgtatgccacggatttgagcaccgcccatagggtgatcggcgaggtcagcgcgactttctgcgcgaatgcgtcgtccatcagtgtcgggtcggtttccaatgcggcctgcagcaacgattcgttggggatgaacgcgatcacgaaatccggagcatcgctgaacgcgttccagtaggctttgtctcccagggtcttcacatggtctcgtaccgctttggcatgggaatgcagcagctcgttcttgcgggccagttcctccggtgaggcggtgtctggaatctcgcatgcgcgctggtagtcggcgtatggcgctttcgcgtcgatcggaatggttttgccgcccggcatgtggatgatcatatccggccgttgcgtatgtccatcggcgtcggtgaccacaacctgggtgtcgaaatcgacatgttccaacagacccgccgattccacgatgttgcgcagctgcgcctcgccccacgcgccacgcaccttgttgttgcgcaatgccgatgatagggcgctcgtctcgcgatccaatcgcgcctgctgttcgccaagacctttgagctgttcgccgagcgctcccatctcatgtttgcggccctcttcgatttgcgcgacctttgtctgcagggcgtcgaggttcttctgcaccggagccagtgcggagagcaccttgctttgctcctgcagtttccgttcgctttcggcttgatgacggttcgcttcttcggcggcacgctgccgttcacgttccacgcgcatttcctcggcacgctgggcctgagccaattgcgatttgagatacgtcagctgttggctgaatccttccgcctgcgtacggtattgcacaacagccgcgttgagattgctgatgtcctgtttgtccgcctcgatctgcgccttcgcctcgttcaggtcggattccttcgcgccacgggccatatcctgccctttggcacggcccgcgaagaagcccgcagccgctccgagcgcggccatgatcaccagcaatatcactacaaacacaggattatcgaacatacgttcgatggtatcacgtcgtcaggaacacatcaatccacgcatccacattcattcgcaagaccgaccgcatgccacacaaccgtgcactatgctgaaatcagccgaacgcgaaatgcatcagcccaacacgaagggacattatgggattcgatctgtttttggcggccgtgtcgattgtggccgcatccatcgccacctgggcgttgttgcggctgtttccaagctcggacgcacgccaggcgattccgctgcggacggacggcggatttgccgacccatcccacacaaccgacggtggagtgacgatagacggcaaagtgacggcagacggcgaatcgacatccgacatcgacggacaacccaccgaccacctcggcaagcgcctcgtcatcgcgcttatcctgaccattccaacgttcgtcatcacattactggcgctggccaaaatcgccatgccgggctggctgacgaatccgtggccgcacgccatcgtcatcacgccggtcatgttctattgcgcggcgccgattcaccaccgcggcctgcccgcattgcagcggcgacgtccgaacggcgattcgctggtttcgcttggcatggcgattgtttacgcgtacagcctgctgctgtgcgtggtgtcgtggattttcccggccggctcgcgcgatccgtatttcgcgttcgtcggcgtggtcgcgacgctttcgctggctggcacgcttgtccggcaacacgcgatgaccgcgcagcagacggcagaaacagaaaaggcgcaatcggcacagtcaacagaatcaacagaatcggcgcgatctcaagcgaaatcccctgagccaacgcaagaaaaaagcgcggaagaattgctcttccgcgctgtggtaggtcatgagatccgcgcacgtgtgctgcagatcaccacgtcggtgacgatggtggtcgcggtgtggacgtgcgcgttgtggctggcgttcggcatgcaaccgaagctggcgatcgccatactgctcggttcgaccgtgctgtcggtcgcaggcctggtattgcaggcttacgaccgacaggtaaccaatcgataatcgtcactcagccgggttcgggacgtcggcggaatcgtccgtcttcccctcgcccatatcctccagctggtccgcggcccacgcggacagctccaggtggtcgccgccggtctggtccaccagcacggtgtcgccgtcgtgcacttcgccggccagcagcatgcgggcaagctggtcgccgacttcggtctgcaccaggcgacgcagcggacgtgcgccgtacgccggatcgtaaccggtgttggcaagccattcgcgcgccgaatcggtcacgtcgagcgtgatgcggcggtcggtcagacgtgcggacacctgcgcgacctgaatgtccacgatgccgccgagctcctcgcgggtcagcgggtggaacatgaccagttcgtccagacggttgatgaattccggcttgaactgcatgtgcacggcgtccatcacggccttcttcttggcgtccgcgtccatgtcgggattgacgaggaactgcgagcccaggttggaggtcatgatcagaatcgtgttcttgaagtccacggtcctgccctggccgtcggtcaggcgaccgtcgtcaagcacctgcagcagcacgtcgaagacttccggattggccttctccacctcgtcgaacagcaccaccgaatacggacggcgacgcacggcttcggtaagctggccaccctcttcgtagccgatgtagcccggcgcggcgccgatcaggcgggacacggaggccttctccatgtattcgctcatgtcgatgcgcaccatggccttctcgtcatcgaataggaagtcggcgagcgccttggccagttcggtcttgcccacgccggtggggccgaggaacaggaacgatccggtcggacggttcgggtcggagatgccggcacgcgagcgacgcacggcgtcggaaaccgcttggatggcttccttctggccgatcacacgcttgccgaggtactcctccatgtgcaggagcttctcgttttcgccctgcataagacggcccacggggatgccggtccagtcggagacgatttcggcgatggagtcggcgtcgacgcggtcggggaccatcggcacgtcggcgttggcattgtcggctccgcccgattccgcctcgttcttctcggcttgggcgatttccttctggatggccgggatttcgccgtagttgatggctgacgatttcgccaggtcgccttcgcgctcgtacttttcggcttgcgtacgcagctcgtcgagcttcttgcgcaggtcgccgatacggttgtggccgttcttttcggcgtcccaacgcgctttcagcccgttgagcttttcgcttttgtcggcgatttcctggttcaaatcggcgagacggtccttggcgctgtcgtccagttccgcttcggccttttccgtggccttgtcgttcttcggattgcccagcaggtacgacttctccatcttgagacggtccacctggcggcgcagttcgtcgatttcctcaggcgaggagtcgagttccatgcgcaggtgcgctgcggcctcgtccaccagatcgatggccttgtccggcagctggcgtccggaaatgtagcggttcgacagggttgccgccgcgaccagcgcgtcgtcgccgatggtcaccttgtggtgggcctcatacttcggcgcgatgccgcgcaggatggcgacggtgtcctccacgctcggctcgccgacgaacacctgctggaaacgacgttcgagcgccggatccttttcgatgttctcacggtattcgtccagtgtggtggcgccgatcaggcgcagttcgccacgggccagcatgggcttgagcatattgcccgcgtccatggagccttcggccgcgcccgcgccgacgatggtgtggatctcgtcgatgaaggtgatgatctgcccgtcggccttcttgatctcctcaagcacgctcttcagacgttcctcgaattcgccacggtacttggaaccagccaccatggagcccaggtcaagcgagataagcttcttgttctgcagggtggtcggcacgtcgccggcgacgatgcgctgcgccaggccttcgacgacggcggttttgccgacgccaggctcgccgatcagcacaggattgttcttggtacggcgggacaggatctggatgacgcggcggatttcctggtcgcggccgatcaccgggtcgagcttgccttccttcgcggcggccgtcaaatcggtggagtacttctccaaagctttatacgagccttccgcgtcggcgctggtcaccttgcggtcgctgccgcgcgcggcggtcagggcgttacgcagcttatccgcggtaagaccgttcttttccaagatgtccgcgctttgattaggtttcgcggccgcgattgcgaccagcatgaggtcgacggtgacgtactcgtctcccctccgttgcatttctttttcggcttgcgatagcaccgccgacagctgcctgctgacgtccggctgcgttgtggtcgatccgctggcgctcggcagcgattgcatcgcctgatgcacttcggcgctcacgttttgcgcgttgccgcctgccgcttcgatgagcgcgcgggccatgctgttttcctgacgcagcatcgcgtccagcaggtgcagggtgtctacctgcggattgcccagcgccgccgcgttctgaacggcgtccgaaagcgcttcctgcgccatctgcgtgaacttctgttccatatcatcctccatggttcgcgcccggccgcccggccttcgctaccgggccggcgttcggacgcatatgtcgttgtctgatatgctcaaccgacttcatcgccattatattcccaaaacttgagtcccacacgctcaactttttgcgtttctcaaaaccgtctttcgacacaggacggcagtcaccgacaatcaccagcgctcaccggcaatcgcaatacatacgaaaaaggcgggcagcaacgtaacgaaatcacgaaacgttgcaaacccgcctaatccaaagtccgccagcaagccgaaaatcagccgcgcaccaccacgttgcgcagatcgccgatgccctcgacgtgcacgatcgcctcgtcacccggatccagatgacccgacgcgttcggcgtacccgtcataatcacatcgcccggcagcagcgtggtgaaactcgtaatcgccgcgatctgctcaggaatgccgtgaatcagattcgccgtggtacccgacgccatcggcacatcctcaccgttgagcgtgaaggaaatcttcgcatccttccaatccacatcgtcacgcgtcacaatccacggacccaacgggcacgccgtatcaaaacccttcgcacgcgtccacgtcggatcaaggccctgcagatcacgcaacgtcacatcattcacgcacgtgaaacccagcacataatccatggcctgctccaccggcacattcttggcgatacgacccatcaccacagccaactccggctcgaaattcatatcattcgaacacagcggaatcacaatcggatcatccggaccaatcaccgacgtgctcggcttggtgaaaatcaccatatcctccggcgcatgcttgatatcggaatgaccggcctcatgcatgaactgcgcatgcgcctcataattcttcgccaaaccgtacaccttcgacggaatcaccggagccagcagacgaatgccgtcaccatccaccggatagcgctcgccggtcggctcgacggcctggccggacagcggatagccgttcaaggccacaagatagtccttgccgtcgttcttgtcggtctgaacgaaggcgtactgcggtacatcattatgcgtaaaacgtgcgattctcatacccgcaagtctacccgctcgccacgcccgccgttctcgacatgcgtcgctttgcggacgatgccgattgctcgcattttttacgatttttgcgattatttgcgatgcagttccgcccgcaacgccgccacctcgcgttccagctcgtcgatgcggcgcacctgctgggcgatgagcaggtcgcgcacgtcacctcccgacagaatcgggacttcggctgcgttgcgcggcgcgggcagcgtcgcattgctttgcgtttccgtcgtttgcgttggctgcaccggctgcgataccgcagatcgagcaacctccgcagattccgccgacggcgccacatccgccgacgccgatggcaccactccaccattcccatcaaccgataccagccggtccgtgcccatacggcaggcaatcttgcgccagcgcgcgaaacaacgttcgatgcgcttatagccgatcagcgatgggtcgagtccggcttcgcggaacagttcgaccggcgattcgcccgcatggtaccggcgcatgcagttgtgtttgaacgattccgtgtaggtgatgcgtcgcgacgtcgcttcggccaccaccggcagcgagcgcagatattcgacttcttccggactgaacgctcccccaccgttgcacatgatgttccctttcggcttggcgtgcggcggctcccttccaccgcacggcagtcgaatggcctccgtcatgccattcccctgttcggcttgcgattcggtttgcgatacgtgcttgcgatacgtgtttgcgatgcaaggccgcaatccgattcgttgttcgcttcgtgttccatcataccggtacgaatggcgtttttccaaccatttcaggcggcactaaaccctaaatcacccgtattcgtcacaacaaaagcgggtgaaccgttgatcgctcaacgactcacccgcccgaacaagccccgttgcctgtctgctggcccgctcagaccgccatcggcgtatcggattcgcggaagcgcagcacgagcgccagtccggctccggccattaccagggccgcgatggtgaacaacgcggtgcccattgcgccggtgagcggcagctgcgtgacgttcttcacgttcttgacctggattgccttgtcggacatgccctcgtcaagcctgcttgccagaccgaggttgttggcgccgaccagcttgaaggtcgacttgccggtttcctggttcacagctagttcgacggtgaagatcggcacaaagttcttcgcatagccgctcgcgaatccggtttccttcagcgtgtacttgccggacttcaagcccatgattttcacgtcgccggtggtggtttccacatccgcgacagcgccgttctcgttcgcttcggcaaggcggtattcgccatccacaatcttgatgaacttgagcggggtctgcgaaacctcggttccctcgaacacgtggaacttcgctcctgcgagaccattggcatcgcttccgacaccgtacttgtggaaggagaagcccccggtataggagtcgaattcgaccggcgtgttccacacctcggtgtcacgggacacggccgccttgttggtaaccttgttgcccatgtcgatgatgtccttgtcgaccacggcggtgtaggtgatgaccagctggccgctcttgttggccaagtcgaatcccagcacggtggtggtcttgccgtcggctccaacggtcggaacggtcacgtaggtgaacggcatattcgtttccgtgccatccgcggctcgaacaacggccttgaagtccttgttgaccgtcaggcccttggatgccacgtccttcacgaagtacggatacttgtcgtagccttcggccgcgttcggaatatccagcgtgatggtgtaggcgacggtctgcccaatgctcacgccttcagtggtggtaatcgtatcggccgtcttgcccggctggtcgggctcgttctcgttcttggccacaaacatgccgacagcgttgatcttgccctggccggttgccggatcgcccttcactttgaatgtggcggccacgccgttcagcgtggtggcgacgatggcattggttccccgaccgccgtccttgtccacatcggtgatgagataccagccttcttcaagcgaaccgatggcagccgtaccgccgttgcctgcaacggttttgtcggcaacgacgccatcgccaaccgccaacgaggccgcgaatgtgcggaaccaggcggcgtcgttatcgccggtcttggttgcggcgaacgcggccggattgctgtcatattcggagggcatgctgacaacggggtccatgttgttgttggcggcggccaccgcgtcggtcaccgcagtcacccaatcggcgtcggtgtcgacctgcacggcgtcgccgtccaccgtcagcgaggcgaacttgtacgcggagtaagtgtgccccttctgcgaatgccgcacttcgatcgatgcgctgccggccgcatacgctccggcggtgccgaacgccataccgcccagcaacgttgccgccgcggcgattactgcacaaagccttctcgtcttcatgatgagagacctctcttccttggtttggtcggccttgttaccgcagccgattggttggttttatgggaagtttcgtatattgtgttgttctttagttgtgattgaaaaattgcgattgccggattgcgatcagagaattgcgattgccgtccggcagttccgtcacggccgtccgcgcccgatcaaagccagtccgacgatgcccgcaagcagcagcaccagtgccgtgacgccggccacgaccagccaggtccgtccttccgatgcgccggatagcggcagcacggccaccgtctctttcacgttggtgaacgaggcttcgtaggtggcggtctgtcccttgtcgaacgcgctccacatgtcggctctggtgatgctgatcggcactgaggtgacgttgcctttcgcgtgatagccggcgatgttgccttccgtgacggtgtagtcgcctgccatcacgccacggaatgtgtactgccattcgccggtaggcagctcgtcatcttcggaaaggtctttgcccagcttcgatgcgccgccctgcatgaaatcgatgcgcaatgtggttccactcgccggcattccgccttcccaatgtttcgtcacgaccacgttggcggacggcacctgcaatacgggatgctggtaggccgcgcaggcggactgcttgtcgaaggtgtaacagacctgcgccgacgcgttcgatcggaagcccggctttcctgcggaagtcgtgccggtgcccgcgtcgccggtcgcgtcgtagttgatgccgccgtcgaccgtattgacccgcgcgtaggcgctgtcggttggcactatgccgtacgagagcgtgtaggtcgcgttgtgcagcagctcgtaatcgccggcgaattcgacgcggatcttgccgttgccggcgtcgctgtaccacaatgtgtaatcacgttccagcactggaggcgtagcccccgaaggcagattcgtcacgttgagcgtcacgccgccggtcacccggcagtaggtcgctccgccgaagttccgcatgctggccatgttccagacaacgccatcgacctgcgcgtattcggacagctcgtcgacgatcgagacgccgctgtaggcgcttcccgtggtgatttccttctgaatgtcgtcgaagatcttcgtcaggtcgtcagcgctgttggtggccttgtagtagccgaggttgccgcccgtaacccaattggctttgtcgtacgcggtggcgttcggatagttgctggatacggcgtgcatgaactggttggcttggtcgttctccctgttaccgaacgattgctgctccggattggcgccttcgaagatgccgatgctgtagatgagcgtgccggccgatttcatggcgagcgcggttgtcacggcgtcattggcgactctcgtgctaaaagtgttttgcgtggtcggcacaccgtccgcgaagaaaatgacgattttcttcgcgcctggccttgcccgcagcaatgccgtctacgcggcggccatgcctttgtccgcaggggtcgcgccattggcggacagcctgctcaccgatgatttcagagcggcggtatcgctggtcagggaactcaccacgccggatgtctgcccgaattgagcgatggcgattcgcactttgctgttttcgtcctggatggtgtcgttggtggtctcggtggcgtcgatgaagctggtcgccgcttctttcagcgccgtcaaccgcttcggattcgatttgttgcatcttctttggcttccgtccatgcagtagttcatcgatccggacgtgtccagtacgagcaccacttcgattttctccgtggtctcatggctttcgcgggtatccttgcccaccacgttgaggttcagcgtgtatttgccgccgttgttgtatgtgatgcttttcgtgtggtccggctgcggcacggcgacgttacgcgcggcacgcatcacggttttgcgattgaaggtgaagcgatcgcgcatgatgtgttcgtcggcgtcggtatcgtctttggcagcatcattcttgtcgttatcgttgccgttttgagccgacgcggcatccttgtcggcgtcattcttaccgttcttgtcggcatcgtcggcatcttcagcagtgttgccatcgttgtcagcatcgtccgcatcgccggttttgccgtcatcggctgtcgcgcccgcatcgccattcgccacagcatccgtgcgattttcgccggcatggtcgtttcgatcgccgtcttgagccggtgcagcaccatttgcaggtacgtcagcgttctcagccgtcggctgcctaaccgcctgccgttcctgctccttctgctcattcggctgttccgtcttatcgcacggctgccgctgttccggcatcgtctccgacggttgttccggttgcgattgcgactgcagttgcgattgcgcttgttcgttcgatggctgatgcgattcgccgtcgtccgtaaggcattgtgcgtcgtcatcgtccgttgcggactgtccggcaacatcttgcccggcaatgtcggcaacgtccgatccgactgcgttttcagcatcggattgttgtgtcgattccggctggctcgctgcggattcggcggccacgttgccgccatccgtcaccgtttcgtcggcgaacgcggtcgcgccggctcccgtggtgccggccagcatcgcaatcgtgacaagcaatgcggtgaattttcccatccgcgcgccacaccggcttatgaagccggcaagcgggtccttcatccacttcatgacatgtccatctctcatggcgctgcggcgaattgcctatgcgcctccatgccttgaaccttatggatgaacgttttgaaacccgtcccctccattgatgggttcggggaacgtacggacccgcgaaaatcgcggccttcccccttatcctttacgcggccaggcgaaagcgtgccgcatgattcggtgtcggggccgcatcgaccgcacgaccatgcagcacaacagcatgccgcccatcgtgcaaacgatggtcatggcgagcgcgcccagttcggtcgcacgttcgtcgcgcacgtcggccggatctggcgcgggcagcggtattgcgacgcgatgcccggagactagcagccgatgcgtgttgatgccgtatggcgtgcaggtcatcaacgtcagccggtcttcgccgggcacgattttcaaccgtgagacgtcgtccggttcgatcacgctgattcggtccacttcgtatcccagcgtctcgtccatcactttgatgtacatgaaatcgccgtcgtgcagttcgtcgagccgtgtgaacatcaacgatttgaccaggccgcgatgcccggtgaccaccgtatgcgagtcagtgccgccgaccggcaggctggtgccgtacagatgccctgcgccgacggcgagcaccggttcggacgtaccatgccgaatcggcagttccacaccgattttgggcaccaataccgtgcccatgatgcctgcgccggaatccagcaggccctgatagttcgcgtccgtgtccgccgcggaaagcccggcaccgccggaatgtgccgaatcgtcggcggtatcagcatctccggaagtgccagccggtctggtagtgaacggatcggccgcctcgcccaataccggctgtccttccacggcaagccgccgattgtatgcgcgcgcccgttccaactcctccatcgccatcggatacggccatccggcaaccgtgcgagccgccgaatcggatgtctcggccaagcgccgcgcggaatgcgcatgcatggcgaacggcaacgacgcgaccaccaccgcgcccacaatcagcagcacggacacgcaccgcaccaatatgaaacgaatccgccgcagcctgcgcgcgcgaaccacatcggcaatgtcaatcgcctcgtaaaacgacggcgttccagcgaacgttccagcagacgttccagcgaacgcaacagttccggcatgaccactgtcggcagctgcatcggcatcagatccgactccggcgccattgccgatgccatcgttatcatcaccggcatcataggaatcagccgaggcgcccgccacggcaccgaacagccgcatgggcgaacgcagcacctcatgcgcatgcacgtaggaatccgtcctgcgggcgagcagacggacgggtttactcatcaatcgagaggcagaccaaaacatgggtttctccttcgaacacacccatgttcacacccgccatacgaaagcccttgccccctataggagggcttacccctagaaagacaacggtttcaggcacgaaaccggcaattttggcaccaaaccgcgcagcaccccacctaccggcggaacgcagctcagacaagccgtttttcagaggaatgcaagtcagacgaatgtaagccagacgaatgcaatccaggcggacgagccccgcaaatccttaaaaaacagaaaaagtcaaagaaagcgctcagatgaacgcacgctcaccgaaaatcgcagtgccgacgcgcacgatggtggaaccttcggcgatggccagttccatgtcgccggtcatgcccatcgacagttcccggcaacggtccgtgcccggttcgccggatgcgaggatgaggtcgcgggtcttgcgcaggtgcgagaaaccgcggcgaatcaccgtttcgtcgtgcacatgcgcgccgatcgtcatcagtccctgcaattcgatgccgtccaacgtgccgattttctgcgcgatgcggatggcgtgcgccggatcgcaaccggatttcgattcctcgccggattcgttgacttccagcaacacgccgacagtaataccgcgagccacggctctacgtgaaattttttctgccaaatcgattgaatcgaccgattcgatagtgtcgaccaccggcagcactttgccgattttattgctttgcagctggccgatcaggtggaatggaatatgctccgccgcagcatccggcgcggcgcctgcgacgcccagcgaaaacccgcgttccgcgcatcgccgtgccagcccttcggccttcgccgtcacttcctgcggacggttctcgccgatcatgcgcacgccggcatcaatcgcagccatgatttcgccgatgtcgcgcgtcttcgtggcggccagcaggcgcacggagccggcttcgcgtccggcttgttcctcagctgccgcgatgcggtcgagcacacgatgcacgccgtccgtgatctcacgtgcgcgcgcatcgtcgatcacctcgttggcgaggttcttgtgatccatgtatgcagtcatcgtccacctctcgcaaattcattcgaccgccggtccgcggccggcaccaccgtttccggcatgtcggctgatatttcgatatcagtgttaccagaaaaccgccgacaacgtataaagaagcccgcgcgatgacctgaagtgaagcgataaagcggtcataaattcgcgcgggctataaaactagacggcagcagaagggggacttcaaagactccgtctgcacatttaatgtatcagataaatgcgcgcgaaccgccggaaaaaccaataaatctgaaaactttttttcagattttatcccccttgcgtagtccctccaccaaacgctccaatttatcgacgcgatcactcaacaccatcacctggcataccagcgattggatcttgcccaacggcacttccgacatcgcattgtggctgtccacagccgtatcatgcggttccggctcttcggccgccttgcgcatgatgtcctcgtcacgcttccagcgtgcgatattgcgttcgatgcgcttgtgcccgatgaccgatgggctcaatcccgcggaaatgaagatcgcagttggcttctccccctgcagataccgcctcatgcagtcgatttggaattccctcgcatacgtgattctgctgtccgtcaccgcgtcgatcgacggcaatgtacgcaggtattcgatttccgctctactgaactgtcgcttcgtcatattcgccccttgtaaatccccttttgaccggccataccgataacgcatagaccgaattgccgaaatcaccacccagaataccggatgacgcacatcaccttacgcacaccccaaacgaaacgcgcggcccgtatcaccatgcgctaaatatccttctcacactgtgagatacctcacagcgacagcacgtttccggagcacgctgcagcctcggcatggcacgtcaccgcacgtccagcaacgcattccacaatcgcgtcccacgaaacccgccgttccggccgccgatgcaggtacagttgcaagcatcggcgcgaccggtctccgcaccggcaacaccgaaccgcccgccaacgacaggaaggaaccccgtgccaggtcgtttcgcacccaccccatcaggccgcatgcacatcggcaacatctatgcgatgctcggcgcatggctgtccgcgcgtagccgcggcgacggcatgctgctgcgcatcgaagacatcgacgaaccgcgcgtggtgcccggcgcggccgaactgatgatggacgatctgcattggcttggcttggattgggacggcgatccggtgttccaatccgctcggcacgacctgtaccgtgaggcgctgcattgcttggaaaacctgacgattgacgacgcatacgattcgccgtttgacgagcgcaacgaccacacccccgcagtcggcagcgcagccaacaacgcaatcgctggcacaaccccgctgatttacccttgcttctgctcgcgcgccgacatccgcgcagcctccgcaccgcaggaaggcgaccgtttcatggtgtatcccggcacgtgccgccggcttatcgccagcaatccggataccgtccggcggcggctggccaacggcgaccgccattcgctgcgcatcgccatgcccgccgacacaaacccgcacgcaaccgtccaattcgatgacgcagtgttcggccatcaggaattcaatctggcgcacgacgtcggcgataccatcgtgcgccgcgccgacggcctgttctcctaccagctggtggtggtcgtggacgatcttgacatgggcgtcgacgacatcgtgcgcggccgcgacctgctccggtcgaacgccttgcaaatcgccattcgccgagcgcttatcaaggcgggattccgcaaggcgaaaacgcaggcctctgcaccatcgcagcacgcaccacaatcgcaatacaccccatataaccccgaaaacccacggtacgcgcatctgccgcttatcgacaacgcggccggccgcaggctcgccaaacgcgagcgctctttggatatgggggcgctgcgcgcgcatggcgtcaccgcggaacaggttgtcggctattgtgcgtggctgcttggtttgcagggcgattccgcgcataccagtccgcagccgatgagcgccgtcgaggcgttgcaggagttcgattggggtaaggtacgggccgatacggccgaccgcagtatcagccaagacgatttcgacgcgtatttcggcctgtgacaacggctggccgggtctcgccgaattgccgagacgacccggtcagtccgggaaacagcagaaagcagcagaaaataacgggaagcagtcgacgttcagccgatccacagctccgagtcaagcggatattcgttgaccttgcagccgtccaaatgcatggattgctcctgcatcagcggcgccaactggccttcgccggcgcaggtcgtttcgttgtcgatgtgccccagccggtgtccgacctcgtggttgatcaccatcgtgcggtatcgcgccaggttgccgccggcggcgagccattgttgcgtgccgccgttccaacggtcgtcgttgacgatcacgttgttgtcgaccctgcagctgtattccaccgagcatgatggcgagaacgacgtcatttccgatgcttgggacagcacgagattgaaatcgcagttgccgtccgtggattggtcgaatatggctccggcgcgtggccatccgtgttcatcgttgaggatgcggaacgccgcgttgccgaattcgtcggccgaaccgacgtttcctttggttgcgatgcagtaatggtattgcgttaccggtttgccgctgttttgcgcggtttcctgcgctttgttcagaatcgcggttttctcgtcgtcgcccagtgccgccgattgcgcgctcaccgctttggcgacggcctgctcttcctgcgattgtttggtttccggtttggtttttttggccgtcttatgctgattggttttggctgttttcttggctggcttcttggccgacgtcgaatgcgtggcttgtgccgtcgtctgcgtgttcggcgtcatgcggaccagtagtgcgtgcacgctgcaggacgtcatcgatgcgatcagcaggaacagcacgagcaccagcacggcggccctgcggatgcgaaacgcctcaagccgttcccgttggcccattgtggcgtcggctttcggatcgagcgcacgtatgatacgacgaatccgcttcaatccagcctcccgatatggtgatgtttctctcttcggcaacagtaccagtctcagtcaacatgccgaagccgccgaccgccatgcataccacctatgcgtaaggcccgtggttccggagggaatcacgggccttaccagcatgccagacgaatgccggcaatcgtcaaagtaatgctcaggcgaacagcaccttgaacaggaacgcgccgacgatcgcgcctgcgatcggggccacgaccggaatccaggcctcgccccagcgggaatcgcccttgttcggaatcggcaggatggcgtgcaggaggcgcggcatgaggtcgcgggcagggttcagaccagggccggtcgggccgcccatggaggtcacgaggccccacacgatgaagccgacgacgatggacgcggcggccgggttcgccttgccccacggcagggacaggcagcacagggcgccgagcaccagcatgaaggtgccgaagaactcgttgaggaagtagttcacgcggtcgttgtgcgcgtcggtggtgcagaaggtgccgaggatggcttcggcatcgtcggtgtccttgtagtgcggcaggtaggtgacgtacacgatgagctggcccgccactgcgccgagcagctgggcgatgatgtacggcaggacctcgttccacgggaacatgccgttgacggcctgcgcgagggtcatggccgggttgatgtgggcgccggagacgccgccgaacatcaggaccgggaacatgacgccgaagccgtagcccatggcgatgttcagccagccggcatggtagcccttggtgtttttcagttccgcgttggcgacagcgccgttgccgaagaccatcagcacggcggtgccgacgaattccgcggcaagcttggtgaagagtgtgtattccactgcagtttcctctattgcttcttctctaacgattcttacgattcgtgcgattcgagatgaattgcgattccgctctgggcggacaacagcgcactaccttactccgtacggaggaagtaatgcggctttgggtggacacatgtccgaaatacgaaaaagacccaagtcattggcttgggtcttgtctgtgcccctcagggattcgaaccctggacacgctgattaagagtcagctgctctaaccaactgagctaaaggggcgttggtcttggcgaggtttttgttctcgctgagcacatggagtaaatatactcagaatcggaaagaacgcaaccctcggcgtgtcgcaatcataaaaccgccattttccaacgttttcagcaaatcgccatctatggtgcacatcgcgtcatacgacgaaaaatgcggcgcgatggcgccataaaatccaagtaatcacattttcttcacattctgccgcaatgcaaccactccgacagtcaacggcacgaacttttccatcacacatttccaccgcggcgagccgaatagcacgcatcatcgtcgagcccgtcggcgcgccagaggccctttataataaggaccatggcgcgtcacaggagtatataacgcgcatcaagaaggagaaaggcttacctatggcatgcccaaattgcggtcagccgaccatcgaaggcgctaaattctgcgcctcgtgcggctcaccgctcacccaaacgaccgcggcggcaccgcaagcgccggccgcgccggaatccgatgacggcaccatgctgtcttccgcgccgcacatggcaccggccccgcagatgccgaccgctgccgtcccgctgcccaatagcgccgcaccggcagctccgcaaaccaccgtcccgcagcccaccacaccgcaaccggcggcgcaagcacagccgaccgctcaggcgcaggcaacgcaaccggtggcaccacaggccgcgccgacgcagcagttccaatacgcgccatccccggccccgcagccggcagcagcgccgcagccaagccagccgacccagcaaatcgcccgtccggcggccgatcccaccatcaccgcgctgaccacaccgcagtccatgaagaccatgggcgccagcctcggcatcggtctcggcgcgagcgtggtgttcgcactgctcgcatcaatcgtcttcttcatgggcaatgccgcggccagcaacgggcttgccggcattccgggcttttccgacaccgcctccttcctgggcaacaacggtgtgtccggctccggcccgaatttcttccagattctcttcaccgtgatgacgctcggcgttggcggttcgctgaatctcaaaaccagctcccagggcttctcgctgagcaatctcggcattgacgcctcgcacgtcagcgtgacgctgccggtcggactgcccggtgtggcattggcgatcggcgccgcgttcggcgcatacatgctggcacgcaggttcgcgcttcgtttcaagtggacgggcgtcatcagctcgctgatcgtcggcgtgctgtccggcctggtgctgctggtcttcgccgccatcttcccggtgacggtgggtggttcctacagcgactattccgcttccgcgtcgctttccggcgtgtccttccgcacgttctgcatggcgttcctgctgtcggcggccggtgcgctggccggctacgcgttggcacagtatgcgggcgattcgggtaacgtcttctccgccgcttggcgttgggcgcaccgcgctcgtggcttcgtgcgcacgctggtcgaatcgtttgcgatctacggcgtgctgttcctggtgcttggcctggtggcaacaatcgccatgtccgccgcgaaccatctcggcgcaggcggtctgctgctggttccgctgctgttcccggctctgccgcttatgctgatttcgctgtcctcgttcggcggcatcgccttctcgacgtccagctacagcgcccatacgatcacgttgttcaacgtgtcctccctcagccagtatggctggattctgtggatctgcttcgtgctgttcctgcttgccacgttctatatcgcgctgcgtgagaccgcgcgcaatatgtacgacccgtattacgcgggctggcagcatacgtggaaggctccggtggccgcgatggtgttctggctggccgcggagttcctgttcacttatttcgcggcgggatacgcctcgtccagcatgtcgatgacgaccccgatgtggtatttcctcgtcgccggcatctgggcgttcctgatcgaggtggccgcgatgacgttcggtccgacgatggtggcgtccctgccgggcatgtggcggatcatcgtcggtggcaccgtgcagcagaccccgcagaacgtggtcgattacgtcaagtcctgcgatccgtcctacggcatgaagaagacctctgccacggcgagcggcacgaccgcaacagcgaccatgccgacggcttcggctgccgcacagccggccaatccaactactccggcagctccggccgcatcggtcccccagcccgcgacgccggctgcgccgatgcccgcgcccaccgctcctaccgcaacgcctgtttcacaggccgttccacaaccggtcgccccgacgtccatgcccaatacgacaacgggcaacacggcaacgggtgcggtgccgctgccgcaatcgccagcaggcgcggcttctatgccggtcgcagctccgggggcaggtcaaccgctcgacccaaaaactaagaagacgatccttatcagcggcatcgtaattggttccctgattgtgttgggcattgtctacggtgtgctcaactcgaccgtcttcagcgcgaaatccgtggcgcaaagctatctgacggcgattgccgacggcaagtatgacaaagccaatgacatcgccgatccgcaggtggacaaggaccagctcaagctgctgtccgacaccgtagcgaaggccgacaacgccacgatcgccaacccgcatatcgatagtgtcaaaaccgtcgaaggcgtggccaaggtcaacgtgacgtattcgctgaacggcaagaacgtcaacgattcgctcaccatcaacaaggacgggtcgaagttcctgctgttcccgaattggaagatctcgagcccactgctcaagaccatcaccgtgtcggtgcccaatgccgtggaatcgttgtccgtcaacggtgttgacgtgaccgcgaagaatgcggagaagtcggacagcagtacgtggacgttgcgcgtctacccgggttcgtacaaggtgtcgatcggcaagtcagggtacgtcaccagcggcatcaccatggtgcgcacgagcgcggactccgatgccgccgatctcaagatcatgcctacggccaagcttaaggaggacttgagcaaggccgtgaacgccaagctggacgaatgcgcgaagtccaccgactacgcgccggaaggctgcccgttcggcttcgacctgtacgacgaggactactaccgcaacttcgcatggtccatcagcgtctatccgaaactgtccgacatcgatctcgattacggcacgttctccacccggcagggcaaggcgaagtgcacgtatgaagagaagaatttcgacgattcgtgggagtctcaggacgacagcacccacttcaccgtcaacggcagcttcagcatcagggatggcaagctcagcgtcacgattgacgatgaggactgatgccggctaaagagcggatataggaaaatcccccgcaccaatcggtacgggggattttcgatgcttaagctcagacgtgtttcagcctgaagtcattcaccgccggtccgtaaggacgtcgagcggtgaatggggcgaaatcactcagcgacgaccttcacgaagaagttggcggtgatttccgggtgcagggcgacggttgccgggaagtcaccggtggtcttgatcggctcaacggtgatgttcttcgggttgacctcaaccttggaggagagcgcgatggcgatcttctctgcggagatgccgccgaacagcttgccggactcggagaccttggcagcaatttcgacggtggaaccctcgatgatttccttggcggcaacagcctcttcgcgggtggcgacggccttggccagacgagcgcgcttcatggcctcgatctgggcggcggcacccttggaccaagcgaaggccaggccctgcgggaacaggtagttgcgggcgtagccggacttgacggccacgacgtcacccgggtgacccaggtgattgacggacttggtgagaataaccttagtttcagccattgttcaaacctctctaagatcagcggccggacgtggcgtacggcagcagggccatctcgcgggcgttcttgatagccttggagatctcgcgctgctcctgcacggtgacaccggtgatacgacgggaacgaatcttgccgcgatcggagatgaacttacgcagcagggcgacgtccttgtaatcgatctcggtgaccttggcggccttcagtggattcggcttcttcttaaacggcttgaccggcggctgcggcctcttgcgtgacatcttgatgttctccttaaaatctggaaatactgcgattaagctgcttgtttcgctgttcgcctatgttgcggacggggttcggtccgtcagaattccggttcgtcgctgtcgccgccgaattcggaggaacctccgaaggactgggacgcgccgaaggaaccgaaggacgagccggagttatccgagcttgaccacgggtccgaggccggagcggactgtgcgggagcggcgttgaccggagcggaggctccaccctgatatccggcgccgccagcatagctggagccaccctgatatccgccgttgttgccgccgaaaccaccgttgttgttggcgttgttgtagccgccgcgattgccgctgaagcctccgttgccggacgagctttgacgggtcacctgggcggtcgcgtagcgcagggacgggccgatttcgtcgacctgcatctcgatgacggttcgctgggaaccgtcctgcgcctggtaggaacgctgctgcagacggccttgcgcgatgacgcgcatgcccttggacagactctgcgcgcaatgttcggccatgtcgcgccacgcggagcagcgcaggaacagggcctgaccgtcttcgaactggttcgagttacggttccaggtgcgcggagtggaggcgatcgtaaagctggcaacggcggcgccgctgccaatggtacgaatttccggatcggccgtgaggttacccaccacggtgattacagtttcacctgccatgtcgttacctacttactttgcagcttagaaagcttggtttacttacttgcgaagaatcttcgtacggatgacggattcgttcaggttcagcagacgatcgagttcgtcgctggtggccggctcagcggagtagttgaccacgacgtagttaccttcggtcttgccggcgatttcgtaggcaagcttgcgacggccccagatgtcgatgttctcgacggcaccgccttccttggtgacagtttccagatactgctcggtcagcttcttcagaccgcgctcatccagctcaggatcagcaatgaacatcagttcgtacttatgcgcagacatcacccacctccttcggactatcggccatggaccttccatggcaggagtgtgtatgcgtgctgccttcaggcatcgataagtcgcaatgaacatatggatacgattgatggcaacttgtacaggctaccccgacgccgcgacgtatcgaaacggcgtctgccgggcgcgaaatcacgtgcggaggcaagcaaaaagccccgctcgcaagcggggcttaatcgcaaaaaatcgtaataaatcctgaaatatcacgatagccgtatggcaatcgcacgaaatatcaggcgtagatgttgcgcggacgcatgtcttcgggcaggccgttgagcagcgtagaaacggagccggattcgaacacggagcggatgccggcggccagcagcggggccacggacaggacggtcatgttcggcaggcgcttctcttcgggcaccggaacggtgtcggtgaggacgatttcgcgtgcgccgcagttcttcaggcgttccacggccgggccggacagcaggccgtgggtggcgacgagcgtcacggacttcgcgccggcgttgttcagcgtgcgcacggcctcgcagatggtgccggcggtgtcgatcatgtcgtcgacgaccacgcagtcgcgtcccttcacgtcaccgatgatgccgtgtgcctcggcatggttcgggcgcgtggtgtcacgggtcttgtggatgaaggcgagcggcagtccgccgagcttggcggcccactgttcggaaaccttgatgcggccggcgtccggggacacgatggtggtgttctccagcggcatgctgttgcgcacgtagtcaagcaggatcggcatggcggtcagatggtcgaccgggccgtcgaagaagccctgctcctgggctgcgtgcaggtcgaccgtcatgatgcggtcggcgccggcggaacggaacaggtcgaacatgaggcgtgcggtgatgggctcgcggccctgatgcttcttgtcctggcgggagtagccgaggaacggcgcgaccacggtgatggaacgtgcggaggcgcgcttcatggcgtccaccatgatgagctgctccatgatccacttgttgatcggctcggtgtgggcttgcatcacgaaggcgtcggcgccacggacgggctcggtgtagcgcacgtacatctcgccgttggcgaaatcgtatgcggtggtctcaagtacgtcggttcccaggtattttgcggtttcctgagcctgctcggggtacgcgcgacccgtcaccagagccagtttcttatccggagtgccttcgagaatcgccgacatgcttgccttcccaattgttcgatatgtgaaaataagccaaactccaatataacaatgcgggtgcccacggcacgcggccgttgcggaagcgtttcaccataccgctccaaactgccgtcggcaacatcaaaaaatccccaagccatcgacacagaaggcacatctcaacgtcgatggtttggggggaaaaccggattaccggactattcggcggacgcgaacgcttcgcggatctgcgccgcgttgccgtaggacgcctgcgcgccgtagccggtggccgcgtacgccgaaacgtacgaggcgagttcggcggattcggacagcgccagtccggacgacagaccggccagcacggtgcccatgaaggaatcgccgcagccggtggtgtcgacggccttgacgcgtaccggggcgatgcgctggacacggtgttccggatcgtccgcggtgccgtcgagtaccacggaaccgtcgccgccaagcgtcacgatcgcctgttcgaagccgaatccgcgcagttcgtcgagcgcgtgccaccagtcgaacgaatcccaatcgtcgttctccggctcgtcgatgccgagcagttgcgccatttcatgctcgttgacgagcaggatgtcggatgcttcgatcagttccgccggcagggacggggtgaacggcgagtcgttgagcagcaccttcacgcccgcttcgtggcacatgcgtgcggccgcggtgacggtttcgatggggctttccaggcacaggccgagcactgtggagtgggtcagcgcgtcacgcacggattcgacgtagtcgacggtcacctgcgcgttggagccgggcgagtacacgatggtgttctcgccgtgcgcgtccacggtgatgacggtggtgccggacgggccgagcacgcggcgcacgtgcgtggtgttgacgcccgcttcgccgagcgctccgagcaggaagtcggcgttgttgtcggagccgaccgcgccgaacatctgcacggtggcgccgatgcgtgcggccgccgcggcctggttgccggatttgccgccgggcagcagctgtagcgggccgccggtgatggtctcgcccggcccgggcagtcgctgtgcggtgacggtgtagtccgcgttcatggaaccgatcacggaaacggtgccgtggatgcggtccagtgcggagaggatttctgctgcgctcatgatcgctttcctttcttgcgattattgcgattgccgacggtcgccgcactttcactgcgcggttattgtgctctcactgcgctttggcggcgaggccggagatgcgggtcatgaattcgttgaggaacctcggcacgtccacgccgacggcgaccttcatggtcttgaccgggtcgttgaggcgggtttcgtcgccgatggtgcgtccgcgggtcgggccgtccacgtcgaccttcatgttgatgtcgagcgtggtgacgagcgtcgggtcgacggcgacgccgacggcgagcggatcgtgcaggccgcagccgccgaggtgcggcgaggtggtctcgtaggccttgatgtagaagtcggtcatgtccgcgaggaacttgccggccttggtgccaaggtcgcgccactgttgggtttccttataagtgagcagggtctgcagggtcacgtcgaggccgatcatggtggtcggggtgccggagcggaacaggtagtcggcggcttccggatcctgcgagatgttggcttccatgcaggcgttgcagttgcccggcacggtcagcgcgccgcccatgagcaccacgcggccgatctcgtccttgatttccggagccttcttcagggcggcttcgatgttggtcatcgggccggtcggcacgtagatgaggtccttgccgtaggtcttgacggcgtcgatgatgaagtcgacggccgattcggtttcgacggaacggttggagtcggggatgtccacgtcgccgatgccgttgtcgccgtggatgaacgcggagacgggcagcacttcgaagcggtcggtggtgctggagtgcggcaggccttggtagaccttgacttccgggtggccgagcaggtcggtgacggcgagcgcgttgcgtacgccctgttccacgagcacgttgccgtaggtgccggtgatgccgatgagttcgacttccgggctgcccagcgcgtaggagatggcgagcgcgtcgtcgacgccggtatcgagatcaagaatgagcttcttcatgattgcgccttcctcgttgattggctgtgacggccgttcgcgtccgcgcggctgccgcctttgttgtgttcttttttttatgcgatgttttatgcgattgttgtacggtgttgagtacggtctctgtatcacctcataacattatgataaaacgttttatcaagatttccaaatcatcctttcgacgtgcgtgtcgcggcggaaaaccgccctttctccgatatgcgccccacgttacacgcgtaatacgcaatacacgcatcgcacgcgctatgcgcgttatgcgcaagcggcctgcaccagtttcggcgtcaacaccttcacctgcggcgaggcgagccacggacggcccgcaccggaatcgccatcgccacgtaccacggcgtcgattcgactgcccagcatgccccagccggcggcggccaaatcgaccacgctctgttcgacggtggtcatgcgcaaacccaatccgaatcgtctgagaatgttgtcgtagccgatcacctgcatgtcttcggtgacgtgcagcccgcgttccgccatacgctgacggaagccgagcgccatcacgtcgttgcagcagaacacggcggtcgcaccgccgtcgatgatctggtcggcagcatgatagccgccatcgaaacggtagtcgccggacacgcacaacgcgggatcgaaccgctcccccgcctgctcgatcgcatccacgaaaccacggcgacggtcggccgcgctcgattcggccacatcgcccgtcacaatgccgatgcgcttgtgcccgccttccagcaggtattgcgccgcaagccgaccgccgagatagttgtcgaagccgaccgcgtcacaccaaccgcattgcatcagtcggtcgatgagcaccaccgggcaggtgacacgctccacgtcctcacgcaacgcggcgccggcaccggccgcgcaggattcgcgcgcgggaatcagcagcacgccatccaccccacgtgacgtcagcctgcgcagcaaagcctgttccgactcacgcgaatcatccgaattggccacaatcagcgaatacccctgcgccgcgcattcatcctccacgcacttagcaagcgccgcgaaaaacaagttctcaatatcaggcacaatcaacgccaccaactgggattgcttggtcaccaagcttcgcgcactctgattcggcacgtaattcagtttcttcgccgcatcggcaatgaccttgcgcttcccctcagacacgcgagcaggacgattattcagcaccagcgaaaccgtcgtcacagacacccctgcgacagcagccacatccttcagcgtcgcacgatacgccatccaaacccccttaaaacgtttatccctccagcataaataccatggaatcctgacgcgcccagcatcgcaataacaaacaaattcctttcacagcaaaataatccgcactatttccaccggtaaatcgtttctcggaagtgtttttgcatactcgcaacgtttgtccaaaatgagagacgcacaagaagaaaggaaccagcaatgcggccaaccacgcagaaaaacaatgcgagacagcgcaaaaccatcgccatcgtcgcagtggtcgcagtggtcgccatcgcacccaccaaacgctatgagaggtcgagatctccgtccgtgcgtagaaactccatcaggttgagatgccttacgccgtcacgttgcattggcagctggtccaaactgaaccggtatttcggatacccgtcagccagcttcgtgaacggacggaattcacgctcctcaacattaggatcctgcacactcatcgacacctgcacataggcgtaccgttcctgcttacgcacaatgaagtcgcactccagcttaccaataatgcccacgctcacctcgtagccttcgacctcaaatgcacgtacagcgcattttccaaggctggtccgtaactcattcgcgtaccagcgttacgcgcgaatcgtatgccaggatccgcaagataatacttctcccctcctctcaacgacctgcgcgaacgcaaatcgaatcgcgggcatttgtagaggaccttcgcactctccaacagccggacatagttcgcaagagtctcacgtttgaccgtcacgccttcgccatgtttcatatagtcgacgatccccgacagattcgtgggagctgcatagttgttgatgagatagtcctgcacacgctggaaggtatcgcggtgacgcaccactttgcgtgcggctatgtctttgttgaagatctgccctatgacctaccacgaccaagaacctaacccacgaaaacagcagaagcccctcaactcttcaattccactacaaaggtcacatcacggcatacgcacgccgacgcgcgtatgcgtgcacgactccagcaacgagccgtacccgccgttagatggcaggcttcagtatcatgacgccatgcgttagcgtcaccatgcaacgataggaacacactattcaatagtgcatcatgaaagcgtgacgttgcccttgcgcaggtgccgtaagactccgcggacaaagcaatgaggcttccccgtgagaagggaagcctcatattccattcattctattcagcgatgatgacgccgaatcaccgatcatcctttgggaacaacgcgtcgaaggcatgttccatcacggacttacggcggatcacaccgacgagcctgccatcaccatccaccaccggcagtttcttgaactgcttcttggcgaggattcgggccacctctccaacatgctggtcgggcgtggcggcaacgaccttatgcgtggcgatgtccatcaccttcttgccggagagcgcctgcaccttggaggccacggtttcgtcgtcgaacaccaccatcgtcgaaccggtgccggtggaaaccgtacgggattcataggtggcaatcgatttcatgacatcgccgtcactgacgaagccgacgagcctgccatcgccgttcaccacgggaaggctggagacgttgaggcggatgaactcgcgcaccacatgcgtgatgtcatcgctgtccaggcagctgtagggctgatcgtccataatcccgccgatggactgttcctgggcctgcttgaacagggaggcagcgggggccacgtatgcgccggcgtagtgatgctcggcgggctgaccttcagtggtttcgaccgcgacttcggcggaggcttgcgcctcgtaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcacggatgtttctgcggtgaccagaagcgaggtcgcaatggctgccgcgatctggcggccggtgttggcgatggcgttgccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgcaaggccgccgatgcccacgccgcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgaaataatgacgaccggactggcccatcccatcgtggaagcggacgagaagccatagagcaggccaccgaacgcgatggtcgaaaggatcacggacaggatgttgagctttgggttcttcaactcgccgacgttcttgagcatcatcgtgcctccgacaaggatgaccagtgccacaattgcgatgccaatgaacatcgggcgccatccgaaaccgtcaatcaccagaccaccgacaaccgggccgatagccgggccggcggccatgacgataccggccatgcccatggcggtgccgcgcttatccggcggatagacgagcatcggcactacggcgaccaatggcaacagcacgccggagccggcggattgcagtatgcgtccgacgagcaacagcacgaaattcggcgcgacggcacacagcagtgtgccgaccatgaaagtggcaagggctccggcgaagagctttcgggtggagaatttatcaatcagatagcctgaaatcggcaccatgatgcccgataccagcatgtagacgctggtcacccactgcacggtgccggtggtgatattgaaatcacgcatcagtgccggcaaggccggtgacatgacggtctggttgagcagcgcgatgaacgagccgacgacgatcacgcccacgacgatgaatcgggcgtgcgaatcaataggctttacggaactggcggcggacccgaattccgcggttttctgtgaggtcacagcatttccttctgttggtaacggcatgtgtgggcgatccggccccatacttgtgtcaagacgcggggacaccgatgagtccggggtaaaggaaaagccgccatccgttccgcattcatatacggcaaacgattcgcggctttgcgtaagttgatggctatggtgagcgattcatgcgacgtcgaccgcggatgggccatcggtgcatcccggcataaggcgtgtccccgctacaccagcatcgaaaaaagggacatttgtggattggcaaacagaacattgccgacgaacgacccacggcaggtgcgtgcgatgaacatcgcgtagcgatacaggttcatggcatctccttgacgggtcttcgtacggcagacatcgagaagcctatcatcattcagatcgacggtgaaacccacgcatgcccgacaatacacaaaatctttacaaaaggattgggcttaccgcatacgatccgcctgggtagcggtccgaggatgaatcaggggcgagccaagggttgcgtctcgtgtttccgccatgatgtctggcaaaatagtgaagccggacatgcgaggcatcgaccggaatcggaaaggggcaaatcatgcgagttctcggcaatatcctgtggatcattcttggtgggttggccatcgcaatcggatgggcattggtgggactgattctgtgcatctccatcatcggcatcccgttcggccttcaagcgttcaagagggcgggactcaccctgacgccgtttggcaaaaccgtgcaatacggcggcggagtcggctctgccttggccaacatcctgtgggtggtgctggtcggctggtggatggcgttcggctatctgggagccggcgtactcaactgcatctccatcatcggtattccgttcggattgcaatcgttcaagatggccaagcttgcgctctggccattcggagcggaaatcgtcaacctgtagattccaaatactacaaagccgccaaagcaacccttggcgaggcggccaccgacgtcaacaattggattgaccagcaagccgccaaggccgaataataaaacacacattatgctgctgcagcagccagtccttgcagaacaatgtcatgacaaaggcccgaggaggcggcgctgccgcagatgttccgctcccatggagaggatgtgatgcgtcgcgcgatggccgtggtgaacgtagtgaaccagacgagcacgctcgttcccgccgtgctcggcggcgtgctgtacgcggcggttctaggacgggattccatcaccttcgctctggacagctgagacatcaaagccatgtgtggatatgcaaacggccgccatcaatcatggtgatgttggccgttcacgtcccattaaatatactttcgcaccgtatctggcttatatacggcagattcgggagacttggattcacagctgggtcattaggccagaacgtacatccggctctcgcagccatttcctgacgaagccaactacttgcagcacgttatttcccaatcgccacttaccggacccaattgccaggctgcgccgcatccgccatgacgcaccgtcgcaaacgctcccgtctgacgcgctttactggccttgtgcgcggtagcgggcttcggtggcggctttggcgggttcccaccaagcgcggttgtctatataccaagcgatggtcgcctgcaaaccggcttcgaaatcggtgcgcacaggcttccagccgagttcggtacgcagcttgctggagtcaatcgcatagcgtcgatcatgcccgggacggtcacgcacccagtcgaacgcatcttcgacacaccccataagtcgcagaatcatacgcattacggcaatattgctcatttcgccatctgcgccgatcaggtatgtttcaccaatccgcccgcgtgtaagaatctcccacaccgcagaagagtggtcttccgtatggatccagtcgcgcacgttctcgcctgtgccatacagtttcggccgcgcgccttccagaatggatgtgatctgtcgtggaatgaatttttccacatgctggtatggcccgtaattgttggaacagttggaaatggtggcgcgcaggccgtatgtgcgcgtccacgcgcgcaccagatggtcggacgcggctttcgacgcgctgtacgggcttgacgggcggtacggcgagttttcgccgaatcgcgccggatcgtccaacgccaggtctccgtacacttcgtcggtgctgatgtggtggaatcgcacgtcgtatttacacgcggcctccaacagccgcatcgtgccctctacgttcgtgcggatgaacggttccgggtcgaagatggaattgtcgttatgtgattccgccgcgaaatgcacgatggcgtcgcagccgggcacaatgcgttccagcagcgacgcatcgcagatatcgccgatgacaagttcgacctgcgattgcggcagcccgtcgatgttcgccggattgcccgcatacgtcagcttgtccagtacggtgacgtgcacgtccggatgattgcgcgccacgtaccgcacgaaattggcgccgatgaacccgcatccgcctgttaccagaatatgtttcggtttgaatccctgttcgctcactgtttcagcaaccgccttcccgattccaacattacgaatgcaaacaaaggcgcataaggaaggaaatacctgaattgcataccgtcgactccgattagcccatccgcatcgtattgcagtcacaaggcaaggtaaatcagtaggatatctccgatacagaccaccgcgatcaaccatgcgtatggtaaggaaagcacaccgcatgcatttatagaaccattggcagtcctaaccggattctttcggcggcttttgacacaagcattcaccacactggtcacagccaacacgactacggaaaccacaattgccaaccaacacgcggcaatcatgatgctgtccgtcctgttattcatattcgattgagcatgcattatcgcccatgcaatgttcttcacagcatccaacatggcaacgggatccgtcaacaatgcatgcttgcgctcgctcatttgtttgtacgaaaccagcatcggacaattcgtataccaagcattgacgcccaaccagaatatggtccatataccagacgcaaccacgcctatcaacaatggcacagcccgaccacgattcacacgccagcgaccggaaactcgatcaaacatcaacggaataaccagcaaaaccaatggcatgtacacaaacttgcacattgccaatagcacgctcgttaccgcaagcgccactgctccacgttgtgatcgtttaccaataattccccggaacagcaaacaggagaacagaatcatcacagcttgtgtcagcgaatccgcagaaatagcgaatgagtaacgaaacaccatcaaaggaaagcataaaagtattccaactgggatacgccatcgcggcaatgcgcgtactgcaccatacatgaacaacacataaatgatcaacatgcacgcttctgccaagcggtatgtcattccagaactgaaattaaaaactcgtccgattctgaagcccagtaattgtggagcatatacgaccggagaatttgttgccgtgttgttaaaaggcaggtcaaccgttgtcgatgatccattgtcagcaacggattccgcaatcacaattcctggatcatatccgtcatactgatctaaggaatactgcatccaactgcgatcgaccgcgccaccgactacccctgtctcagtattatgcagcatacttctcgaagtgactggccgtgcgattacatccccgttaagtatggagtcaattcgataaacatgcgtccaaatatccggcacatggccaggcttggtaacagccatgaaaaacatgccctcaagcagcacacacaacgccaccaacactggcatgcatcgaaaaagcttctttcccttcataccgccactatcgcataactatttgactgcgcttaagaacatgccttggtttcattcatcattcagatacccaccagctaccatcaagacacctactcgtccagacacactggctaatatatagctcggttttacatgctcataaacccccgtttacacaaggggttatttgccgtgaaggaagcgacgatgccttatatccagtctgccgttcatgccttcgagccttcatacgtcaggcattccaaacaatcgtttataggcggaacttaccggacactggctgacgagagcatgatagacaccccctcttgtttcgatgtgcgccaccgcgcggaactgtacacgcataaagcccctcttcatgcggaacccgcgcaccgaagcatctacataccggaaacggaagcgtccgtcgcaccatgtgatacggatattcttgcgattacggacgagcagtatatttcctcttttgctgcagaggcgcaagttaatggcaatcacgcattacaggcaatgccgcgcactcttcaaacggttcggacggccctgacgactgccgggcatagcttgaaacgaattggccagactattgccagtgcggctcacgccaccgcacgcgtcacacgtaccgctgcgaccacggtgcgtaacgcatggcgcaccttcacgagtttcaaagccgtccagcttatcatcaagttcttccggggtgcgcatgccttgtggaagaaacgcatgaagttctcttatgcgttctataccgcagtgttcttcctgctcacttcagccgaagtcattttcctgcaatggggcatgtactccgaaccgaaatatagtaaaggaagtaaaatttccgaaaccgcgaagattcttcaaagtgtatccgggaaaacaacccaattcatctgtcaaatgtggcttgagaatagatataacttcttattcaacctatttgctctcaccatcatctatcttgctttcatcttcatcacgaatcgtttctggattgccactgctcttttcggagtcttattcaccgcctacggtgtagccaaccatataaaaatgcaattacgaaacgagccaatcattcctgccgatctgacttttgtcgcaggcggaaactcagataaactcctttccttcattccaaaagaaaatcaacaattcgtaaattcctcaatcagtgttgttatatggctcgcttgcctctgcgcacttttctttatcattgacggtagaagacaattcattccttgttcatggagacatccattctcaaatccaggaatcctcattggctcgttgacacgcattttcgcagctataacctgtatcggtatcgtttgttcttattcatttaatctcagcgtcccaggttcttgggcttactcttttgccggcaatctcggatacacgccttcgttatttgacgcaactctcgatgccaaaaccaatggtcctgccaccacttttctaagtctcaccaaaacaaaagtaatggataaaccggaaaactataatcgcaaaacgatggataaaatagcccaaaaatatgattcgatggcccattccatcaatgctaaccggaaatacaacatcacggacagcaccgttattatgattctgtccgaaacgttctccaacccaacacgagtaccgaacattagcttctcaacagatcccattccaaacattcaccagattgaagaaaataccacttctggactcatgctttcttccggatacggcggaggaaccgctaatatggaatatcaggcacttaccggcctgaacctcactaattttgacgattctctcataattccattccaacagcttgtgccgaatcaaaaagccccttatgctttcaaccaaatctggaacacccgctatggcacgtccggttcggacgcagtgcatccgtattaccaaaacatgtacttgcgggataccgactatcgtaaattcggatttgctcacctacgcacacttgatagcaagccaaaaatcacgcacaagcaaacctctgattacaatccgtacgttaccgatgaagcggcttatcaaaacgtgttggaccttgtgaataacgagacgcatccacaattcctgcaattatcaactatgcaaaaccatatgccctacaccggttggtacccagataatgaatttaccgaggcggattcatcagtcgatatttcaacagaagagcaccaaaatctcgagacatatgtcaaagggctcagcctcaccgatcaggctacagcatcttttctaaaccagctaaacttgatcgacaaaccagtcactgttattttctacggagatcatcttcctagcatttactcaacagccgaacaagaccctaagaattcatccgtcctgcatgaaaccgattatttcatatggtctaacagcgcttctccatcaaacggaacaaaactcgcagatacagatgctgcttatatatccccaaattactttatggcgcttgccgcttctcatatgaacgctaaagtatccccctatctcgctttgctaaccatgttgcacaacaatcttccggcttcgagccgagtagcattcgccacaggcggagtcagctctggagatgaaacaaatctcgaccaagtaggtaatcaaatctccaagaaagccttatcgaaagaggcaaaacaattgttgctcgattacaggctcgttcaatatgatatgaccgcaggcaaagggtacctagccgatacgaacttcaccaaaataaagtaaactctattgtcaagagacgtacaatctttcgatgccacattacatcaaggaaacaaggacaggacatggctacttcaagacctttggtttcaataatcgtccccgtatacaattcggaacgatacctgccatattgtgtggaatcgattttgaatcagtcttataccaatcttgaaataattctcgtggatgatggatcaaaagacacctctccacgtatttgcgacgactatgcggagaaagattctcgcgttattgttattcaccagaagaacgggggcatcgccaaagcccaaaacaccggattggatgcagctcacggtgaatatattgcattcgccgacaacgatgacatcctggacagccgaaatattgaattgttgctgcacgcaattctaaataccggagctgatatgagcaagggaagatggcagcaattcggcgtctcccaactagcagaaatcaaagcacgcgccgcccaaggatctgctgcgccggacaaaacaacttcctttaaaaatcctctgcacgcatatcaaaccgtgttctgcaagagtctacgtattttgggaaatctgcttggcaagaactctgaagctctctatttcaacgaggcaaactggtgtcgtctgtacaaacgcgaattgtgggacgggctccgtttcgatctgggacattatgcccaagatattcgcatggcggcccctctttactccagaatgaagctggtgaccgacatagattccgtgctctactactggctgcaagaaccagattccgtaactcactctaaacgcacaccaaatttctggcatgataatgtaaccgccgccgcaaaaaatttccaagccactcttgatcagggcattgtcccttgccgtaactatttcggtctagtggcgagtgtcaaagacgaagaaaaagtgctacgtaactccagtaatgaagttaccgatgcagattggcaaaatctgcaggatgacttgacattatcgagtcagcttattcttaagctgactccactgcaaaggctccattgctatattttgtttataattcgacattatgaaaacaaaatatatgatcgcaaaattcatgacatgaagtaaagtcatgtgcatacggaaagcaaatgctcatccgtatcactttgctggaataaagacctttaaaaggcgataagggctatacaaaaaagcatgcaaaaacatgcacaccttgaaaggtggcaacaatagtgccgcatttttcgattctggtacctgcatataatgtagcagactatatttcagactgccttgaaagcgtcatatctcaaaccttcactgatttcgaagttatagtcgtagatgacggaagtactgatcaaactgctgagatagttcaaaatctgcaaagcaaagacgcccgaatccgtctaatccgactcacgcataactcaggacgccatgtcgcgaggaaaacagcagttgactcatccactggtacatacacgctgttccttgatgcagatgatgcaattgaacctcatctgttggagctacttgatttcgtatccaaaaaacatgatgcagatatgatcaggtatggtctgtcagttattccaggaaccgaccaagacaagaaatgggcattcgactatgaagcaatgtttaacagtgctgacggagagctccatggagacgatatcttaaaagcatctttctccttcgatttcaagcaatgggtttcatggaacattcatacaaccatgtatcgctccgatattgttaagtccagttttaaggaaatgccagcagaacgtcttaacaaacttgaagatgcttacgaatatctcgttttatgttcacgtgcaagaacgctatatccaataaccgagctacgtggacttcaatatcacatcggaaggggcatctctggaagggcacgatattccatcgataaattcatgcaagatcaacgttctgtacatgatgtcgttctcgccgctcaacgatttagcaacacacagcatgttccagcaattcaaacggcgaccaattggctgagcacacgtgccgtctcaattattcaagatgatttccaagaaagactggcacctgaagaatgcgaatccgcattacaaagcatcgcccaaacctggaataaagaaacagcctgtcaaattctttgcaattgccttgaatcacgcgtctggtggttttgcaacatgaacagctatcccgcagacaacgatcccgtcatttactggaaaatcgctttctcccatatgatggattccgtttctttcaaggatgtttttatctctaataaagagttacagaagcaagcagcacatatttatgaagcgctctccgaactcgatcgtcgaatcgctgagaaaaaccaagaaaattctgcacgagaagaggcatataagcaagccatcatagacgaaaacaagcaagccatcatagaagaatataagcagacgacattaccttaccgcataaccaatgccttgcttccaaatgaaacacgtagacggagaattttcaaccacctcattaacaagcagaataatcaataattgtttgtgttaatgatggcccaggggtaacgtcactggaccatcattaacacaaacatacatacaattaattaaaagacaaatatgtattgtctttatttacgcttccttattatcatcgctttctcattcagcagtgcataatcttcatgatctgggttgttaatagaaaacacgcacccattagcctcattcgtaaaagcaaccattttggtttctgagtctgccgagtcgccatcatcaacacgcacactggcatacaggcggtataccccactattaagcatgtcaatcggcatctccagtgcaaatcgatgttttccactacttgtctgcacaagagtgcgtgaaccggaatcatagacgatgcctccgcgtttcagatccaacaagttcacagcaacataatgcgtcccagaatccttatactcgtataccacatcaaattggaacggatgttttccatcagttgataaatcagacttcgggactattttcaattctggaacagtggcgtttaatcctatcgcatattcaccattttgcttctttttctctggcaaaggttcattgcctttgagattgtccaatgtatattgatccgcaacttggtttttgtcaccactaacgacaatttctccgtcacggatgagaatggctttattacaatacttttttactgcatccatgctatgagtcacgagaataacagttttattcgggtctgcctggaccttcttgaaaaatgcatcacatttacgttgaaacgcctcgtctccaactgcaagtacttcatctagaacaagaatgtcaccttgcgctttgattgcaacggaaaaagcaagtcgaacctgcatacctgaagaatagttcttcagtttctgatccatgaactcttcaagctcagcaaattcgacaatatcgtcatacatggcgtctatctccgaatgactgaaccccaggagagcaccattaagatagacattctctcgaccagtcagttccgggttaaaaccaacacccaattcaatgaaaggaactagctttccatagacatctacactaccttggtctggaacgtaaatctgtgaaataatctttagtaatgtggatttaccggaaccgttacgtcctaccacaccgaagaaatcaccgcgatggacctcgaaatcaatatcacgaagaactttctgctctgtatatcctttgatccccttggtccaattcagaaaagccattttcaaaccagtcgcttgctccgtcggcaagcgaaatgacttagctacatgactgacttttaatactactggggagtcttgcatctttttattttccctcaccgtttacagcacctccgcaaatttagcgctgtacctacgaaacacctgaattcctaatacaaaaatcacaattgaaagtacatatggcaacgcacacagcaagggattgccaacatacgtccagactgttggaatatattctggagacaaaagattatgccggatatccataattacttgagtactaggtacaagtaacagaaacttcgaagcccaagcaaaatcaggagccctttgcgcaatcatagtaatcggatagataataggtgtcgcatagaataaagcctgcgtaatcacatcccagatatgcgctacatctcgaaaatacacatacaagcttcccagtaataatgtcactccaagcgtcaacaaataaaattgcataatgttaagaggaagcaacagaaccctccacgtataatgcgcatgtgcaaaaaaaccaaagcaaataaccacaacaaggttgatacccaaagaaatcaacgcgcccatagcagtagaggcaacaataatgtaatttggaaaatgcactttacgaagcaaatcgccacgatctactatgccacgcattcccatgctggtagcttcagtgaaaaaagaccacaaacacgtaccgcacaacaatgaaatcgggaatgtaggtgttccatctgtaaatttcaggaacctcacaaaaactacatacataaccgcgaacaacatcaacggtttaagaacggaccacgccattcctagaaccgatccttggtaacgaagctgaaaatcggtcttcacaagctctttaaagacaaccatggaataacggtatcgttttctaaagcgttctaagacattctccataaaaagaatatattagcaggagccccaaatcctatcgagggtatgaagtcatctccagaatattctcatacatcacctatcagcgctatactttctatgtttgagagtcttatagaaaataaggattattggaatgttactcacccaatcttcaatcaaccgactcggcatcttcttcttctatgattccgatggagttgtggatgactatgtccctaccctgctagctggattcaaacctcatttctccgaaatgaccatcgtctgcaacggaaaactcaacgaggcagggcaatcaattttgtccaggtataccgacaacctcatcattcgtcccaatacaggtttcgatgtttgggcatataaaaccgcccttgattcctatggatgggaaaaacttgagcaattcgacgagatcgttctttttaatgcaacgattatgggacccgtctatccgttcgccgagatgttcgaaacaatgaataagcgcgatcttgatttctggggcatcactaaattccataaagttccacaagatccattcgggcgtagcccgttcggatatcttcccgagcacattcaatctcatttccacgcttatcgaagaagccttgtgcagagtaaagagttccaggattactggaacaatatgccgcagattaacagctattatgattccgttggaatgcatgaatcgttattcactaagcgcttcgctgatttgggattcaagtgggacgtttatgtcaataccgatgatttagaaggattcacttatggtccgattacttttgcggccaaaactcttatcaaggaaaagcgctgtcccatcttcaagaggcgatcgttcttccatgattacatggatacgttaaaccaatcagccggcaacgcagctttggatttattcgaatatctgcgagaccacaccgattacgatgtcaatctaatctggcaaaacgcattacgcacgatgaatctcgcggatctcgtcaaaaacctgcatctcgatttcgtgatgccgtcaaatatcactacgccgattcctgaaggtaagcgtatagcgctgattatgcatttgtactacatggatttgctcgataaaacgctggaatatgcaaaatccatgccggaaggctgtgacttcatcttcaccgtcgggtccgaagaaaacgcaaagctggtacgggaacgttgtaaaggactgccttataacgtcgatgttcgtgtcatccagaaccgtggacgagatgtaagcgcattgctaatcggcgccggtaaagattgcctgaaatatgactatgtgtgcttcgctcacgataagaaagtgacacagctttctccatacagcattggagatggctttgcctacaaatgtttcgagaatatcttaggcagcaaggcattggtgagcaatattatcaatcacttcgagcaggatccgcatgccggtttacttgcaccaacatcgccgaatcacgccgactatttcggtaatttcgcaagcctatggggtccgaatttcgaaggcaccaaaaaaatgcttgaagagactttaggcgttaaagtacctttgaatccatacaaggaaccaatcgcacctttgggcactatgttctggttccgtccaaaagcattgcaccaactgttcgatattgattggaaatacgaggatttcccgcctgaaccaaacaaaatcgatggatccatgttgcatttcatcgaacgagcttacggatacctgcctcaagccaatggatattacacaggtttcgtatattccgatcatttcgctcgcattgagcttaccaacctgtcatttgatgtacagacacttgcgggtagtacggcaccttatctcgacactacactgcggggaacctgtctgaatgttgcgcgtggattcacattgcgagccgctattttgctgtggttcaagcgaacactggtgggcactccgtttgcatatcatttaggcgctagggttatgaagctgtaccgtcatatccgtcatccgaagacgtataaagagaggtatgggaacagtaacgcccatttgaagaaggatcgtgcatgacagacaacgttccttttactaaacctactatgcccgatacgacgaagcaaaaaggtaaacgtccacgacttttttatctagatctagtccgtgcaattgccgcgattctcatcgttatcacgcatttcaataacccatacatgatcgggcaccctgtattcgcttacgaaccatttggtatctatatcggtggcttaggcgtttccctgttcctgattatttccggcgccgccttgatgtatacatacggcgagtccgaaaaattaaactacaggcattttcactacaagcgttttattggaatctatccaatgttttggattgctttcattatcgctaatgcctatctttttttgcgtaacggtggacatgtattcgcgaacgctccaaaatggacgttaattttctccgtgctcggcattgacgggttggtggccaatacttcacttccaacgttctatacacttggcgaatggttcttgggattcatcctcattttctatgtggtatttccattattgaggtacggagtaaaaaaacatcccctcatcactggatctgtcgctattgcattgtatgccttgacgctttattttcatccaatgccccttggactaccatccgatttattgcttacaatgaggttgcctgaattactgtttggcatgtatttcattcagtacatcagaaaaataccaacctatgcagccgcagcagctttattattccttgttgtacaagaaattcatccactgtttagcggatcctttgccgtgaccattgtaggaatttgtgcatttgcagttatagtctatactgcaaaatggcttgatgtacaacctattcggataccagtaaattctgtatcaaaatattcgtatcctattttcttagtccaccatgttttgatttcacaggtattcacaattattaactgtactgccttgtcacgctttgacggttatctactattttttgtagattttatgataatcatgacattgtcaattgctttatacagactcgaaaaaaagaccatcagctacatacaatcaatgttttaaaagttatataagtgcccagaggtatcccctcctcgggcacttattttaagcatctttctcatgtaaactgaacatttgtaactttcaaggccactgcccccccctggtcaggattcgagcatggattgtccatgccgctgcctcatgttgaattcgccggcgtcaatccatatcgtgttgtgcacggtgcggctaaggatggcgccaccgcctaaatggcagcacatcattcctcgacggccagatgggttgggagcatggtaccgaccgccttgtcatccgatttcgtttccatatcaagctgaggttgattatcaaagcgaagtatcgccttggcttgatacgtaataatcgtcaagaagtgcgattggcctcctttggtaataacgctggcctcgaaacgagcaaatattcatgtaagccaatcttatattgacgatatatccatattgctagcaaagggagtacatagtacatctgtaaggaataccgaaaagcagcaactggtgaaaaagcaagcaaggaaatcaagatacaaagcaacggcaaagacatgattacaaatttacgcaaacatctcatacgatatgcgattatgcatcctacaacaaatagccataatggtaaagctctgtcaaagaagatcagattaaatgaatctgagattacagggattcccatactttcaattttgttataaagtttcgaaggcaccgaacgcatatacgtataatgccccttaaattgattaaggtactcgtcactacatttattccccatcttttggcatgtagaacgcgtataaatatcgtgatccatgaagtcagtatcaataaattgggtggaaggcgtactagttatctgccaatacggcttcataagatccaaataggccgatacatattctccaaaattattaattcctgtttcagcccaaaatttaataaaatctgaagataattcaacctgttttttccctggagcataattgaatttcacaggatctgcatcaaatggcagatacgactccacccatacctctttatcatgaatagactgaaaatatttatcagcctctttggaaattttacctccatcatgatatacgcgagcaacctgttgaaccggcacagacatcagctcttgagatggcgaaggctctgccttaagaacatgcgaaaaaagaaaagaggacatcccagtcaggacaagaagacatgctgcaatagcaccaatacgcttacgctgttttttataaatacaaaaaagaaccgtaataactacgattgcaattaatactgcattcttacgcaactcatattcgcaatataataacagtccaaagccaagacagaaagaaaaacgctcaaacgatttaccgacggtcgtcataacctcaacaatctgcaccgtcaaaggtaataagagaatcgcaaaaacaacatcagaactatataacagattatataaaacatacgtcgggcataaggcaaaacaaagcagggcaattcggtagccttttcttccataaaaaccaagttctttcatcttgcataaggaatacatcactgcaacagtgaaaataccaatttggactaaaccatataccccaaaagaccttgtcatatatatgaaaggaaacgctaagtacccccataataacgagtgccactctgaaggacttcccgaagcaatatctgcaatcgtattttgatgatcagcttgaatatatcctggataagtcataccccaaacaataagagagggaagagctaggacaagcatatccatgctaagccgtaaccatctttttttaatatccgaatgcgtcaagccaacttctacagcgcccacgaaaagccccctaccttttttgcattcgataatctcgcgttacataattcgtatccataatgaaacgtctacgactatttttagcaagcgtatcctgaatgaaacccaacacaatgcatagcagaccaatgacaataagcatgaccgccccgattagagtcggaaaacgttgaacctgcccagtacggaagaaatcaaataccaccgaaccggtaagtacgaatccaattattccaactagtaaacctaatccaccaaaaaaaggcaacggtttatattccctaatcaacctgaatatagtggaaaggactttaaaaccgtcaccaaacgtattcagcttactaactgacccatctggacgatcccggtattgcacaggtaattcatataaccgaatattattatcaaggctatgaatcgtcatctcggtttcgacctcaaagcccttagataaaacaggataggtctttacaaaagagtatgaaaaagccctatagccagtcataacgtcagtaacgttagcggaaaacagtgaattaatcactccgcgtactgttcgatttccaaaattatggaatggccttttattttcttgaaaatatgttgagcttaatcgatccccaataaccatatcgtagccttcaaggaccttctccaccatgtgtgaagcagcttctgccggatatgtatcatccccgtctgtcatgacatatacatctgcatcaatgtcctcaaacattgcacggatgacattgcctttgccttgcctaggttctctacgaacttgtgcgccagcttgacatgctatctcagcggtcctatccgtcgagttattgtcatatacgtaaatatcggctttcggcagtgctttccgaaaatcacgaacgacttttccgatagtaacttcttcgttgtagcacggaatcaacactgcaatcgaaggttcttcattttgaataagcattttgggaattgccctgttccattcaccttcagtttttcattattttattaattttagaagcatcgccccacacgcccggcgaatcgtatggacgatcagggaacgcgccatagtcgagcttaatattgagatcattctccttgatatagcgctcgacgcgttcagccaatgtcatcggttcaccagtgcagcaattaatgacgccatcaaccgcatcctgcgaaacaactgcactaatctgacgcgcaagctcatctacatcgatgaaatcatacttatttttacctgtagtgaatgggaaagtcgctttgccatcattcgctgcctgtagcagctttgagaaaatagagttaccgtgagcatcgtcgccaacaatgtaataagcacgaatccattgcgcagttgcatcatattccttggcaagcattaaagtcgcctcacgcaacgcattcttagcgattccatacatagaagcaggatggcacggagtgttttcatcaatcgcgccttcccaataaccaacttcatgcatggttcccataacagcgatttgcttgagcccagagtcaagcatgtgcttcaggaagcgataatgattggacaaatcacccatatggttatccgaattatgcttaaagccatcacgccaagccatgtgcaggcatacatcaggagcccctagctcctcaaataaattatcatttggctcaaaaatatttgcttgtacttttgtggcgcgttcatcgacaccatcaagccgtaaatccgaagcaatgacgtcctgtccagcatcaagcaatgcgctcacgacatgacgtccaatatatccgccagcaccagttaccaaaattttcttagccatatttacaaagtctaccagcaggctccccgcaggaaacaagcgattgaatgtctagcccaattttcacgttttttagaaaaactcgtacgcgcaagcggctaatattgcatatatggctgaagagacgtttactcccaagaacattattgtgaccggtggctgcggtttcatcggatcgaatttcgtgcattacgtagtgaacaaccatccggacgtgcatgtcaccgttttggacaagctcacgtacgcgggcaatccggagaacatcgcgggcctgcccgaggaccgtgtggagctcgtggtgggcgacatctgcgacgcggacctgctcgacaaaatcgtgccggggcatgacgcgatcgtgcattacgcggccgagtcgcacaacgacaattccatcgcaaatccggaaccgttcctgaagaccaacgtggagggcacgttccgcctgctcgaggcagtccgcaagtacggcatccgctaccaccacgtgagcacggacgaggtgtacggcgacctcgccctggacgatccggcgaagttcacggagcataccccataccatccgtccagcccgtattcgtccacgaaggcggcgtcggacatgctggtgcgcgcgtggacgcgcacgtacggcatccgcgccacgatctcgaactgctcgaacaactacggtcccttccagcatgtggagaagttcatcccgcgccagatcacgaacatcctggacgggcaacgtccgaagctgtacggcaagggcgagaacgtgcgcgactggatccacaccgaggaccacagctcgggcgtgtggacgatcctcaccaagggccgcatcggcgagacgtacctgatcggcgccaacggcgagaagaacaacatcaccgtattgcgcatgatcctgaagatgatgggacagccggaggacgcgttcgactgggtcaaggaccgtccgggccacgaccgccgctacgcgatcgactcgaccaaactgcgcaccgaattgggctggacgccgaggcacaccgacttcgaatcgggtctcgcgcagacgatcgaatggtacacgcagaaccgcgcgtggtgggaaccggccaaggccgcgaccgaggcacgttacaagcagcagggccagtgaggggatggatttcatggatttcgaaaaggacctgagggccgtggagacgaacattcccggactggtcgtgttcgacctgccggtgcatggcgacaaccgcggctggttcaaggagaactggcagcgcgcgaagcagacaaaactgggcctgcccgatttcgggccggtgcagaacaacatcagctacaacgcgaagaagggcgtgacgcgtggcatccacgcggagccgtgggacaaatacatcagcatcgcggccggcagcgtgttcggcgcgtgggtggacctgcgtccgggcgagagcttcggccaggtgtacacgacggttttggatccgtcgaaggcgatttacgtgccgcgtggcgtgggcaacagcttccaagcgttggaggacggtaccgtgtacacgtacctcgtgaacgcgcactggagcctggagcagaagaagacgtacacgttcgtgaacctcgccgacccggacctgcatatcgactggccgatcccgctggaggactccgaacgatccgaggcggacctgcaccatcccatgctgaaggatgcgaagccgatggccccaaaaaagactttggtgcttggcagcaaaggcaaattgggacgtgcaattcgtgaatacgctgaaagccattcattggagaatttcgaatatcacgatgccgatacctttgatatctcggacaccgcctcttatgagaatatcgattgggatttatatggcaccattatcaatgcggcagcctatacttccgtcgatggggcagaaacgcctgaaggtcgcaaagctgcttggactataaacgttcgcggtgttaggaaccttgcgaagattgccacagaacacagaatcactttggtgcatatttccagtgactatgtatttgatggcactctccaattccacaaggaagatgagaatttcgcgccactaagcgtttatggccaaactaaagccgctggcgatgcattagtagagaacgttccccagcattatctgattcgttctagctggattattggagaaggtcgtaatttcgtaacccgaatgctggatcttgctcaatctggagctacggcagaagctccgaacgatcagttcggtcgactgacttttacggatgacatggctggagcaattttccatcttctgaatagcaacgccccttacggcacctataacatgacaggctcgggacgtgtcgtgagctggtttgatcttgctcaaattatttttgctgcagcaaatgccgacaattcaaagattattgcaaattccgtcgaagaatatgccaaggagaataacgcagctttgcgtccgcataattgttcgcttgatttgagcaaaatcgaagatgccggttatcagcccgccgactgggagacatctcttcatgactatcttgcaaaggaactcaacaaatgaaaggcatcattttagcaggaggatctggtacacgtctgtatcctctgactacggttacttctaagcagctgttgccggtctatgataaaccgatgatttattatccgttgagcgtgctgatgatggccggtatccgagatatcctcatcattagtacgccacaggatttgcccaactttgaacgtcttcttggtgacggcagccaatatggcgtgaatttcagctataaggtacagccgtcacctgatggtcttgctcaagcctttattatcggtgaagagtttatcaataacgaaccgtgtgcgctcgttcttggggataatatcttctatggcaatggattaggcaagaccttacgccgtgcagcatcagttgaacacggagccactgtattcggttattacgttgacgatccggaacgttatggtgtcgttgaatttgatgacaatcacagggccgtctcaatcgtagaaaaaccgaagcatccagcttccaactatgctgtcactggtctttatttttacgacgctcgtgtcaccgagtttgctaaacaagtcaaaccaagtgcgcgtggcgaattggagattacagacctaaataaaatgtatctcgaagacggcagtctgcgtgttcagacattgggtcgtggttatgcttggcttgatacaggtactatggattctttatatgaagctggagaattcgtgcgtacagtgcagcgcgcacaaggtttgccgattgccgtcgccgaagaaattgcattcgaaaacggatggattacaacagatcaacttatggatgcagccattaaatatggtaaatctccgtatggcaaacacctcaaagatgttgcggatcataagattatttcgcaacctgatgatgatccattgaaataataaaatgcatgtatgagtggggtccaattggaaaattggaccccactcatattttaaaaaattacagagatatcggcttttttacctttacttttgtctcttgttctcactggcaaccatgctccagagtttatcgaaccaagcaccacgatgccgattaatcgtcatatcaaaaagcagcccccttaataaatcaagggcgcttgcaaccacacatacaataataatacaaagaatagcttgtgctattgcatattttgaatcataaaaatcagataatacaatccatttagaccacagttgttcacgaataaaaggctgctcagtagcaagatatacaccaaaagaagaagtagcaatcatattgattacgctactatggaatgtcgctctccgaagtaattcaaacagaccaaaactaatcatcaaaatcggaatagaccattctttttcaactggccaaagaaaatccataaggagacttgaattatcggggattaacattggaagagctatattccatatcaaaataaccaatgttcctaaaacaaccaaaattgcagcataattagccttaatttctttcatataccatttgtaatatgaaataagcacaaagacgtattcaaatcccactacgctaaggccattatctaagttagaacctggaattagagccagcgctccccataagacaaataacaccacacagcattttttatgattctcttttcctaaatatctaaggcatggaagaacaaatggaagcaaaaccaaaaaaatagcataactacttacataccaccattcatttcgagttagtggaaagaacatattcaaccaactgaaccaccagtcattcacagttctaggctcagaggaaggaagggccaattgacagcacatacctacgatattccagaagaatagttctctccaaagaagccaaattttacggatagcaccttgtaaagtcactcctttatccgcaagaaaccaaactgaaataaacaaaaaaagagcgataccgatttttcccggagcaagatacagcatctggaaaaatagtctttttacgcaaaagggctcattaaataaatcaaacgtagaatgacaaagcaaatgatgcgagacaataagaaccactgcaacgattctcaataactcaattccagattctcttgatttacctcgtttactcatttcttctctcttaaaacccatccccattcatctaggacgtcctacactccaaatgcatacgttcgtgtctcagtcaagagaccattggaggtatacaattcaaaatgcgtccaatatatccctttttttggataccaacgagcccattgtcctttccagcccgcaacccacgtcttcttttgtgtatcatatattttaatttgataatttccccttggattatctgagttgacaccaagcaaaatgccattcttttcgtatcccgcatatgtgccgttaattctgccggatcctggagcatacgcaaaagcaatcgtttgttcatcaatcttctgctttgaattagcgtctcttacttcacaatgaagccaataagtaccctcattatctgcccatccagcccaattcgaagatgaccaatccgcaattgttttccacacacccgcatttacatcgtaggacatccacttgtattccaaagcctgagtattcgcttccactgcagcgccaaccgctatatcttcagctcgaattacccaagtcaaatcaacgctggatttaaattctttattaccgaaagcattcatatccacggaaccgctgatgccattgatctgaccggagctggtgtactgccaaccacgatcgttggtactgaatgcggtaaatcccatttgagcaccatattgcgccacccaacgggtcttcgcatggatgcttgcgctattcaacggaccattcagataattggtgtacgaatacacgccgagattttgatatccacccgactgcaatgcgctgtaccatgcatcggcaatgccgttatacacattcggatcagtcggcggagtgtgccctgcccaagaccattgttcaagatcgtaaaacactgggtatctcagatcgtttggatccactcccatctgacggagcttggcaaccacatcattgccttccgcacgagcgcaattcgcatcatatgcatacgaataccagtagataccgaatggaatgcctaaacgtttgcattcattaatattgcgctgtgctttcttatcagcactattaccccagccataacccaaacggataatcgcgccttccgcaccatcagctttcgctttggcccaatcaatgtcgttctgccatgaagaaacgtcgactacgcccttggcctgctgaacgaacaaattgtttttgtaatcaaagaatgctttcgtattgttataagttccccaatgcgcgccatactggttgccgtcgaacctggcaagctgtaccgtcgacttcaccttcgaagaggactgtttcacaggctgtttcacggcgtctttcacatccgaaacacttactggaatgaatgactttccatccgtcttagccaatgggtcaggctgctgatcttgagtgccaatcaactgcggatcagttaccacttcgccggtttcaatatcttgcacgtcaccttcaggagtgacggcaagattctgtgaaaccatagtggaatcgtccgaaatgttttcgcttaccgtttccggcagcgtcgcgttcggattgtccggcatgctgtttgacgaattctgcgcatcatccacagttgcggcaaaagaacttggcgtatcctcaatcgcaatatcctgcatggcgtaagccggcaccacggcaacggaaaccgtcattgcaaccacggaagcggtggtcgcaatcttcatcaagcttttcggcgatatcatcgtcagcctctctcacaaaacgcattttcactcgttgacgcaattgcacacgcaaaacttaagtgtattctgagatgtccccactcaaaataaagcagatggattccaaaccaaacttcacatttaccgaatatgccacaacatgaagtgctggcattcggaagtggaacgggtaacataccttatgtattgtcatttgggaacagaggaccttgtcggaccacctccaatagacaacatcaaaacggtatcacggactcctggaggaaagcatggcacggcacgaaaagcagccggacaaagctgacggtcaaacaaatagcgtccgtaagccccgaacgttcagcagtaccgcgaccgtcgaaaccagcaaacccgacaattccgttaacatcaccaatcgtaacggaaagcctgaaacagacgcatcaggggtttcctatcaaacaaacaccaaagattcattccaaatcgccatatcgcaaggcgtgcaagatggcgacacttgggtacataaccatgtcaagaacttgattcgccgttccatcatcgtagccgttatcgtcgttgcggtatgcattgtggtcttcggcgtcatgggcgtgagaacatcgcagaaaatgcgcgaactgaatgccattaacgactgcagagacgcggttgccaccatgaacgcttcatattccaaggatttccagctcaagggaaagattgtcgacgcattttccagcatggattcctcatatgatctggaaaagctcagcaccttgtatcaggaagaagtcaaatcgccgaaggcgcttgactgcaaagccgacccgtccgggaccaccagcaaagccaacaccgaacgagccgcatatgacaaacaggccagaaccttcgagcgggcgttgacaaagaacgaggcaaatcagaattgaatacgaaacgattggcaagaacggcacttgccgttatcgtaaccgtaggaatagtcgttgccatcatcgtcgggtgcggccccaaatggggcaacggttcagcattgcaccaaaacgaagaaaccgcacagtcctcaaattcgcaggtttccgtgactttgccttcctactacatggaaaatatggtcttccagcgcaatcagccgttagtggtcaaaggaaccgtcaaattcgcgcatgccagcaaacagattgacgcatcgaaactatccgcaacacttgcccaaggcaagatgactgcgagcgccactgcgaaaatcgcaaaaaatggttcgtttacttgcacgctgaacgcacagaaagcaagcctcgagtcgtattcgttacaggtgaagtacgacggcaaagtcgtaacggaactggcgaaagtgtatgtgggcgacgtgttcgtggcggccggccaatcgaacatggaactcaactatacgcagtattacccggagaacagcgccaattttggcaacggaatcatcaaagagaccgatcttccaaaaccactcgtcgacaagaacgtgaaattcgttatcgcagatcatgatgtgaagaacacggattttccgctggccaacgtcaacctgaacgctggcgcgtggctgaatgcggattccacgaactcactgcatttgagctacttgacacagcagttcgcacttcagctgcgcgcgaagcatcctaacgtgccggtcggcatcatccagaccgcgtggggcggcacgcctatacgcagacatgtgcgcggcggagatatctacgcgaaccatattgcaccgttgaaagattttcatgtggcaggtgtgctctggtaccaaggatgcgacgatgcgatgaattttgcgaccgccacggagtatgagtcgcagatgaccgcgctgatcaaccagtaccgtaccgtattcggacgcaagaatctgccgttcctatacgtgcaactcgcgcgatggacgaactatcagtacacacagaacgtacgtgaagcgcagcggaccacgcttgacaacgcgaatctgcaagaccgttccaatgtggcgatgacggtttcccttgacaccgataaaggcacatccgcgctgattcatccactcggcaaggatattctgggcgcgcgtatggccgcgcagtacctcgccatggaaaacggtacgaaaaacgctgtcagcgtacctaacggaccgcttattgaacgtgcacggcatactgtggacggcaaaatcgccctgtctttccaaatcggcaccgcaagcggactgaaagcgatgcagccgaactatacgaagagcgcaagcgcgagcgcacccgattatacgaaaaattcgaaagcgacccctcttgacggtatcagcaatatcgtaatcccaacgactgcggcattgcagggattcgaggttgccaactcttccgggcaatgggtaccggccaacgccatcatcagaggcaaccaggtggtgctcagcgcggccaatggaacgccacttgacaatctcagcggtataacccaggtgcgttacctgttcagcggcaatccgaagtgcgcgagcatcctgtacaacgactttaatctgccggctagcccattcatcactattgttgagtgatctttgttgggggccgccgctagataaaccaatacgggcgggataagtacgggcggtctgagccgttgctgggcctgcttggtcatgttttgagcaggctgttccggcttctggtttggattctggtttcccgcttaaactatgaagactgctgcagcatcacagaaactagacaaatgtcattttcccaccggtttatttaggcacattcccctcctactatggcatacggaacgaacgcgagcgcacaatcacagatcgaatgcaaacgtgcgcaggagaggaatcaccatgaggaatcgtattgcagcagctgcagcggcgggaatattaaccatcggcatggccgtcctgccttccgcggcttcggccagtgaagtcgcaccgtctacggacggattggccggcagcaccgccatcagcgggcagatcgaccaggatatggccgtgtgcaccgatcaggcgtgcgaggccgtgcagcacttgaacaagacgaatcagcagatcaagtcggatatggaaaccgccaagcagcacgccgagcagctgcatcagaacgcgcacgaggacgccgacgcgcttcgccagtacggcgagcaggcctggaagaactaccaggaggaccgcgaggatataaagaatgcgattgacggcgcggtcaagcgcggtcaggagcgtcacgacgctctgcatcaggatatgcaggacacgcaggcccacctcaaccagatgcatgccgatatgaaggagacccacgacgaactcaagacgaggcatgacgcgtttgcggcgagcagccaccagtggcatcagtcgttcatcgcggcgctgaaggacgcgaactccaagacgggtcagcagggcggctcatccgttgctaccggcacgcatggcatcacggctggaacgaatgccggtacgaccgttactggagtcaacggcaccactggcactgtgcgcacggctgccgacactggcgcgaatggtgctgcaactggatccgtcacagcttccggcgatcaaaccgccgcgtccaccggcgcgctgaccaagtcggaatatggacagcttgcacaaaccggcatcggcatttcccttgcctgcgcagccattctgctgcttgccggccttgcctacgccatgaagacgttcgtgcagtataagcgcgaaaccagcgaagactgagccggctcgctgccggacagcgtttgcttcatcgactcatgaaaaaacggtctcgaatatatcgggaccgttttttcatgcgcgtttttcgtatgtgcttttcatctgctatacgcattgttgcgattcaattggaatgacgtagtacagcgacgtacaatgcagcgcggagcgcgcgtaccatgcgtgaaccgcgtgtatgtccagtattcccactgatttgttacgttggccgttctgatcagtccactggtcaattcgcataatggggagcgctgctggcgattcgcggcgacggcgtatcgtcattccccgccgtccgtccggtactacccgcgctccccacatcgccggccttttcagcattgccgatgttggttctacgcaacgaccccgcggccaacgagcggatagatcgcctgcgctgcgcctgttccgtctgcgaagcggactgaattgcgggaaaagcgcccgttacgggacgaatacgaccggttgcggtcggaataaagcttggtggcaaaacctgcgttgtgatggcgcttatggatgccatttgcggctgctgcgtattatcaggaccatccgcagcgtctttttctttcacggtttgcgattcttccgcacgattcgcgtcatcattcgcatcctcgcccgtttgcaaggcagacccagcttcgctctgcttttcttgtttttcctgcttttcctgcggagcggcctgcacatcactctgcaatacgattggcgatgaattcgaacggcgtcgggcaagcgccgccagagagtcacgagtatcagcatcgcgttggtcagtctgctggctgccggcagccgtcttgtcaaccatcgtcgtgcttctttctctcaacgtcacgatttcgagcgtaacgtagcgcagcgcaaaagtgcgcgtaaaacgacgatgtacgcaactcccccaccgaatcgcaatcaaatatcgacatatgagggcaaacaatcccattattgagaccacagactggcaccaataagccgcagcatggcaatcagagactttcctggatgccggcccgtacacgcgagacttgcgatacgggacgattcaaaaaaccgaggccaacgaaagaagcattcggagggaatctggaaggaaccggaaaacggagtggaaaagaaggaaccccagaaaccgaatgattccaacggttttcggggttccaatccgggcggagaatacgagattcgaactcgtgaggctgttacaccaacacgctttccaagcgtgcgccatagaccactaggcgaattctccaattatgcaacgctttccggtgtctatccgttaagcgcaacttgactagaatacaacaggactggcagaagaccaaatcggcgtgtcgctctaccaaatctgcaaaagatatagagctccaatatcggttcaaggttagtgacgttttgcaagactctccaataatccggcccaacatgtacatctcgtattcacgcaacatagaatgacggataaccacggatggcgtttaatgaccgactgtcgtccacgtaagcgtaaaaggagcggatgatgatcagccgagagaactacgacatactgaaggaaaaatacggagatgcgtccagctgggccgtctggaacacggattacgcggattccaagcccagccgcaatataaacgatctgagcgtattcgactccccgaatctgtccgaattgaacactggcttcgtgttcgtggggctgaaccgctccggtaaacccaaggacggcaacgcggagaaaaagccggacaagccgaaggatccgtggttcaatttccatgcgggaaggaacgatttcaaactgcgatatgcgctgcagggcacacggtattggggaagctacataaccgacgcaatcaaggattaccaagaaaccgattccggtgaagtggaaaagacactcaaaagtaacccggaacgcgttgatgagaacctcaagggattgagggaggagctcgagctactcggtggcaagcctgtattggtggctctcggatacgccgccgagaaaaatctgaaatgcatgaagtcggaagggtatgaagtggtcagaatattgcaccccgcagccttcatcggcaaaaagaagtatcgcgataaagtgctgaaagtcttggacaacattcaaaaataacgagacattcagctccgaaccacatctaaccatctaatccggatgggcatgagagaaaaatgggggttcccggagcgcgaacccgacgggaaccccggaaacgaaaaaggggcctcccgggagccaaaggctcgaccgggaggcccaacatgtgaagcggcggcgtgctactctcccacaccctctcgagtgcagtaccatcgccgcgcctggccttagctaccgggttcggaatgggaccgggcgtctcaccagggctatgaccaccgcaaaaccgcgatcacggaacgacaaccaaaacatggcggccattccggccattatgttatgaaccgtggcggtctgggaaccggctagcggacgcgaggcaaagcctaccgttgtatcgttcagtgaccatcccaacgcatattgccgtccaggacgatccagcacaggaaagacgcggaaccaatcccgcaaaaggatcggaatgttatgtcgccgtcgcccgttagtaccggtcggctccacccctcacggggcttccacctccggcctatcaaacacgtgttcaacatgcgggctacaacagttcaagaccgtacggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccacgaatgctggcgcacccgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccggacgcaaggtccttcaccccagtgggtctcccttataccgaaggcacgggagtgatttgccgagttccttgaccaggattcgctcgatcgccttggtattctctacctgaccaccagtgtcggtttggggtacgggcggccatggccctcacgccgaggcttttctcgacggcctggacaaccggatatcgaaccataacggctcccatcatcacacctcgccatgcacgccatgcggatttgcctacatgactggctgcgtgcttgaccacggaaaaccacctccgcggccggctcccattccgtgtcacccctgcgctgacctactgcggctacgctcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggccggtttccaccgccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatcccccggttttcaacccaggtgggttcggtcctccacgcggtcttacccgcgcttcaacctgcccagggctagatcatcccgcttcgggtccaggacaagcgactgaaaacgccctattcggactcgctttcgctacgcatacgccacacggcttatgctcgccacccgccactgactcgcagactcatttttcgataggcacgccgtcaccccaccagggaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtaccccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaaaaccatcgtcccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgatccgaccagccacccaggaccggccaccacgcatgggcatcgaaccgcgccacagaaaacccgtggggtggcggtccgggagcccaaaagcatacccataccactcccggacgggacgaatcccatccaagccattgatctcttccacaccagcatccacaacaacgacgccgactgccggcgcccatgtggctcacactgtccaaaaacatggactgtattctccgtagaaaggaggtgatccagccgcaccttccggtacggctaccttgttacgacttagtcccaatcacgagtctcaccttagacggctcccccaaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctccccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatgaatctttcccagaaggacatgcatccaactggagcatccggcattaccacccgtttccaggagctattccggtgtatggggcaggtcggtcacgcattactcacccgttcgccactctcacccaggagcaagctcctgggatcccgttcgacttgcatgtgttaagcacgccgccagcgttcatcctgagccagaatcgaaccctccacaaaaaaaccttttcatgaagagacatcgacacgatgactctcgaaataagaaaattgacgatcgccttataaggaaaggcgcatcgcacaaaaacctcgccgccgtttgaccgatccctcggcaccacgcgtcagcgtggccggcaacgaactggcaatcattgactataaagaagtagtacaaatacgctcttgagttctcaaaccaccaccactcacccacctcgcaatccggagtgaaccggaccactcgctgagcggcagcaagagataaacttacagcacgatcgcgatccgcgcaacccgggccgcatgaacaacgcgtgaaccgttggaaatccaacgttccatcggcgtgtcgaaacttgacaaatcagagcctcttgttctcccaatcgcctatttcgacgccacgcagccacgcaacacacgtgatcactggcagttgaactggtacaacgcccagcccttcgcatatgaagccatattcgaataatcctgaaccttgcgcatcgtgccatctttggcgtactggtcgatcagcttttgatcgtggaacgtgtcgtactgctgcttgaacgtgaacatctgcaggctcggcgcctggccacccatgctcaggaagtatgcatcgccatccgcgctcagcgggcagacggtattcgtcagcaccttgccgtcgcccgacgcgaacgcattctccgtctgaccgaaaatcgcaccattcttctcggccttcgcgttgtaaatcgggaacagcatatccgcgccgtacatcgccgtcgcatacatggaaccgttcagcggatcggaaaccaccaccgaatcggtaccagtctccttcaccaccttcttgagaatcttctccttcgtggcagtgagctgctcgtccggccgcgcatcgtcaatcgtcatattcgcatagacggcatccgacagggcggaacgaacagtattgccgaattggcaggaaatggcgagcgccgcaagcagaacaatcgcaatgattttcgtgacgttcggcagacggccggcacgcaacaatacgacggcggcgaagacgatcagcggcagcacgccgaacggaatcatggtaagcggtcgggtttcggcgcgataccaggcggcggccacgatgttggggaaccagccagtcagcgcggtcgagcagacgtagacaagaccgaccaggaagaaggccagcagaatggcgatcgcgtcgcggcggagttgcgaggcgtcggaacgtggagtgcggtagctgacggaagtcttgcgattcctacgatcggcaggcatagccgcaaaatcggcaacctgttcgtgcggttgcgctgacgtgctatcggatgcacggtcaatcgcagaagcgccgggcacagtagcggaatcggcgcgattggcggcgaaccattgcgggcggatgatggctgcgacggtgacggcaaacgcgatcagcacgattgcggccatgaaccagccttgcacgccgccgatattgtcggtgacgtagattttgagcgcttcgggcaccgtgcggttcggaacgaaggtgtggaaccagctggcgggattgaagtagcggtccgatttgtagctggacatcatgtatacgaggaacacggcggcgccgagaaccactacgccagcaaggcctgcgatggctttccacggcagtcgcgtcagtacgaagggggccatgagcaggagccaggtgaacacgatgcgcggatgggcgaacatgcagacgccggcagtgacgaagaaccatatgatccatttgacgaggtgttcgcgggtggcgagcgcgtcgagcaggcgaagtgtggcgtacagccagaacggcagaagcgtggcggccaggccgaaggcgatcagcggaccggaagccagcatttggaaggggtgcgaggcggaagcgacggcgagcggggggatgatgagcgcgagtatcgcggggaatagcggaactacgacagacgcgacattgcgggccgaggactttcgtgcgttcgcaaatcggggggagcatacggattgtgccgaatgcgacaggcgacgcgtgaaataggaagcgtacagctgaatcgcaatcggccaaaccaagccggatgtggccagccagaccgtgttgaacgcgacgtaaatcgacagattgacgccgaacaagctggcgagcttaatcatgccggctgcaagcagatggaacaacggcggatagtatccgtcgttcggccacaggtgggtggccgcgccgacgccttcgccgaggatcttgcggatgaagtaatagtgcgcgggcgcgtcgatttcgtgcaatgggttcgtccaagcggcggaaccgtgcggaaaccaggcccatacgatcgcagcggcgagcgcgacgccgatggcggaacagaccggcagtgcgatgcgggataagcggggaacggcggaatcgcaaggcaaaggcaaagtatcgttcgtcgtcttgcttgatatcttgtccgtcgttttagccgtcgtttcgtctgtcgtcttgcttgcggcgactgcgctgtcggcttcatcgactgcgtcgtcggccgctgtgggaatcgtattgtctgtgctgtgctgcttcatcgccatccatcgtagccgaagccgcgaaagcaagccacaaatcgcaatcgcacctgcattttgtaatccaaaactggaccgtgcggcaacaaaagctggaaaggcatctaaaaacggatggaacatgcgcgggatgggcgcaagacggacgcggaacgcgggaagaataggcggacgtagagcggagacgagcgcgagcaggaacaaaatcgccgcttatccaaccttcgattttcaggaagtattcagacttcacacagaggtataacagtgttgcgcaagaaaacaatcacgttggatgggcaggatgattgcacggggcgcattgcgctgtgagcgtactcgctgtcgttgcttgactgtgtgcgtcccggccaacgctggcgtcggcatgcgtcgacgcgtaactacagagaactggagaagtaccgcatgttcgttctcaagaacgcatgggctgcgctcggtcgcgtcaaatggcgtaccgcgctgacggctttgcttgcactgctggtgtcgttctcagccgccgtggatctggcggtgctgagggcagatgacaaggcgaataacgaaacataccaatcgcagaaagcttcggcggtaattcggccgagcgcgaaagtcactgcgaaacgcgacggcgcggactccaattacaccgccaattacatgacgtgggacatgtacaccaagtacgcggaagcggtgcagaagaacaacttgacgttcgaatacacgctcgccacgtcggtgccggtgcgcgccagcaagtcgctgcaggcgatcgcggcgaaaagagacacgagcgaggacaagaccggcggcaacctgacgttgcaagccttctacacgaacgatgcggcgaaaatcaacgactacggcacgttcaaagtggtcaagggcaagcagctgaactacaagacggccaacgacggcgtgctggtctctcaggcagtggccaagaagaataatctcaaagtgggcgacaaggtgaccgtcggcaatccgacgaaggcttccgaaacctacaaattcaccgtgcgcggcatctacgagtacaccggcgagacgccggccggatacggttccgacgcgaaatacgcgaaagacaaccgcgagaacgtggtgtacacgtcgtacatcaacttcgcgcaaagcggtctggatgtggccggcaccaagggctgggccatcccgaacctcaacatcatcttcacgctgaccgattcggccacatacaacaagttcgtgcgactggtgacaaaggccaagctggacacgtcgaagttcacgatctcatcgccgtcgcttgatgcgtacaagaagcgcatcgcaccgctggacgccgccgccaaggccgcgcgcacggcgttgttggcgaccctgatcgtcggcgggctcgcgctgctggcattggtgctgtgggccgcgatcggtggacgccgtgacgaaatcggcatggcgatggtttccggcgtcaccaagggacgtttgggatggcaattcatgctggaaacgttcatgatgaccgttccaggctgggcaatcggattgattgccggcgcgctgctggccaagccgcttggcaccgcatgggccggtggacaggctgtggccatcacatccgcatccgtgtggaacatgatctggtacggactgggcgcctgcctggttctgggcatcatcgcgttcatgcgcgtgggattcttcgatttgggtcagctgttcgcaggccgttctgacgattcgaacgaatctgccgaagcgaagaacgcagacgagccggaggaaacagtcgagtcgacggaacgtacggaggtgaacgcatgagcgagaaagacgtgaaagacaacgaaaccgaagcattgaacaacgatgctgcggaaaacgcggacatcgaggcgggcgaaaccgatatggccacgtcgatcgaatcggtcgatttcgcggtggtgtatgacgatggaggcgattccatcgcaaccgaatcggcagaaaacgcggaaaatacggaaggcatcgccacggaagacagcgttgccagcgacaacgcgaatcgcgtgaacgaaacgctcgcattgggcgcgaccgacgacgaacagtcgctcgaccagcacgaaaccgtacaggcggactccgcaaccagcgtgtcatcgcagatcgaccgcgaaatcaaacatcatcgcaagaaggacgcattcttcttcaaagcgaacccgacattcgcgctcgaccatgtgacggtgcacaaccgcaaaaccggtcgcaacgtgctcaacgacgtttccctggcgttccatgccggcgcgacccacgcggtgctggtggatgccgaagatgtcgaacagcatcaggcgctggtggccaccatggtcggcatgatgcggacgaccagcggcaacgtgatgcacaaaagcacgaacctcgccgacgcgacaccggtcgacgtgcttggacaccgcatcggtttcattccgcagcggttcgccgtgcgcggcgaccttgacgcggaaggcaacgtgttgtacgccatggacgcgtcgaaccgcaatttcctgcagcccaagccggtgattgcgcgcgagctgctcaagcgcgtgggattcgaggaagtgacttccggtctgccggtgggcaagatgagtgcgttggaccagcgtcgtgtggcaatcgcgcgtgcgctgagctgcgaggcggaggtgattattgccgacgagccgaccgctggattgaaccgtgacgacgccgccgtggtgctggggctgctgaagaaggccaagcgcgatgaagatcgtaagcgtgcgattattgtggtgaccgataatccggaggtcgccgatcagatggagcattgcgcggagcttgagtagcgagcggcgttctgcgaggcgaaagccttgcggactggtgttgcatgccagtccgcaaggcttttttcgtgctggttcgttccggttcattctgggcgcatgtcatatgcgctatgtgtggcagattctttcatctttggaatctcaaaaccgctatgtgtggcaggttgtttgacgcatcgtgagttagaggggcggttttatgcccccctaatgtatggcgggaaagagaagtgccacagatagcggctttcacttttccgtagatggagaatctgccacagatagcggttttcagtgcgcaaaactcgggcggcggccaggcttcgaggaattttcgggtgtatctcgcttatgaatggcggatttttccgctcgacgcgtgctatctcgcttatagatggcggatggttttgccgcatgagacttagaggggattgaacttgccccctaacacctagtctttctgagacacccgccattcataagcgagatagcatccggcagacaccgaaatccgccattcataagcgagataagtaggttcgctactcggcgatgcgcatgtggtactgctcggcgagcggtttgacgtcgaggacgccgtagcgttccagaaggcgcagccattcgcgcttgttgctttcgccgaaacgggcggccttgcgcgtgtaggcttcggcggtcaggaacttcggcggaatcgacttgctgttgtacttgtccgccaccatgacgacctcctgctcgaggttcatcggcacgtagtcggccgggggcaacggcaatccctgcgattccacggtttcgcgggtgaggcccacacctgtgtggttgcgtgcgaactgggcgatcgattcgtcaacgccctcgttcagcaagtattcgtagcctttgagcccgtgctgaacatagtgcggaccgtcgaatttgagcggttcgccgtcggaaccgtcctgcttgagcaggaaatacgtgccgatgtcgtgcagcaaaccgccaatgaccaccagatgctcgtcgatgagccgcggcggaacggtacctccggtcagcccttccgtggacggcaccgcaggcatgtgcaacatgccgagcgattcctcgccggtattgtctttcgtcagttccagcccgaagtcgccggttttttcgggagcgtccgtcggcagggtgcagcggcgggtgaacagcgcgttctgccggcgggccatgcggcgggcgatgtcggccacgaccacgcaatggccgtggataaggtcgtatgcggcttgcgattgcgcgattttgcgatgtagctcatccacttgcgcaagagtggggatatagccggtcgtcggcttgttcgattcggttgtttcgttcgattcgttcgtcatacgcccatcttaggcacgttccatcacgcccagcatacggttcttgacgcagtttccaaaacggttcccaacagccgaagagattcatacaccacgccagataaatcccggaatggacacggattcaacggtttctccgtcttgtcaacgatgttccaaggaatgccgccttaaaacgagcattcatcagctgctcgcagcggacggcacgatgcgcggggacgttatgtgcggaaaatcagatggaacggacgcggaattcgccggtgcggttggaagccacgatcatctggtcgttttcgaggcgggtccagccgtcttcggcgcgctggtcgaaaccggagctggccacgaccacgcccttcgactgatcgtcgtttccgccgagcgcacggtagcgcagcacgcgatagtcgcgcgcctgctcgccgcgaccgtactggtcgtagatttcgacgatgcgcttggacgtgacctcacgtccggccgcgcacagggcgatgaactggtcctggctttggatcatgcagttgtagctggacttcggatagcttttgcgcagttcacgcacggcctgcgccaccgcctcgtcgagtgcgaagccaaagccgatgtattgcaggatgacggcgaagaaaatggcggaatcggaacggccgccagtggactgcacgatgctcggatcgaccgggaatgcacggttcgtaatgatgttgcggccctggtcgtcagaaatgtcgccattgtggatgaagctcaggccgttcgcatagaagggctgctggttctcaagaatcagcggcaggttggagctggccaagcgcaggtgccacaggccgccgcgcgccggagtgttggcgagctcgtcgaaaatcggatcatgacgggcggcgatggtgtttttgtagatcgcggtgccggtttccggagtcggcgcaccgccgtcgcgacggtatggcgattcgtctggcacggtgatcagcgcggcgccccagccgtcgttgtggatctcgctcagatttcggaaatcgcgcacgttctgcatgccgagcacgccattgaggttggtgttgctgcctgccgtcgcgaatccaagtaatctgcacatggttgattactttagcgacggcaggtttcgacgcgcgcgtgccgttatcggagttggttatagcctgcgattcatccgccgattcatatgcatcgcacgtcgcaaaacgcacgtcacgaacgtaagttgtcccgcaaacgagcaggaggaccgacatatcctgttgcagaccgtaaaaactcggcctgagcggcccggagcgtgtcggtaataggatatgccggtcctcctgcggacttggcggtattcagccaaaggaaaagggctggggcatctcgttcgtgacacactcaaggccgttcggccaagcctacggtcacaaacgaaatgtcccagccctccttgcgtagataagccgtgctcgcagagcgaattcacacgcgcttcagacgcggcggacgctcggtggcgaggaacagcggctgaatctcaatcagcggattgtagggagcgagtccgaaccatttgaccggagagccggccaaatgacgaatcgcgtacttgatctgcagtgagatcgcgcccttctgggacaccttcgactcgggcatcaacgccttgtgaatcagcacgtagcggataggtccgatgttcggatcggcatccagcttcgggtagcgggtggtctgcttgggcagatcgccggacttcgacagatcgttcatgatctggtggatgtatgcaggaatcgactgcgacaccttgaagcccaagcgaatacgcacgcggaacaggaagtccgtgccgaaattctccaccgaatactcgcgcgtgaacgggttgtcggacgtttccaccgacaccgcccaccatgcgcgggcgcgcttcggatggtccgcgaaaatcgagaagaagatgtcggtatcgacacgcttcatttccggatcggacgtcagatagacgatgttgtccgcgaaatacggaatcgaatcgtcctcatgaagccgcttcagaaccggcacgcaatcggcgggctgcatatgccggcgttgcgcgcgttccagcttcgtgccttcgttccacgtgtacataatcagcagaatcgccaatgtcagcagcatggtgaaccagccaccgtgcaggaacttcgccatcgaagcgaagaagaacaggaactggatggccaggaacaccactgtgaacacgaccgcgccgacgcgcttgccatcgtgccaaatgtagacggccagcagaatcgtcgtggtgatcatcgtgacggtcaatgccaggccgtacgcggcggaaatatgctccgaatcgcggaacatcgccaaaaccagcagggtggagacgcacagcacggcgttgaccaccggaatgtacagctggccgcgggtacgagccggatagcgcacctgcaggtggggcatccagttgagtcgcgtcgcttcggaaaccatggtgtaggcgccggtgatcaacgcctgcgaagcaatcacgccggcgcacacggacagcagcaccgccacgtaacgcacggacggggtcatcatttcaaagaacggattaaggccgtgcatgtggttgtacgcggtgtcgtcccaatggttgagcatccacgcgccctggccgaaatagcagaacacaagggcgatcttgatgaacggccacgtgaagtagatgttgccgcggccgacgtggcccatgtcggaatacagcgcttcggcgccggtggtggacaggaacacggtgcccatgacggcgaggcctgccgcattgtggtggctgaagaggaactccacgccgtacaccggattcagcgcttcaagcacgctccaatcggagctcaggttcaccaagccgacgacggcgaggaacgagaaccagatcatgaccaccgtgccgaacgtgcggccgatgcgttcggtaccgcgcgactgcactgcgaacaggcagacgatgatcacaatggtgatcatcagcgtcagttctttgtttccgctcatgatcggttccagcagcggcagtgtttccaagccttccactgccgagctgatcgagacggccggcgtaagcacggaatcggcgaggaacgcggcgccgcccagcatggcgggaatcgcaagccatgccccatatttgcggatcagcgaatacagtgcgaagatgccgccttcgccgttgttgtcgatgcgcatggcgatgaacacgtatttgacggtggtgatcagcgtgatcgaccagaagaccagcgacaggatgcccagcaccgcggcgcgatccgtatgcgccaaaccgccttggccgttgaggaacgtctgcatggtgtacagcggcgaggtaccgatgtcgccgtataccacgccaagcgccacgatggccatggccggcgtgattttgtccgggccggactggagacggctccaccagcggccgatgcggcccttgctggcggcctcgtcaagtttcgcggcttcctgctgctgcgcctcgtgctccttgatgagcgtctggcgctcctccttggtcaggaccttgtgcgagacctttggcgcctgcgtgtacgtcgctgcgtgaagcagcgactgttcttcttcgttcggctcgttagccataacgcttcctccaagtggcgggccttccaacccgctccccaaaataaaacgcaaggtgtgacaccaggagcttggcaaaccattgtcaaatcttcacacgtgattcggcacgtcacgcatgaaattcacatatgcttagtcgtttgtattttgcttattttctggcgattacgcaactgttacgttgaggcccatgcgaccgtcacggaaccgccacgggattaccgcgaaatcgccattctttttagataccgtacacttcgcgcgtcgtttcacgcgtggctttggcgatttcagccaacggtctgtcaagatagtcggcgagcgcctgcagggtgtacgggatcatatacggcgcgttggtgcggccgcggtagggcatcggacttaagtagggggcatcggtttcgaccatgacgtggctcatgccgacgagtttcgccgattcgcggattccgtcgttgcctttgtagctggatgtgccggaaaggctgagataccaaccgttttcgcgggcgatttcgcccatttcggcgtcgccggagtagctgtggaacacggtacgttcgggggctccgtcggcgagcaacgtttcgatgacttccttgtgcgagtcgcggtcatggatttgcatgggcaggttgagttccttggcgagcgcgacgtgggcgcggaacgcctcgcgttgcagttccttggcggattcgccggtacgaaacaggtccatgccggtttcgccgatggcgacgacctggttggggtaggtggtggcgaggcggtgcacttcggccatggcttcgtcgaaggggatgtcgtgccagggcttgtatttgatgggcaggccatcggggccgggtgcgccgcggtggccgtgcagcacggcttcgttggggtgtatggcgattgcggcgtgcacggttccggggtgttcgcgggccatgtcgatggcggtcatgaggttgggcagctcgcagccgcagtcgattacgccttcgacgccgactttctgggcttgttccagcagttcgtcgacgctgtagacgggtacttcgccttggcctttttccatggcttcgtgactcatggcttgggagaatggcacgacggatgcgacgtgggtgtggttgtcgatgacgtgcgcgtcttcgggcagcggctgtggggccggggcccaattgcgattgcggtggtgcttgctcatgttttccagattagtcccgattggccctgcactgcgggcgaactctcgttcgagggttcaaacgagggtccgcccgtttcgcggcatacacgtcacttaatcgtgatggtggtgaacgaccatgccggtgccgtgtagtcgccgtctgtcagatcaatcgcggtctgccgcggcctggtcggtgattcctcaccgacctgtcccgcatatggattgtctccggctaggacggtggccgtggcggatgccgccgatgctgtggaaatattcaactcggcaagaatctgacgtaggtcaacgcttattggcgcgtccatggcattgaccacgcgcacgtaggtctctccggctttgtcattacgtgatacggtgacggtacgccttggctcgtccttaacctccgtgccatccgcaatcagcgttccatcgatgtacagcttcatggcttggccgcgatcggtgacgtcaacgtgcacctgccaagtggtgcccggtcgcacttcgttcatggagacttcggtgccggcaagcgcgtaggcggtgccgtcgcggaccacgcgcacgctgtgtcctcgaccaagtgagatgatgttgtggttcttgccgtcgatatcgccacagatgaggtccatgccccatcgtccctcgtaatagacgacggtagtgtcgatactgtaggaatcagcgtgcagatcgagggcggtgtcgatggttctgccatcgtaggccacgttgccgagattaatcgtctccccggatgcggtggtgatggtgagattgttgagatcggctttggcattgcccgcgatgcgtagtctcacggtgtccggcaggctgcgacgcaatgtggacgggccttcgacggtgacgggccacgcggtgtcggccgtggtggtggcgtacatctgctgcacccaatagctgtaggggtgataggcacgctcgttgtcgaagtagataaggtccggattccagctgtggtggccgttcttggcaaacagcggagcgtaggaggccatggccaccacgtcgccgttgagttccatgcgtcccatgaaggccgcttcggacaggccgttgatcagttgggtgttccaggagccgtattcgccgaggtagaccttcggccccttgcggtccgtgtggtcgtagtggtcgaggttgtggaaccaccagctggacgactggtaggaatgttcgtcgacgatcggcagacccgcttcgcgcgcgtacttccagccttcctcgtaatcctgaccgctgggggcgggaccgacggtgccgacgacgacgatgtccggatatgcggctttgacggcgtcgaaaatctgctggaagcggtttttgaacacgtcgtcgataagatcctcgttgccgatgccgaggtattcgaggccgaacggctccgggtgacccatggcggcgcgcttggcgccccattcggtggcggtgctgccgttgcagaattcgatgaggtggagtacttcatcgatgtaagcgggcatatcctcctgcgccaccggcaccgggccttggctggtgttttggcagctcacgccggcgggcagcaccggcagcggcttggcgccgatagtttcgcacaggcacaggtattcgtagtagccgatgcggaatgactggtggtagccccagaggttgaagttgtgcggacggtgctcgaccggtccgatggtgcggtcccagtggtacatgttgtccatgccgaggccgtgggtgatgcagccgccggggaatcgcatgaatcgtggtttgaggtcggcgagcgcctccaccagatccgggcggaaatgcttgagaccgtggtaggtggtgcgcggctccaaggcgacgaagtcgaggtcgatgacgccttcgccggcgaaggccagacgcaatgtgccctgtgtggccacgctcgagccggcatcgccgtgctcaggaacggtcagcgaggcttggtatgtcgtccatgccgaggctgagacggtgatggtgttttcggcgatgatgctgccgtcgtctccgcgcagcgagaccgtcaccggcatcgcgctttccgatcgcacgcgcatccaggcggtgaaatcgtaggtttctccggcgcggaacaccatgccgtcccagccggtgttgtccagcgcggcaggggcatgttcgacttccaccgtcgcgtaatgcgggttttcggtggcaaccgggtcattgtcatggataccgaaggctgcgaacgagccttccggcacgattttgcgccagaagctgtagttgctccaatcgatggagtcggcgcggttgtattcgaaggcaccgttctgcacgaggtcggcgttgaggccgccgtcgccggagtagctgatgtcttcgaagaagatgccccacaggtcggtgctgatggcgcgcacgcccgctttgtcgagtgtggcggtgagtttgtcggtcatggtgtgtccttgaatggtgttggttgttgggttggatggtgttgaggtatgtgcgattgcacggtttggcgttcgtttcgcggctattcgccgccggctggcgtcagacgggctcagtcgagcgcgaaccagaggcagccgtgcgcagggatggtgccgcggatgacgcggtcctcgccttcgccttcgatgcggacgtccgatcggatgccgtcgggcgattgcggagcgtcggcccacaaatcggtgagcgtccagtccgcgttgcgttggtcgatgccgacgaagctttgcagctggatgttgcccttgagctcgtacggttcgctgccggtccagaagatcgcgccgtagtggccgcacgcatgtgccgacgtggtaccgtcggcccagtcggccgcgtcggcggtccatgcgatgagctcgccgatgaaggattcctccacgttccattcggcgaacagccgttcccggacgatttcgcggttgccggacgagccggcggtcacttcgcgcagggccgggttggcgagcagtgcgatggtgtcagcgttgctggtaggcagatcgccgccgaccatcaacggggatctgcccatgctccacagggtgagcagtgttttctgctcgtcgcgggtcagtttcgattggcggtcatcgccgcgttcggcgcgcaggccgatatgtccgagcggcagcatgtcggcgtcggcccaatggccggtgcgctgcatcggcgcccatcgcgcgagccgggggaactgctggtagatgtcttcccagcggtcccacaaatcgtcggagatgcgccacatctgcgagacaccgcggagaaaatcgacatgggtgctggccacccagcctcccggggacagcgatagcgtgatcggtcggccgtaggcggcttccgcgcgttcgatggcgtgatggtaggcctcgatctcctctgggaagaacggggtctgcatgtcgtcgaccttgaggaagtcgagcccccaggaggcgagcaggtcgacctgtgcgtcataccaggcctgcgcgccggcatcgccccgcttgagaccatagttgtcgtgattccatgcgcaagtgtgctcggtgtcggcaacgtcctgcgcatgcagcgcggtgcctttgaccggcaggttctcgtgcacggcctgtctcggaatgccgcgcatcacgtgcacgccgagtttgagaccgagccggtgcaccgcgtcggcgagcgggccgaatcctttgccgtctgccgcactcgggaaacgttgctcgtcgggaatctgccggccatatgcatcgatgcacaacggcgtgccgtcggaatagccatgtgcatgggcgttggggtcgaaccagccggcgtcgatgaccagcgtgtcccagccggcgtccttgagatgctcggccatgaagcgcgcgttgtccagaacctcctgctcggtgatggtggtgccgtaggagtcccagctgttccaacccatcggcggacgccaggctttgactggcatggcctcgggtaccgtgtggccgtcagccggatattcgtcagccggggcgacggaaacggtggttgggatcgtcatcgaacctctcttttcgttcgggatcgctatgggggctgtgtcgcggaaagcaggacgccgtcatgcgaaccgtatatgtatcgttacatatactagcgcaaatccaatcatccgcaatggaggcaatatatcggtgagtctttgtatttgcaacgattttacagaatcaagagaatataatatcgttacatatcaatcataagttttcaaggagcggcatatgaccagcagcacaccgacgctacgcgacgtggccgcggaagcgggcgtctcccccatgaccgcgtcgaacgcgctgcgcggcaagccaggcgtcaaggaatcgacccgcgccaaagtgatcgccgcagcgaagaaactcaattaccgcatcaatctgacggccagcatgctcaaatcgggccgcagcaacatcatccacgtcatcgtcaacgaattcgattcgccgttctattcaaagctcacgcaggcgttgagcaacgaaatcgtgtcccgcggacttattccattcatcgagcagacgcagtattcgccggacgctgccgagcacgcgctgagcagcaatccgttctctgggcagctgttcgatggcgagatcctgcacgccacaggcttgggcacaaatgtgccgctgtccaaactcaatggcggcagaccattcgtgctgctggacgcctgcgaggagacgccgaccgtcgatgccgtgaacttccccaacgaggaggccgaacgcgcggcgatgcagcatctcatcgaccgcggatgccgcaatatcgcgatcgtcggccaccggttcgcccccgcgccgatctggcgcatgcccagaacgcgttcgctctgcgattgcgcggcgcatgcggagcgctgtccgacgccggactgccctatgacgagtcgatggtgttcgaagccggggatgtggccaatggcatcatcgccgggcatgcgattgcggaacgtattctcgccgcacggagcggacatggtggcaccgagttcgacggcgcgtgctgcgccaacgatttcgcggcgttcggcgtgatacgcgggctcgcggaccgcggactgcgcgtgccgcaggacgtgaaggtgatcggtttcgacggcgtgacctccggctcgtacacgacgccggcgttgagcaccatccaggtcgatttcatgcagcttgcgaaattctcggtcgatatgctgtccgaacgtatcgatcatggagcagacgaggcgttgccgccaagacgggccatcatcggctaccagctggtggaccgggaatcgaccgcggtctgaggatgacgcccctatggcaggcaatccgccataggcagcagccttcgcagccaatcccactcaatcggaatcactcaatcggaatcaatcgccatcattcatcaaggaatctctaggagcatcatgagcatcgacacccaggcctatctgttcgtgcatttcatcggcgaggaacgcaatcccaccgacgaacagctgtacttcgcgctgagccgcgacggcgtgcattggagggatctgcgcccggccggcagtccggcgttgacgtggctaggcggcgagaagggcgtgcgcgacccgcatattgtgcgcgacccacgtggtggattccacattgtggccaccgatttgagcatctattaccgtggcggctgggggccgaacgatggcgccaccacgaatggatcgaccggcctggtgatctgggactcccctgacctggtccattggagcgagccgcgcctggtggacgtggcctcgaagattccggacgctggcatggcttgggctccggaggcgaattgggatccggatcgcgggcagtggatcgtgttctggtccacgaagagcaacgccgaaagctccgcggatccgttggccaacgagctcggcgatccgacgaatgtgtattatgcgacgaccgttgatttcagggtgttctccgatccggtcaagtggatcgatcgtaagaatgtgatcatcgattcgaccatgctgcgcgacgatgacggctggtggtaccgcgcgtccaaggactcggaaatcaccatcgaacgcacccgtaacccgtatgcgacgacctacgaggtgctgcgcaccgacgacccgaatgagtggtcgtatgtgggcacgctcaccgacatcttcggcaatggccggtattccatgcactacttggaagggccggaactgttccgttacaacgacgaagacgtgaaggtggtcaacggcaggaccatgccattcggcctgatgtgcgaccagtacgcggagtccaggggctacctgtcgttccgcgccgcctcgctcgcctcgcatgatccggccgattggcagcgcgcagacgatatcgatttcggcgcgctgaagaagcgtcacggcgcgattctgccgatcacggccgccgaatacgacgccatcgaaaccgccttcgccctgtaggcggcgcgattgcccatccgtcgcaaccgctcaggcgcggcggatggcgaagatgcgggcggacggctgcttggaggtggccgcgttgagccggaccgtctcggggtccatgcgctcgacggtccacggcttggcgtcgggcgcatgctcgggaacggccggattcgggaagatctgctcgatatggcagtcctcggacagcggcacgttcacggaaggcgtgccgccgcgacgccagacaatgatgtaatcgcacgaatcgtcgtcctccgacgggaggaatgacggatggcgcagaccgacgacgagccaatcgccatcgaaatcaggcagacgggccggccagaacggcaccaattcctgctgctcggtcagcacacggcggtgcaaggccaccgcatcccgcaccaaggcaagccgatgctcgtccatgcggtcaatgaatccggacaggtacaacctgccgagtatgcccgtggccagcgtgaagacggcggtctcatcgtccatctcctgctgggcgtaaccccagttgccttgctgttccggcagaatcgtcagtccggcgccggcggcgatcgcggcgtaaatcagcggatcacactggtcggaggtggattgcaggtccaatcgttgcaactgcgcgtaatcggcgcgcatcgcaccggaaccgcagttttcaatcataacgtccggatggcggcggcgcaggtcgtcgagccagtcaagataggcgcggcaatggccgagcaggccagcgccggcggattcggcgtcgagatcagtgccgacgccggggacggtgttgtagtcgaatttgaagaagaccgcgccgaaatcgtcaatcagccggttgacggtgcgagtgacgtgctcgcgtgcggcgggcgagcggaagtcaagcaggtaccggcccgaatcgcagacgcgcacaccgtgacgctggaagaacgcgtcatcgggcagactttgggcgagcggcgatttcacgccaatcacctcaggctcgagccacaatcccaagcccatgccatgcgcgcggatggtgtcggccaaacccttgagtccagcttcgccgaaacggttcgtggaggcctgccattctccgaccatgtcccaccaaccgccgtccgtgctgtcgtaccagccggcgtcgatgcagaagatgtccgcgccgacgcgtgccgcgccctcgacgagcggcagctccttctccaagcgcgggtcgccgaacagggtgttcatgtaatcgttgtagatgacgagtccctgcgtgcgttcgaactgctcggaacgacccaattcgcgagccttggcggcacgcaacgcacggcgctgcaatgtcatttcggcgacggactgctgccaatcgccggccgagatcgcgaaggagaccggcaccgattcgaaatcgtggccttcacccagctccgtataccaatggtggtcctgatattccggtccgaacgcgctgatgtgcaaaccgggatcatcctcgccgatctcccattcccatgggccgttgtgctcgatctgccacatcacggagaagtcgcgcgattggcggcgcgaaccctccacctgcacgatgccggccggctcatgcacgccggtgctccatgtggaggcggagctcatggcgaatcgcgagctggactggccgggattgatgacttgattgcgattgcgcaccgacacgtcgcgcagtggacggctgcgccaatcgttttccaccgcccacgcggagtctccccagaatacgcgggaatggtcgattttgccgcagttgacgcgcatcggcaccgtcagattcaacgacgacaccgcctcgatgggcagcgggcgcgcggagctcaaccgcgtgtaagtgcgcactgcggacagacccgggaacgcttcgaatacggaagtgactaccagcccagccgtggcgtcggcatggcggacggtttccggcgagggctgcgcggcggcttcggcccgttcggcggcggtcggttcgaacgcgcgcccgtgcggctccagttccgcatacgaagcgaattggacgatctccaaacgatatggttcggcggacccttcctccggctcggaagcggcggccgagacgaatcgcaatacgctgcccgccaccgtggcgatcaaggtgaggcgattgtcctgcgatccggtgttggcggcacgcacttcgacgattggacgcggatcacgttccagcacggttcttccatcgtcggtaacacggccgccgatgggccccatgccgcggcctgcaacgttgcacaatcggacgggggaatcgcctgccgtgtcgaacagcatggaaaccacgccattgccccattcgagacgcccgtcctcacggggacatacggggttcattgcaccggcaccgcttatcatcttcgactcctcaaccgtgttcagataccgcctgatcattgacgtgcatcgattgacgtacctggtactagcttaagcggcaaatggggcaaatcgcacgtgcgtgtctactcgaagcggagatatgcgatgaacttgactggcgcatccttggttttggcgatgttgccgaaaccaaggacagcccctttgtcgggcagtcccttcgtcactcgtcatgctcacccgcgtaggaacaccgtcatctcgttctcgccacggttggcccatgcgaagtatggaatcagcgtggccgtcgtcgtcttgcgttcggcgggacgccaatcatggtacaacgcggaggtttgcgcggagtcttccacttcacgccaagcgggaatcgccagcgtggtcatcggcatatcgacggcgtccacctcgccgagcccctgctcgtcctgcgcgacggcgccggcatggaagacgatgcgatcaacggacacgcaggacgggtcggatgcgatgcgcgcggtatcggcgtgcagcagatgcaggttcgcgccattatcgacaccttccgcgcagtaggccagcggtccgcgcacgaacgccacctttccggcgtcctcgcgcacgaacggattcgcggcgaccatgtggaccggcatcgggaaatcgaaatcgacgacgtcgccgtcatgccatgcgccggtcagatacaggtatccgtctctgatgacgcgggagatgtcgtcgcggccgcgcacggtgaccgcatcggaagcggtttcgccaccggcccaggcgggcagacggagggcgatcgtgaaaaccgcgtccttggatgcatcggaagcagaatcgcctgcatcaaagcccaccgcgacggatcccttgccggaccagggcatatcggacatgacgtcaaggcgcacatcggtgccggaaagcctggcatggacgccgccgcccatatacagatgcacatacagggtggatgagtcgtctccgatcgtgtaggcgtactgctgcacgtcctccacgatgcgtgcgatgttcggcgggcagcaggcgcatccgaaccacttctggcgcaccggcttgacgtgcgccttgcgttcatcgcgatggcatgcctcgggcaccacttcgagcgggttcacgtagaagaagcttttgccatcgagtgccatgccggcgagcgtggtgttgtacagcgccgattccatgacgtccgcatattcggatttcggctggatttccagcatgcggcgggcgaagaacgcgagcgcgatggcggcgcagctttccgaataggcggtgtcgttcggcagatcatagtcgaaggagaaggcctcccccatgtgtgtggcgccgataccgccggtgatgtagatctttcggtcgacgatgttgcgccatagtcgttcgcaggatgccagcaggtcggagtcgccggtcaggcgtgccacgtcggcggctccggcgtagaagtaggcggcgcggacggcgtgtccgagggcctccgtctgttccgtgatcggcttgtcggcctggtagtaggcgtagttctgctcgcgcggcgcgtagttgcggccgtcctcccgggcgcggcggcggtcttcgagctcgaaatagagcggctgccggccgcgttggcgtacaaagtattcggcgaggtcggcatagcgctgttcgccggtggtctcggcgagtttgacgagtgccatttcggcgatttcgtgcccgggatagccgtgcagcttgccgtcggcggtgccgaatcgggaatcgatgtaatcagcgaaacggcaggccgcgtcaagcagcttgcgtttgccggtggcttgatagtaggcgatcgcgccttcggtcaggtggccgaagcagtacagctcatggtggtccttcaggttggtgaagtgccggtccatgccgttgaggatgtagtaggtgtccaggtagccgttgtcgagctgcgccgcgcagacgatatcgatggcggtgtcggcggtcgcttcaaggtcagcgtccgggtggtgggtcagcgagtagccgaccgcttcgatccatttggagaaatcagtgtcttggaacacgaagccgtagaacttgtcggaatcggggtgcgccgggtcgtccggcagggcttcgaagccgcggaacgtgtatttcggcggcacgaaggccttgccttccttgtggtgttctgcgttctgcgcggcggcggccttgaagttgtgcatgcagtagctgggtgcggcgccgggaacgttgtcgttcagcgcgttccactggtagggaatcacctgggtgcgcacgagttcctgccgcgatgcccagaacgggtcggtgacggtggcgtcgcgcaatgcgattggatggctggtgcgattggtggtagtcatgagtgcaagcgctccttagtgcatcgttgtcttgttaacgctcacaatccattattccacgggttgctccaaagtacattccgcatggcggcatgtccgacgggaatcccaccgcggcagccggcccaagatggccgcgcattggctgcgcgaccgttggacaggcatttcggattgcggatatacgggctaaggggcagagcagctagccgccggggctggcggccggctgctcagaccttgatcatggcgtactgcgattcgtagagccggtagtaggcgccatggcgggcgagcagctcggcatggttgccctgctccacgatctgcccgtggtcgatgtagcagatctcatccgcattctcgatcgtggacaggcggtgcgcgatgatgaagctcgtgcgtcccttgagcagatggttcagaccggcctgcagcgcctcctcggtacgcgtgtcgatattcgacgtggcctcgtcgagaatcaggatgcgcgggtcggcgagcagcacgcgcgcgaacgcgatgagctggcgttggcccgcggacagggtcgaaccgcgctcctccaccacggtgtcgtagccgtctggcagttccatgatgaattcgtgcgcatgcacggccttggcagcggccacgatctcctcgtcggtggcgtccagtttgccgtagcggatgttctcacgcacgttgccggagaagatgaacgtgtcctgcagcatgacgcccatctgccggcgcaggctttccaacgtgacggaacgcacgtcgtggccgtcgatcgtcaccgagccttcggcgacgtcgtagaaacgcgacagcaggttgatgatcgtggttttgccggcgcccgtaggaccaaccaacgcgatcgtcttgcccggctcgacgtgcaggtcgaccaggttcaggatgttgcggccgtccggctcgtagcggaagacgacgtcgttgaagtcgacgcgaccctcgatctgcggcagattgacggcgtccggcgcgttacggatctccggctgcacgtccagcgtttcgaagatgcgctcgagatacgcggagcaggtgatcagctggttgtagaagttaccgatgctgatcaccgggttccagaagttgttcgcatagccgacgaacgcgatgagcacgcccgtactcacctccactcccccaaaaccggtgacgccgacgaagtagatgagcgcgatggtcatgacggaaatcgtctggatgcccggccacatgaggaactggatgtgcacggccttcatccacgaggtacgcacatcgttctgctgctcctggaacgtcttgaactgcgcggcctcctgggcgaaggtctgcgtggttttcacgccggcgatcgattcgtggatgtacgcgttgagattgctctgcttgttggacagcacctggtaggcgcgacgctggaaatgctgcagcaccagcacccatgcgatgaggaaggggaacagcgcgaggctgaacagcgccaatcgccagtcgatgacgaacatgaccaccagcgtgatgaggaacgtgaacacatcggaaatcacattgattaggccggagctcaacgtatcggacagcgtgttcacatagttgaccacgcggatcaggattttgccgtgcgggcgtgaatcgaaatagctgaacggcagcgtctggatatgcgtgaagatgtcgcgacgcatgtctttgagcatgagctggccgacgcgtgtgatctccacggtgcggtagcgcaatcccagttcgaaaatcacgatcagcaccgcaagcaaggcggtcagctcgccaagcagcgtgaggtttttcgtcgggatcgcactgtcgatcatgactttcgtcaggtacggcaccaccaccgcgatgcagctcatcatcaccacgaccgcgaggatgcggaccacgcgtgccatgtacggcttgagatagacgccgatgcggaggatgtcatgcaggttgatctgctcctcaagttcctcatcctcgcggaacgtattgcgttttgccatgatgatcctcctttctagtcgtcaaaaccctgtgcgcggccggcttcgaggcccagctgcttgcggtagatctcccaatatcgcccatgcgcggccaccaggtcgtcgtgggtgccgcgttccaccacgcggccatgttcgagcacgagaatcaggtcggcatccttgattgacgagatgcggtgcgcgatcgtcacaattgttttcttctcgtccaaatcacgcagatgctgttggatttccgcttccgtctccatgtccacggcgctggtcgtatcgtccatgatgaggatcgacgggttgtcggcgagcgcgcgtgccaggctcagtcgctgtttctgcccgccggacaggccgacgccgcgttcgccgacgacggtatcgtagccttccggcatgctgcggatgaagttgtccgcgcctgcgatggcggccatgcggcggatgtacttttcgtcgtattcgcgctgttcgccagcgccgaagccgatgttgccgccgatggtgtcggagaacaggaacgtgtcctgcgcgacgatgcacacctgcgagcgcagggtggcgagcggccagtcgcgcgcgtcgatgccgtcgatgagcacgcggcccgcggtcgggtcgtagaatcgcgaaatcagattgacgagcgtggacttgccggcgcccgtctcgccgaggatgccgagtttcgagccggcggggatgtggaagtcgatgtctttgagaatcggggtttccggatcgtcggggaaggcgaagctgacatgctggaagtcgacgtcgccggcgatgcgcgcggggcaggccgcggacaccgcggtggcgctgtctgcttcatggacaccgttggtccggccgttgacttggctgacgatagcgactgcctgtttgacgctttcctcagcgcccggcttctcctggatacgcgactgcgaggtcagcagtttgcgaatcttgatgcaggacgcgttgaagcgttgccaatcgttgatcagccagccggattggcgcacgggaccatcgatcatccacaggtaggagttgaacgccaccaggttgccgagggtcatatggcctgtgatgaccaggaatccgccgaatcccaaggtgatgagctgcagggagaagccgaggccgtcgagccatggcatgtatctgcggctgttgtaggcctggtccatattgcgctgcatgtagtcgtcgttgcgctcgtcgaatttcttggtctcgtacggctcgcggacgaacgctttgaccacgcggttgccttcgatgttctcctcgaccatcgagttcatttccgctagggaattgcggatggcgaagaacagcggccgcgcatgcgaagataggccacgcgtcaggatgaacaggaatggcgtgatgcaggcgagcgccagggcgagacgccagtcgatggtgaacatcatggcgagcgcgccgatgaacatgaccacgcagtcgagcgcctgatagctgacccagcttagcgcgtggcggatggcgtccgtgtcggaggtcatgcggctcatgatgtcgccggtgcgggtgtggttgaagtaggtgaagtcgagctcgtgcagtttttcgtattcgtcgctcaccaggcggaatacggagttttgtccgaaacgttccatccacatctggtagccgtagcgcgaggccacgcgcacgatggtgaagacgagcatcatgacgcatagtcgggtcagttcgtccacatggccttgggtgatgacgcggtccacgatcagtccggacagcagggggatggtgagggccatggtgttgttcacgcagaacagtacgaccgcgccggccacgcgcggcaggtcgggtttgcagtatggcaggatccatgcaaggttgcccgcctgctggttgcgtttcggatcgacatacatacgtagcgttccttcgaattgtttgcttgggtcttggttgggttgttgttgggttgttgttgggttgtggtgttgcggccattcgttgccgccacgattcacgtccgtcgtgtgtcgagcgtcccgtcaccggcatgccgccgccggccgaaacccctgttcggattcgcaaactcgacttattttaaacgaaccgtacgccgatgcaacagatgcgttttcggcgtgtcgcaatcataataaaatcaacatatataccgttacataccactggtttgcgggtgctgcgaaaaccgtcatcggagcctggctcgccggaatcagagcatcgcatcggaacatcgcacgataatggaatcaagctcgaactatcgatacgagcatcggcgacgcacgtcgaggaaaggacggcaaggatgacggacttggagcacatccgcgcgaagttcgctgcggaatatggcctgtcggaggacatgctcaggaacgcggaacgttggacggagaccacgggcgacctcgaaggggttcccgagaacctgctgccgggcattctgggaatgcgatttggcgcgatcaccatcgatacgccgcgttccgaacgctggagcacgccggaagacatcgatgtgatcgccgacctcgcctacctgccggatggcgggtacgatacggccgcgggagcgtgccgcggccatttgctcgacctgtatctgccgcatgacgcggtattgcgcggtgggcacaccctgccggtgtacatcgatatccatggcggcggattcacttacggatacaaggagctgaaccggaatttcaacgtgcatctcgcggaacagggcttcgcggtgttttcattgaactatcgtccggcgccgcagaccgacttgcgtgggcaattggccgatatccaggcggcattgcgttggatcgcagcccatatggccgattatccggtcaatccgaacgcggtgttcctcaccggcgattccgcaggtggcgcgttgacgctactgaccttggccattgaaaacaatgcggaagccgcggctgcgtttggcgtcgacaagccgtccggcatccgattcgcgggtgccgctccggtgtgcggcgcgtacagttcggcgtcgttggagaccatgggccgcaagctgacggtcgggtatgacccgaaccgccgtatcggtcttgagcagatgttgggcgtcgatttctttgcggggctcgaagccgctgatccgaagttcctcaccgctgagggtctggcgttcaacgtcgatcttccacccttgctcatcatcacctgcggcgacgatttccttgaagccgacaatctggcgttggccgccgccttgtcgcgcaaaggcgccgattttgaattgttcgacccgaagccgcgccgccatgagacgttggggcatgtgttcgtcatcggcatgccatggcttgaggaaagccgggaatgccttgatcgaatccgccgcttctcatacgaacgctgttgaataacgtgaatggggtgaatactccttcggagtgcccgccccattcaatggccgtcgatgccgcgacgccgtatcagcggcggaccatttcctcttcgatctgttcgagcgacttgcccttggtctcaggcacgaaacgcagcacgaacgggatggacagcgcggagaacacgccaaagatggtgaacgggccgccgacgttgttgccgaacatggccagcagcatgaggaagaactgggagaccacgaaattgcccagccagttggcagcagaaccgaaggagctgccgatgccgcgcacgctcaacgggaagatctcgccgatgagcacccatgcgatcggaccccacgacagcgcgaagccgaggatatagcaggcgatcagcaccatggtcggcacggccagcgtggccacatcgccggtgaagttaagcacggccagcaccgcgagggcgatggtcatcgtcaccgatccgaagatcagcagcttcttgcggggaatttgtccatgataagcgtggccgcgatagtggccacgaagttgaccacgccaatgccgaccgacacccagatggcatggttttcggggaatccgaagcctttgatgaacacctgcggcaggaaatagatcacggagttgatgccgacgagctgctggaacagcatgatgccgatcgcggcgacgagcgcaggacgggcgatgcggaacagctcgcggacaccgcccttggtgttctgcgcggcgacggccttgatctcgtcgagctcgagctgcacctgcgtctgatcgacgtccttgcgaataagggtaagtactttgaacgcctcacgatccctgcctcgactcaccagatatcgcggcgattccggcagcagcaggccgccgatcagcagcagggccgccggcacgagcgccgaccccagcatccaccgccaatcgcggatgccggcgatattgtggccgaggaagccgagattggacgcgtatgccagcaggatgccgaaagtgatcatcagctggaatagcgtggacagcgatccacgacgttccttcggcgcaagctcggcaagatatgccggagtcagcgaggaggccgcgccgacggcgagaccgaggatgatgcgggccacgaccatcatcaggaatcccgtggatcccgcgcacatgcccgaaccgagcaggaacagtatcgccgccagaatcagcagcttcttgcggccgaaacgatcggacagcgcgccgatggacagggctcccgcgcaggaaccgatcaacacggatgatgtgatgaacccggtctgagccacggacaggccgaaatcggattcgatgagaggcgaggctccggagatgatgccggtgtcgaagccgaacagcatgcctcccagcgcaccgaacgtgaagatgaacgcgctgttgagcgggaaacgtgtggaaacgccacgccccacctcccgctcgacggcgtcgatcgtcgcgccgacctcatggatgccggcttccaccgcaccttcggcgtcgtgtactggattggacgtctgcaccgcagtcatgatttcaccttccattcccatcgatcctcatcgatatgagatgcagcaatcgcagcaaacaaaaaagacctggaacgacgtatagtgacgtcgttccaggtcttgcctcgcattgagtagcaaccctgccgcgcttgtatgctgcgtatattgcattcaagtgtaggtcatggcggcatgcgacactccgattttttagaaaacgtttaccggttatttttcagtgcaggaaagcgtgaagcacaggccagcggcacatgcttttccctcgtgcggagagcctcctcggatatccacgagcaagcggaccgaatcaagccgtcaaccatccacaagcaagacggcaaaaagaaagccggcggagagaaagccgccggctgagagagaagagagaagaagggttcagttatgggattccaaaggaatctcgccaacagccgcaaccgttgacatggtctatataaccgcccgacccttggaggaacgatgtgcgttcctgtcaattccctgagaatttcgtagcggaaatgtcacgacggtgcgaattcgggggtttatcccactgaatatcgccccaacggccttcctgcagcttgttcagcgcggcaacagacgatcgcacggcatccgccatacggacaccgtcatgagacaccgctatacgacgccgtacactcacacgcaatcgtgcgtctcactcagcgaatttgtcgacgcggcgatcgtaggtcagcaggccgttgagctcttcctccacgtcggaaacctgcgtatacacgtatcccgcaagtccgcgcgattccagtgcggccgcggaggcgagcacggaacgcacggcggcccgccaatcgtcgatcgaatcgtattcaccgtaaccgtaggcgcgcgacaccgccgcatgctccggtacgagctgcgccaatccgccgaattccgaaatcacgaacgcgcgtacgccgtgtcgtgcgaccggcagcaccacgtaatgcgcggccctgcggcgacggcggtgcttcttctcgaattcggccacgtatccgcgcaacggacccttatccgggtagatttccagcggacgaaaatagttgtgcacgctgtggtaatcgccacaatgctggtcgtaccagccgctggtcgcgtcaatcggacgggtcgggtcgagcgcgtggatgcgttcggttgcgtcgcacgcgtcgaattggccccagccttcgttgaacagcgtccacgtcacgatggaggggtgcccgccgagcatgtgcaccatcgcgtcgcacgtacgcgaccaatcgcgccggtagatcgggtcgtccgcgccgagcgccgtgaaatgtttggcggtgtcgtcgcggaatttgttccatgtggagcggatgagcgtcggcttacgattcgtggtccacgcattgtattcgccgtccgtgccgccgccggacaccgcgtcctgccagacgagcatgccgaggcggtcgcaatggtagtaccagcgggccgactcgattttgatgtgcttgcgcagcatgttgaaaccggcgtttttcatggccgtgatgtcatgcgtcagcgcctcgtcgtcgggcgcggtcatgagaccgtccggccagtagccttggtcgagcacgcctttgacgaagagcggcttgccgttgagatggaagcgcgccacccccttcgtatccggtttgatttcgacggaacggaacgcgcagtaggaacttacgacatccatcggctgcgattgcacgaccgccgcatcacccgccgtttccgcgggtttcgccgacccgtatcgcaattcggcccgcacgtcatacagatacggatcggccggcgaccacagatgttcggcagctgttgcgatttccgcacgcaccttgcgcacacccgccggcagcgtctcatccgccaccaccgtgccgtccgcagggtcggtgacgacgatgtgcagtttcgcgttcggcttgtcgccgccgatttccgcgcggacgaacaacttgccgtcggatgcccccttgagtgtcagcgtgcgcaggtaggcttccggcacgatttccagccagacgctttgccaaatgccgctttgcgcggtgtaccagatgccttcgcgctcgattttctgcttgccgcgcaactgcgtgcccgaatcgttcggatcgtagacacacagcgcgatttcaaacgcgtcatcagggtcgataaatgccgaaatatcgacgtcgaacggcaggtagccgccgacgtgcgtgcccgcgagctggccgttgacatagcaggcacagacataatcgaccgcttcgaaatgcaggatgaggcgattcgcgtcgccgatttgccggaccgtttcctctccgccgagcgtgacgggatgcacgacggtgcggtaccacagcaggttgtcggggtaaatggtctggtgcacgccggacagcgcggattccggcgagaacggtacgaggatcttgccgtcgaacgtttgcggaatggcggtttccttgactgcgcggaccgcttcgtcgcgggtcagcatcgccgccgttttgcgccatttcggcgcggtctcatcttccggaatggacacgatcgcgtaatcccaccagccattgagcatggtgcagttgtcgcgtaccatggtcgggcgcgggtgctcgccgagtatgggggtacgaccctcgtccagcgtgcgttcgccttcctcggcgggattgaacgccttgttgccggcgcgggcggatagccattcgtgctcgattcgttcaccccacggcgtccacaactgctgcagcggctcacgggaacgcattttcgtaggcgcggccttcagtacgcgtttgatatccagcatggagagccccttcctgcagctttgcacgtctctgcgttttattgtactgagcggcttgcgttttttaacgattcgtaccgcggtttgaagtaccgtcttgcgacaccccgccaagaccagctgaaaaatcgcacgcatttctacccaaaacaatgcgaaagcaaccggaacatacctacgacaaggatgcggtcggtcgtatatgcgttgtaaggccataggcttggccgaacggccttgagtgtgccgtcaacgcatacctcgaccggccgccgggcccgccaatcgcacaaaacgtcgcacaggtggaaacgtgatacgggaatgagacgctgaaacggcacaaaatgtcgcacgacttcgatttttcggcacttttttcaagtcatgcgacacggcaatcaaaacaaataccccctaaccgccattttccggtcattttgacctaaaaacagcagttagggggcacttatcgcaccgcagctgtcgcacgacttgaagaaatcgtccaaaaatcaaagtcgtgcgacgcgtacgggggttatgcgacggaatcagccttccagcttcgccttttcggcggcgagacgggcggcctcggcttcgcggcgggccttcagctcggcatcgaagcgggcgagctcctcttcgacggcctccggcggaatcttcgcgaagatcgggtgcggcttcggcaccgaggtgccggccacgatcggctcggaagcccacggatgcacggtttcgcccagcttgtagtcgcccgtgatgatcgggtacgtgaagcccggcttgtcgagatcctcgacctcttcgaggcgcggcagcggcgagaagacgccggttccgccgagggcctcccacaccttctgtgcggagtgcggcaggaacggggccagcaggtggttggcgtcggacacggcctgggcggcggtgtgcagcacggtgccaaggcgggccggattgtccttgatcttccacggttcggtggcggagatgtacttgttgatgtcgccgaccacgcgcatcgcttcggacagcgcgttcttctggcggtgattctcgatgagtccgccgacggtttcgaacgcggccttggtttcggccagcagcgcacggtcctcgtcggtggcggaagcctcgtcgaacgccggaatctcaccgaagttcttgttgatgaggttggccacgcggttcaccaggttgccccaggaagcggcgagctcctcattgttgtggcgcacgaactcagcccaagtgaagtcggaatcggagctttccggtccggccacggagatgtagtagcgcacggcgtccacggggtaacgggcgaggatgtccttcacgtagatgacgatgccgcgggaggacgagaacttcttgccttccatggtcatgaactcggaggccacgacctgctccggcatgttcagcggaccgagcttgccggtttcgccgcccttggagccctggccgttgtaggccagcatttcggacggccagatctgggagtggaacgtgatgttgtccttgcccatgaagtagtagcccggggtggtcggatcgttccaccatgcgcgccatgcctccgggtcgcccttgcgtcgggcccattcgatggatgcggacaagtagccgatcacggcgtcgaaccacacgtacagcttcttgttcgggttgtcgatccagcccttgaccggcaccggaataccccagtcgatgtcacgcgtgatggcgcgcggcttgacttccttgaacaggccgatggagaagttgatgacgttggtgcgccagccttcacgggtcttgagccacgcgagattggcttcggcgagcgccggcaggtcgaggaagaagtgttcggtttcctcgaagcgcggggtttcgccgttgatcttggatacggggttgagcagctcgtccgggtcgagttcgttgccgcaggcgtcgcactggtcgccacgggctccgtcggcgccgcagatcgggcaggtgccttcgatgtagcggtccggcagggtgcgtccggtggacggggagatggcgactttctgggtgcccttgtagatgtagccgttttcgaggcactgtttgaacagttcctgcacgaccttttcgtgattgccggtggtggtgcgggtgaacagatcgtagctcaggccgagatcgcataggtccttggcgatcacgcggttgtagcggttggcgagctcctgcgcgctcacgccttccttgtcggcttccaccaggattggggtgccgtgctcgtcggtgccggacaccatcagcacgtcattgcccttcatgcgctcgtagcgcgcgtacacgtcggacggcacgccgaagccggcgacgtggccgatatgacgggggccgttggcatacggccatgcaacattcaccaaaatatgactcatggtgcccgattatacaaagcgccatatcccgtgttttcggcgcattccgattggcggaagacgggcggatggggtcgatgacgttctcgcagaccggcctgcatcaggctacggtagtccacaaggttatccacattgttgtatcacgcaacaatcatcgtccacttatccacttttttcgcgaagccggtggcacgccgctttccgtatcagctacggtaccccgcatggacacctcccctccccttttgggcgacgccgacctgcccggccccatttgtttgaatcgtttgcattccctaggcgtggtatgcaaacttgacaacgacaacgcctactcgtatcacgattcgcgcacgctgtacggccgcgccagcatcatctcaacgctgacgccgagccgttccgtggcgtgcgccggcaccgctgcgtgggtgtggttgggtggcatgtttcccaacacgatcgacatcatttcaaaagcgcattaccgaacggcgaggtacggtcgcaaagtcagcgttttcaaccgacaggcgcccgacaagcatgtcaccgacgtcggcccgatcaccgtcaccacgcccacacgcaccgcatgcgaccttgccatgaactgcacgccggaaacgcagtcgccggtcacggaaatcgtatgcatgctcatgcaggaattccggttccgccccgacgattgcctgcaggtcatgcaggaggccacccatattcgcaacgcgccacgggcacgccagtttttccggacgattgacggaaagcagtgacggatatgcgcgaatcgcaacggccgtcggaaaaaccacggcagacgggacagacgcggcaagcgtcggcaaagtcgcggcgcacggcaagcaagagatatgaagagcgcgcgaaacgtagcaaacgtcatgggcaacgacatgaacagcatggacaccatggcaaacgccacgaacgacgtcgcgcgccgccgaaatatcagccgcacgcgcggcagcgggcattagtcgaaccgcctgcgccgccaatcgaattgacgccgttggtggcgtgcagcgccgacaccgcgcaagatgtgctgtggcatatcgcggaatatgcgccgcgattgcgcaagtggctggtcgccaatccttcggcgacaccggcgatgttggaatatcttgcgcaggtcggcgggccgggtgtgcccgaagcgctgcggatattgctgaaatcgttggaaatgaacggttccggaagcgatcagcccttcatcgcaagcacggcattgtagacctgcttgcgattggcgagcgagccgtcagacagcggatgttcggcgacgacctgtgaaatcgcgtccttgatacgcaggttgtcttcctgcgcgcgatcaacggacagcaccgccagatcctcgatggacagcgttgcgggcgcagccgcgtcggcctcctcttcggaagcgccggcgatgacgagcaccatttcgccacgcggcggatcgtcgacgacgctttggcggatttcggcgatggtgccacggcggatctgctcgtaatccttggtcagctcgcgacacaacgccattttgcgattcggtccgagcacgtcaagcaggtcggccatggattcgtcgatgcggtgcagggtttcgtagaagacgatggtgcgacgttccgatttgagcgcgcgcaggtgctgcacacgttcgctgtgcttgcgcggcaggaagccttcgtagcagaagcggtcggtcggcaggccggacaggcacagcgcgtcgagcacggcggacgggccgggagcgcaggtgacgggcaggccgcgttcgatggcgcggcggacgatcgccagtcccggatcgttgatggtgggcatgcccgcgtcggatacgacgagcacggtggcgccttgttcgacctggtcgagcaggccgtcggccttgtcgcgttcgttgtggtcgtggtaggcgacgacgcggccgggcacgcggatgccgaggcggttcgcgagcgcgtataggcggcgcgtatcctcggctgccacgatgtcggcgccttccatgagggcgatcaggcgggcggacgcgtcgccggtgttgccgatcggcgtggcggcgagcacgaccgttccgcgcggaatgttgacgtcggcgaccagtccgtcgagcccgaattcggcacgttccgtggcttgcgcggtttcctcggcattttccgcgttctcgccgatttcggcaatctgaccaatatttgttttcacggtttgtttcacggcgttaccagccttctcggcatcagtctgttcgctcaagttctccatatttccagtatcgcccacagcgtccccaaaccatcagctcccgccatttctccgtctttcgcaaccaaccaatcgaaacccgaccaaaccacctacgacgccacacgtcctcaccggtaaatcaaaatgcacccctcacacatccgggtttccacccgccacgcattcggatttttcttcgtacgacattcggattttcctttgcgtaggattcggattttctcagacgggggtgagacggcgattcaacacgactttggacatgccatcgatagcatggaatcatgcgttattttgaagatgaaatttccggaatcgacggcagcacggccacgttcgtcggctactgccttgacaacagcagcgaaatcgacccgaatcgcaagcgcccgtccgtgctggtgattcccggcggcggctacgaaatgacgtccgaccgcgaagccgaaccaatcgccatgcaattccttgcagccggcttcaacgcgttcgtgctgcgctattccgtgaagccgtccatttttccggtcgcgctgctggaagcggccgaagcgatgcggcggatccacacgcatgccgacgaatggcattgcgatgccgacgctatcgcggtgatcggcttttccgccggcggccaccttgccgccaatcttgcgacttccgccagcgacgacgtgcttgcggcgcatggttacgacgcggatgcggtgcgcccgaacggtctgatgctcgcctacccggtggtcacgtccggcccgctcgcccaccgcggcagtttcgatgcgctgctcggcgaccgcaaggccgatccggaagcgctcgacgcggtttcgatcgagaaacatatcgatgcgaagacgccgccggtgttcgtctggcataccgttccggacgattgcgtgccgtacgagaacacgctgatgctcgtcgacgcctgcaagaaggcgggcgtgagcgtcgaggcgcacctgttccccaacggcggccacggtctgtcgctcggcaccgccgaaaccgcatggcagggggtcaacggcatcgaaccgtgcgtacaggtctggccgaaacttgcgattgcgtggatgcgtcgcacgtttgccgctaccgacgccaccgccgccatgaccggctctgccacgaccgtcgcgattgccgaataatcgccattcctgcgtttttttctgcgtcttttcacgtcttttttgtcgcacgacttcgcttttcggaccaaaaaacaagtcgtgcgacatttaatcgagtaaaaataccccctaactggcattttccgggcgaaaacggcacttaggaggtattcggcgtcgcacgacttgaaaataaccaccaaaaatcaaagacgtgcgacgtttcgcgccacctaatcgccaaaatcagatgggacgcgactcgtgcaccatctgacgatcgccgtaatacaacgagttcaggccaggattcgccggcgtgccccacgcggacgccggacgcgccggacgcaccggacagccggtgagcacgctggacaaccaccagacaaccaccagacaaccaccgggcacgcaccggccggacaccacctacaagcacacgcacataggcgcccataggcacatattgacgatttgtgcagatttgccacccgtcgtcgcactgcggcgcacactgcatagacccgttggtagtctgtgattggttcgcaacggcacattcgttgcgcacgatggaaaagcaagccacacgaaccgaccccgcgcaaccgcgcaaaaccacacagagagacctatgaatatcatcaatttcttcgtcaacctcatcaaggacccccgtaccgcgatcgccagctggattgccatgggcgtcgcgccgaccctcggctttattttccttatcgtcttcattgagaccggcgtggtgttcttcccgttcctgccgggcgattcgctgctgttcgcggccggcttcttcgccgcccccgacgcacagaccggcgtgtccgcactgccgctgttcgctctgctgccggtggtctggtgcgccccggtcatcggcgaccagtgcaactactggatcggccatttcttcggccgtcgcatccttgaatccggcaaagtcaaggccatgaccccggagcgcatcgagaaaaccgagaagatgattgagaagtggggcccgctggccgtgttccttggccgtttcttcccgttcatccgcacgttcatgccgttcatttccggtatttccggcatgcgttggagccgtttcacgccgttctcggtgctcggcggcctgtgctggtcgacgctgttcacgctgctcggctatttcttcggtggcattccggccgtgcagaagcattttgaattagtgattattgcgattcttgtgctgtcgctgattccaacgatcgtcggcctgctcaaggccaagttcggcaagaagaagccggctgccgaggacactgcggaaaccgccgacgccgaataagcagcgttcaatcgtcgtaaaaatatcggcgaatacaacgcaagcacaacacgcggagtgtggaattgcatttttccacactccgtactaatatttcgagagttgtcttgctaaacaaggtgacgcacatggggctgtagctcagttggtagagcgcttcgttcgcatcgaagaggtcgcggtttcgactaccgtcagctccacgaagcccgctgcattcattccaccgcagcgggctttttcttttgttttccgccgtttccggcatttcggcttttgattacagccgcgtcaggcgttgcggcggcgtatataggcgtcgagcgtggcggcggtgatgccgtcgtagccgttgattgaggcgaattgcgggccgttggaattgtcgatgcgcatgaagccggtctggccaagcgtggtggcaccggatgcggccgcggagcgcaggccggacatggaatcctccaccgcgatgcaatatttcatgtcttcgggcgcgatgccaagcttgcggcccgccgcaagatacggtgcgggcgacggcttcttctcgacatcgtcatcaccgcacacgtaaccggcgaacgtgccgtccggcgcctgcgcgatcaggttttccgccagatgacgcggcgatgtggtgacaagcatcgacggcacgcccgcctccttcagcgacagcagcacgtcctcgacgccatcgatccacggaatgcgttcgaattccttctgcgccacataatcgatcatgcccttgccgatttcttcgatcgacagcttgcagccgtgctccaccatgcggcaggccacgtccggaaccggcgttccggaaccctgccaagcgaggtcctcatcccagtatccgccgtggtcggctgcgattttcagctcgccttcgtgccaatacggttcggaatcgatcagcgtgccgtccatgtcccagaacacggctttgagcatcagcttcgaaacttcctgggcgccgttctggataccgttgttcagctcggtcattacgtttcctcgcaatcgttacgcttcgttctccgatagctacattcttcgtcagctacgaccatttcagcagagcggcacgacggaagcgcttcagcgcgcagaaaaaacaggacggttccatcaagccggtccgccaatcggttcataccaatcggctcgcaccaatcggttcacgcaaaccgactcatgcacaagccaattcgcgcaagccaacgcagcaaccaacccatagcaacggaggcacttgggaatcccccaagtgcctccgcaacgaaaaacacatccgacgaaatcggtcggtcgcaatcgcagcaatccgtcatagaccccttttagacgaatcgcaagacttgcgtgcgactactcctgagcctcctgctcctgagcggccttctcggcatcctccgccttccagcgggcgatgcaacgctcgacgcgcttgtaaccgatgatcttcggatccaagccggcctcgcggaaaatcgcggcaggcgaaccaccctcggcatacctgcgcatgcagtcgtcacggaattccttggaatagcgaattcgatactgagtgactgattccacagcatcgagagaccccaggtatttgcgggtctttgcggtgaacgcaactcttggcactgtacgctcctaacctttctgtatccaccgcatgccctcccccgattcttcacggaaataagcagtcatatttcatcgaagctgtgggccagccggaagaaatacgaacttcaatgcggatacgtaacattatttctcacaatagagacatcattgcgagacagatgcggcgttatgagtagttgcataccaaaaatcgggcatacccccgcgatatatgcccgattttgctgtttttttagatttttttagggttttccagcgcttttcaggaaagtcagcgaatgggctgtcagcgaattccccaaactaccactgacctggagcccatatcgtccccctcttccgcacgttccgcccgtacggattcgcgcgacggaagctgccgtgcatcggctcgcagctgcctgcgccacatgcgcgcgcgctgggaccgctcgacttccacaatgccaccgtccgcgtccgcggcgaacacgctggaaccggccggcttgcgcagccgctccacttggcggcgcagctcgcggttctcttcctcaagttcgaggatgcgcgtgattccagccaagttgatgccctcttcctggctgagttgctgcgcttgcgcaagacgggagatgtcgcgcagcgaatagcgccgcgcgccaccttccgtacgttgcggtacaaccaagccaaggcgatcatactggcgcagcgtctgcggatgcacgttggcgagctcgccggccgcaccgaccgagaagacgggcagctcgatgtcgaaaccgacttcggcggcaccgtccaggtcggcccggccggccacgatcgccatggcgcacatttcatacagccgcttgatctgccgtgcggcgcgcgcttgggaggcttgggaagtccgcgatgagcgtgccatggcggtcagcgctcccgagcgagctcgtcggcgaagtcaccgcacgccttgtcgaattccttcgcggcatgcttggcaacgaggttcggatgctccggaatgcggatctccacacggccgaccaaatcgccgttctcgtgcggattggccacgcccttgcctgcgatgcgcacttccgcgccgctggacgagccggcaggcactttgaaggcgatttcgtttccgtcgatatccgtggccgtcactttcgcgccgttcacggcttggctgacggtgatgggcagcggcatgatgatgtcacgtccgcgcagggtgaatttcgggtcttcggcgacggtgatatgcaggtacagatcgccgtttttgccgccattgcggcccggcttgcccttaccggtgagacggatcttctgcccgtcacgcacgccggcggggatgtgcgtcttgaacttcttgccgtccgcggacagcgaaaccgtggctcccttgacggcctggcggaaggtcagacgaatcttggagttgcggtcctcgccgttttccggctgcggctgctcgtaatcgtcagcgccgtagcgttcgtaggcggagcctgcgcccgggccgcccgcaccgccaccgaacatcgagaagatgtcgttgaggttcggattgccgccgccattggtctggaagcgaatgcgcgagccgttgccgcccatgcctgcgccgccaccgaacatcgagccgaagatgtcggagaacgcgcccgcgtcgaagccgccctggccggaaccgccggcgaaacgcgcgccgcccatgccgaactggcgaatcgcatcgtatttctgacgattctccttgttgctcagcacgtcgtacgcttcggagatgtccttgaacttctcctccgcttccttcgtcttgttcaggtcgggatggtatttgcgcgccagcttgcggtacgctttggtgatttcggcgtcggtggcgtctttggagacaccgaggaccttatagaaatccttgctcagccattcattctcagccatgatgtgcctcctttcgtgaggttttcatgcagtaaaaagtacagtttttcaaactttcaaacagttgtcgttgaaccgttgtttcaggtaatcgaaggcccctcgtttttcagaggggcccgattactcgtcacatgcgtttcgcgcggatacgcggattgtgcgaatgcgcgatcagttctgcggagaagccacgaccacacgggccgcgcgaatcacgcggtcgccgatgcggtagccggcttccaccacggtgtcgacggtttccttctcggcattcggatccggcttgtgcaggatcgcgtcatgcttcgtcgggtcgaaatcctcgcccttttcgccgaacttctcaacgccgaacttctcgaacgccttgtcgatcttgttggcgacggccttgaacgaatcgtccatttcgctgtgttcgcgaatgcggtcgatgtcgtcgagggccggcagcagggcggtcagcacgtcgatgatgccgtgctgacggaagcgttcctgctccttctgcgcgcggttgcggaagttgatgaactccgcgcgttcgcgctgcagcgcctccagatattcggcggcttccttcttggcctggccaaggggggtcagcgtatcgtcggccttgccgtcggcagcgcctgccttgtcagcaccgtcagcggcagcggaatcgccattttcttgcgattgcgcggcagccggctgagctgcaccttcctgcgttgcgccagcggcggcagcggcggaatcggcggaagcggcggccggggcggcctgcccggacaggtcatccatgtcgggcaggtcgttcaggtactcgtccttgttgaaatcggacatgattacttgttgtccttgtcgtcgtccacgacttcggcgtcaaccacgtcgtcgtcggagccgttggaagcggagccggcagcgcctgcgccagcagcgccggcagcgccggcggcgtcggcggcgccctgctgtgcgtagagggcctggccgatcttctgggcggaggtcatcagctcggtctgggcggacttgatcttctcaatgtcctcacccttcagggcttccttgagctcgttgaccttgtcggtgacttccttggccacatcgtcggagagcttgtccttgttgtcattgacgagcttctcggtctgataggcgaaggactcggcctggttgcgggtctcggcgtcttccttacgcttcttgtcctcggcctcgtgggcttcggcttccttgaccatgcggtcgatctcgtccttcggcaggccggaaccaccggtgatggtcatggactgttccttgccggtgcccttgtccttggcggacacgtgcacgatgccgttggcgtcgatgtcgaaggtgacttcgatctgcgggacgccacgcggagccggagcgatgccggtcagctcgaaggtgcccagcggcttgttgtcgcgagcgaactcacgctcgccctggtagacctggatgagcacggacggctggttgtcttcagcggtggagaagacttcggaacgcttcgtcgggatggcggtgttgcgctcgatcagcttggtcatgatgccacccttggtttcgatgccgagggacagcggggtcacgtcgataagcaggacatccttacggtcgcccttgatgacgccggactgcacggctgcgccgacggccacgacttcatccgggttcacggactggttggcttccttaccgccggtgagctccttgacgagttccttaacggccggcatacgggtggagccaccgacgaggaccacgtggtcgatgtcggagacgccgatgccagcgtcgcgcagcacgttgttgaacggggtgcggcagcggcccagcaggtcggaggtcatttcctcgaagtgggcacgggtcagggtctcgtccagatgcaccggagtgccgtcaggggtcatggccaggtactgcatggagatggaggtgctggtggagctggacagttccttcttggcctgctcagcagcttccttcagacgctgcagggcgatcttgtccttgctcaggtcaacgccgtacttgttcttgacttcgccgacgagccagtcgatgatcttctggtcccaatcgtcgccgcccaggtggttgtcgccgttggtggcctgcacctgaatggtggagaagccgtcgtcgtccttgccgatttccagcagggacacatcgaaggtgccgccgccgagatcgaagaccaggatgcgctcgtcttccttgcccttctcaaggccgtaagccagtgcggctgcggtcggctcgttgatgatacgcaggacgttcaggcccgcgatggtgccggcgtccttggtggcctgacgctgggcgtcgttgaagtatgccgggcaggtgatgacggcgtcggtgaccggttcgccgaggtaggcctcggcatcgcgcttcagcttcatcagaacctgcgcggaaatctcctgcggcgtccacttcttgccgtcgatctcaacggtccagtcggtgcccatgtggcgcttgacggagctgatggtgcggtcgacgttggtgacggcctggcgcttggcgacttcgccgaccagaatctcgccggacttgctgaaagccacgaccgacggcgtggtgcgagcgccttcggcgttcacgataacggtgggctggccaccttcaagagttgcgatgcaggaattggtagtacccagatcgatgccaactgcgcgtcccatatttggtctcctttgcaataggttcgctatacgttcttttcgttcttcgctcgagtttcggatcgccgtttccggattgccgtctctcatgctttccaaaacttgagcctacaccactcaactttgaatcgcaagttattattcccaaaatcgcaaaaattcttgagcacacctcactcaactttgcgcaaaacccaaaaccgccggcgctggagagtatctcagcggcggcggttttggggatcatcggaggttattcagccaatcagcggtcgttcttggcggccttcacggtcttgatgagcatcgcgacggcaaccagcatggcgatcgcaacagccgcagccagcaccgcggtgccggtcttgccgagcagtgcggcgccaaacgggccggccttcgtatcgttgttgaccttgccggaagcgatcacgccgttcttgtcagcgttgccagcgcccggcttgccgttgttcttgtcagcggagttggcggccggagcctggaagtcgacggtcacggccttgccggactggcggccggtgacggtgagcgtgtattcagagccttcggtcacgccgtccagcgcgatcggagtggtctgtgcggtcttgacgcgcacgccggagagcggagtggaggaatcggacgcggccacggtcttgccgttcttgtccttcagctcgtagctgagcacagcgtcgccgttgaagccgtcgacgtccgcggtgaacttgccgtcggcagcggagaccttcacagtgccgttgtcagacagtgccttctgcgattcggcggaagtggccagtcccagagcgccggcgatcgtgtagaagttgtcggtctggtcggtcaggccgatgacgcgctgtgcgccagggccggaagccgcgatacgcagctgggtgccggtgtgctccatgtcgccgccgttgtagccgccgtctgcatcgcgagaatcgtcctgggcggtgccgtaggagacgaccatgttgttgccatcagcggtcttcagcacggtggacagtgcgtaagccggctgggcgttgaggatctgggaggtgtgcgcgtggtcggcggtgacgatcaccagcgtgttcgtgaggtccacgttctgcatggcgtaggcaatggcctggtcgaagtcgtcggtctcgccgatctggccgcaggcattgcctgcgtggtcctgcttatcgatcgaggcgccctcgacctgcaggaagaagccgttcttctggccgttcgggttgtcattcagcaaatcgagcgccttcttggtcatgtccttgagcgaggagccctgattgccgagccagtcggcgttcggggtgcacacggtcgggttggcgtccttggctggatccttggcggtggccttggacgggttgaacttggtcggcatgttaccgtcgctcatcagggcgagcactggctggccgtccttgtactgcagggcgttcatcgcggccggatcgttctcgacggtctggaagcccatttccttggcctgttcccacacggtcttgcccttgtattcaccaccctgcacggtctgacggaagtacttggaaccaccgccgatggttacgtcggcgcgggtgtcgagcagctgctcggagatggagccgatgccgccgttttccttaagctggttgatgaggcactgcttggaggcattgttggacgtgccgtcggtcttgccctgtgggccgtagcaggcacgttcggacgaatgcgattccagcacggccggggtggcatcctggatttcggcggtggtcacattgccggtggctttgccggccgccttggccagctcgaagaggttcagctgcggattgccgtaaatatcaacgtcaacggcgttgttgtaggtcttggtgccggtggcccatgcggaaccggatgcggaggaatcggttacgggggtaagcttgcccggattggggttggcgaccagcttgccgtcgccatccttgccgacggcgctgtccttgctgccgttgccgacggagaaggtcgtgtactgaccggtgccggcctgcacgtcgccgagcgcgccgggctggccgaccgcgtcgagaccgtcgaagtggccgttggcgcccttcaggtagtcgcgggcgacggtgatttccgaatcgcccatgccgtcgccgatgaacagcaccacgttcttggcgtttttgttgccgatggctgcgatgcgttgcgcgccgccgtgctgcgccagttccgcaacggacttgccgttggggctgtacgtggtgtcggctgcgagcgccggcgcggcaagcgcaccgagcgttgcgacggaggcgagggccgcgattgcgcccgtgagagccttgtgcttactcatgtttcttctttcttccatgcagtttcgtctgtgccgtccggtttcgtcgattcgttgcgatcgaggcggtttcccgattcggtttcccgatttcggagtcccgttttcggctataccttccagctatgcggaacctttccgcaactgcatttgcttggatctttcgattccaccgcccacgctatgcgccgcaagccaacgcacaccgcactacagaagaacggcagatgaacactcatcgccatatgatgaccgcaacatatccaccgcatgaacagggggaatacggccaataaaatcgccatattccgtcaaacaacacccccaccgcaccccacaagccaaaatcccccactggctggataaatccaacctctcagaccccactcacacgccaaaaatcccagtgactggataaaaaccacctctgacgcaccactcacgcgactaaatcatccagccactggaaaaaatgcccgcgccactcagccccgcgcaacccgcgccgcgcgcgtggcctttacggccacgaacacggaccgcaccagcagcacgcacagatagcaggcgaacataatcgccccaactcgtggcgaaacctcccccgcaatccacgtgccgagcggcgcggtcacagccgccgtcacgccaataatcagcgcggttttcacatgcgctagcctgcgcttcaagttcgccgcgctggtcgtgatcgaattcggaaacattgccaacagcgaagtgccgcgcgcaaccaggtcggacgcgccaaacagcatcgacagcgacggcaccgcaagcgcaccacccccaatgcccagcagccccgccagcgtgccgatgaccacacccagcaacgccaagccaatgccggtcaccaccgtcatgacaatctggtggtcgcgcgacggcacaaaactcacctgattgatcaccacaaacacgagaaacgccacgaaaatccaccgcagcaccaattccggcagccgcgacagcagccaactgccgatctgcccgccgacaaacataccgcaaaacagcaacgccgcggcgagccagtcgacgtgcccgccggtcgcgtacgaaacgacgccggaaatggaggtcggcacgatcgccagcgtggacgtggcggccgcgttgcgttgcgacaggccgagccagacgagcgcgggcacgatcaccgtgccgccgccgatgccgaacgtgcccgacagcacccccaccaacatgccgaccacaatcagcacgatgatgctgagcgccgacccgtcaagcgccgtctcccccgctcgcgattccatcttttgcgattccgttcgtacggcatccgcccgatccgcagtttccccttcatcacacatggcagctccttccacgtcttccgcgcccgatactacccacctgccgcgcgcagcaatcagccgattccataattttgcgatttcgccgccgcagcgcccggttcacgcgctttctcgcttatagatggcggattcgcgggatcgacggatggtatctcgcttatagatggcggccccttgcgggaacaagacatctagggggcatgcatgctaccccctaacgacctattgcccaaaccgacccgccacctataagcgagataccaccggacgcccggccgaatccaccatctataagccagatacccagccaaaaccacgaccgcacgcctacacccacgcctacaccggcacacccgcgcgcctacacccacgcaagacccattgcacacacccccgtacgcacacgaccgcgcgcggaccggcaaaatcgcaagtcatgagcgaaaaggggcatcaaaagcgtccgaaacagcccgaatcacacccccatccgctcacagacaagcaaaaccagcccaactcacaagtcgtgagcaaaaggggaggccacccaacatcaaaacagcccgaaacatccagaatcgtacccccatccgctcacaaccgcgccaaaaccgtcaaaaccgcaagtcatgagcaaaaggggcatcaaaagcgtccgaaacaggccgaataatacccccatccgctcacaacccatgcttcagcacgattcaggccatatgcgcaccgcaacaacacccctgcgcaacatcagacatgcacacgcacgcaaacacaagtacacacactgaaacgcaacacgtaccacaagcacacaaacaccacgcaccacataccaagcacgaccagacgcacacccccgcacaccggagaagcgatgtcaccggcttgcggcggcgctaggctagacactacccccgaacaccagacgaatggcgcgcgccggccccggcgcacaacccgtgccgcacaatccaggagcgtcgccatagccgcgcgagccccacaaaagcgcagccagccacaaacacgagcagtccgatcaccgcagccgccacggctgtcatttcgcccggctcgtcgtattgcgtcttgtctggcactttggggttcggaatccggtgcccgcgcacgagcaacctgtgcgagttgatgccgtacggcgtgcaggtgatcagagtcgcgtaatcggcgcccggctcgatgttgagtttgctgatttcgcttggcagcaccactgagatctggtccactttgtacgtgtacgtttggtcgagcacgtggaatgcgaacgtgtcgcctttctccagctcgtcgagaccggttagcaatcgcgcgctcggcagcccggtatgcccggagatcaccgcgtgcgtggtcgctccgcctacgggcagcgatgtgccggccaaatgtccggcggcgatctgcaatacgccgtcactggtgccgtgatagacgggcagtttcactttgatgcgcgggatggtcacgtatcccatgatgccggtgccggtcacgtcgagcgtttcatcatattcgcgcttctgcgcgtcggtcatgtgccaccgatcgccgttcgcggcgagccgttcgttgtattcgtgcgccgctttcagcatggctttgcgttcggcgccggacatgtctttggtttgttccacgtagcctgccacggcgtatgactggtgcatgcggttccaccagtcgctgaatgtcggatacgcgatgaggcccagcgccccgatcatggctattgcggaaatggcaatcatcacattgagcagcgcattcgatttcttatgcttggcagccggtttaacctgcgcacccggtttaacctgcgcatccaattcgacttgcgcagctggcttggcgtccgattcatccgtcacgttacttatgctacgcccgcttccgcaaagccgtcttggcaacgatcagcagcaccaaacccgcgcccaagatggccacggcaatccaagcggcctgctgcacgtcggcgccggtgtgcggctggtccggcgtggtgggtggcgtgtgcgtgttggtgatttcagtggagtcgccttccacatcggagatggtggtgtagccgtcgggcaccgccgcttcgaccacggtccattcgtggtccgcgtcgagcgctgtccacgaatgcgtccacttgttggactcgttcagcttcacgttttccacgggctcgccgtcgcgcaggagtttcacggtgatggattcggggcgcttgccgtcagaattgttccggtcattccagattttgcgcacggtgcgtttcacggttttcggcggttgcgccacacattcggttttcggttcgatactcagcacacgcgacccgccggagacgccgtcttcgggcactgcgacgagcatgctgccggaagagcacgtccatgtctggttctttccggaggcgttggcgaccttcacgtcaacgctgtcggacacggccaagtacaggccgtcggacagtccggtgaaggtcagatgcccggaggtgttggcgacgccggttgccgtggcgtcaggttggttcaccgcgatgagtccggcgagcgtgttggccatgtctcgccacacctgcgcgtccttgccggtcatcttcgaccagtcgacggggtaggcggtggagtcggtgaacggtgcgacgggttcgaaggtggcgccgccgcttgccgggatctgcccgactttgtagaggttgaagctggcgtccgaaatggcgaagttggtagaatcgtcgccagtttcggagtccgagcttttatgttggtacgaaatggcgatgctgccgctggcagagtctgttgttggcgccgcgacggcatcgcgagtaatgaatgcacaggctgccgcggcgaatgtggcggcgattgcgcagcatgcggcgatgacgcggcttgcgatcgtgcgttccttcattgccgacccctcttctgtggattggaaagtaagcatgtttgattcgcccccaacggcaaaccggaaaatatatggagccaggctggatactcaagaaaattaggcagtgtacaagggattgaggtctttatgtctgaccggcctcccctcgtctcgccaaggtgatcattgctgccgctcctttgccctgagggccaggagaccaaccatgatcgcggcggtcagtgagcgggcgcgcgaaagcacgcgaccggatgccgatcgcattcccgaatagtgctgtggcgcattctgcatggtaccgttacgcagctgcttcatcctgtccccctgccgcacgactacagccccctctaagttcctttccaagaggtgacatcctttgcaggaacgtcaactcccatgctcttcattgcgcatatagcggcctgctatacacttctcctcgcttcataccctcgtttgagtacccctcaatgataacctttgcagttatgaaatgaaacactgctaccctacccccgcgacgcgttataccctcctcaaaatactgcaataaaggcaaacatcggctgatataccgccgttcccggcattgcacagaccacactatctctgcaaatttattttcactatcacgcaggaaatcgtacccccttctacgtgttgcaacaaataattctgcaaacattttcatattttgcatgcatcattcgttccgttgtacaacgaaaacaaagcaaaccgcccctaaaaacagcccccgttataacgccatcatgaccacggcaccattaccagcgaaactgagcgaatcgcatccgcaacgacaatcgaagcctcccgaccgacatgcagatgcggagcaaaaaaatgtgtcacgatcctgattttcgccgcaaatttcgaatcatgacacatccagatgccgaaaaagccaatttttcaaccgactcatacccccgacacgcaatttcggcggattcgaaccagtacgggggtgcacgatgtgtcacgatcccgaaaaacagcccaaaatcagaatcgtgctacatatacgggggtgcggaaacacaaactcggcccccgcaataaaaacatcaacaatccacagaagtaaaaaaacacacgaagacacaaccggcaaccaatgcaactattacggacgcaccgacttcctcacaaacgtcagcagcccatcataatcgagatccccattcgcaactgaaagaatggaatgaagcagctcaccatgatcaaaagtcgcagcaatgccgccttcgcgtaaaagaaccagcatcaacgccaatcccgtacgcttattcccatcaacaaaaggatgctgcgtaatcacctcatatcccaacctcaccgccttctcgcacaacgtaggatacaagtcctcgcccgcgaaactcatccaaggagaagccacgcatccctcaagacaagacaagctccgcacgccaccagatccaccatgacgacgtatctgcaaatcgtgaatagcaagcaccgtaggaacgtcaatcggctgcgtaacactacgattcacgcgcaagaacctcgaagacatcgcgatactcatcatctatcgcccgggcagcatcaaggtaccgaccctgcaccgcatcctgccgcgacccttgagccggtgccgcaaccggatccagcggaacgatcttgaaagcaggcttgttgttcttaaagacggtaacggaaacacggtcatgcatgactttgtccgtgatggctttcaaatcgcgacgcacatccgtatagctagccgttagtggcatcacagcccccatcctttgtatggcaccatattcagtacattatattgtacagaattcttttatcggacagcgcctgtccaacttccggatcatcgatacgtgaagactgccaccggcggcgcggatgcggaacaaaatgtgtcacgatcccgaaaaacagcacaaaatcagaatcgtgctacatatacggggtatcgaagcattatgacgaggtgcaaaggcattacggggatgcagggacgcaaacccaaccaccaaaccgcacaatcaaacagcagcgttacccacaaggttgaaagcacacgggggcgcacaccacttcgaccccgcaaggattccgagccctacacaacgcagccaaaataccagccaaaacaccgcggttccgaataagaccacaatgcgaccataccccgctcatcttcgaccccagcagcctcggcgaaatcgcgcccaggcccagaaccggaacctactgctccccgccgaacacggaatcagtgccacgcagcaccagctgcgcacgcaccacttcgtacgggttctccagcggctcccccgcgatgagcttcatggccttctgcgcggccgcgcgacccatcgcatacggatcctggcgcatggtggtcaggttcacagtgtcggcgtacggcgaatcgtcgaagccgataatcgagtaatcagaaggcgtgtggtggccgtaccgttccaaacgcagcaccagcggaatcgccatcatatccatctggcagcagatggcgtccgggaattcgtcgaacgccagcagcgcggtcaatgccgaatcggcgaacgtcttgccacgcggcacggaaacgacgcgccacttgaagtcgtgcgtgctttccatggtcttgcaggcgcggatgaagccctgtccacgcgagtcgatggaggaattgatggagtcgatggcgtcggagcacacgtacacgatgtttttgtggccaaggttgatgaggtgctgcgcggcggtgaacatgccgtcctcatcgtcgatggagatggtggcgtcgaatccgctttgcgtcggcgtattgatgccgatgatcggcacgtggatgcgtttgagctgctggatttccttcggatccacgccgaacgacgttacgaatacggcgtccacgttgcggcggacgggcagattcgtgaagaattccttgcgattttcggcggtgtcgacatgctggaacagcgagatgtcgtacccggcgtcgtgcatgacggagtcgatgccggcgaacacttccgtattgaaccagctggtgatttcctcgttcatcagcatcgccacacggtacgattggccggatttcagcgacgtggcggaacgggagatgttgaaatcaagcttgtccgccgtttccagcaccttgcgacgtgtacgttcggacaccagttccggacgcttgaacgcgcgcgataccgtggaaatcgacacacccgcggccttggccacctcgcgaatgcctgctctatccatctctcaacccctttgcggttctagcatcataatcacaaacgtttccaaccttggaaacactcgcttgagcggtgatgctctctcaatccgtttctatcatattgcgaacgttgtcaaaaatcacgccagtgttgcacaaatcgcacaaattatcaaaataaccgggtaaaccgcgtaaaaagcccatttcgtccactgatgcttatagcccagcttgccgttgtagtagtgcacgaacgccacgcccacgcccggcgcgatcatcatcacggcgccgaacaggccggctgtgaacatcatcgaattctcatactggcgcatcagagcgaaaatcagcacgaagccaagcgtcaccgaaccgatgctcatcatgtgctggcgtaggccgatacgcagcagcaggtcccacagcagaccaatcaccaccagtccgaccgacaacagcaccttcatggccttctgatagcgcgacgccacccagtcgagcgcggcaagcacaacaaacgcaacgaacaggccgaaaacgggattctgcgagcccaggtcgaaagccttatgcgatgtggcgaggtcgtacggcacctcgcacaccacggcgagaatgaacagctgcaggccgtacgcgacccggctgtgcgtttcacggaaaccctgcaccagcagccacgcgtagatcggaatggcgaaccaggacaccacttcgctcaggaccatcgccgtcagcgacgtcatattgttggtatcggagccgaagaacagcggcacgatggtggtgctgccggcggacaaggccaacgccaccgcgccgatgaccttaagttggaacaccgtcagtccgcgacgctttttcctgttgcggcgagcgccgccgaatccgatttggtcggtcgaatcggttcgagctccctgctcggcatagccttccatatgtcctcctattgcgatttttccgcgcgtcgcacgtggcacgtgcaccttacgcacgccttacgcacgtatgccttttacgacttgcgacttttccttgcgactttcccgcacgccacagcggcttcccgcacgtcccatgcgatttaagctcagcgcccaccgcgcgccttatgcgtccagcacgaatttcagcagcccgtcgtagtcggctccggtaaacgaacataccgcatgctctgacgccgccggatcattggcgggcgaaatctccgtgcggaaatacgcggcatcaagtcccgcggcattggcgccgatgatgtcgttgcgttcgtcgttgcccaccatgagcgcatgcttggcggtcacgaattcacggtcgagcgccagcatgtacagctcgcgggacggcttgcgcatcttctcctcactggagatgatcacgtcgtccagcacgctcgccaaaccggtcatctccagttcgggcctcgtgtagcatgcctgcgcgttgctcagcagcaccaccacgacgccggcgtcctgcagacgttcgatcatgtccagcgcgcccggatacagacggatcatgctggtgctggcctggcggaacgcccatgcggccttttccgcggcctgcggcagcgccaatcggcgttccgcctcatcgtcgcggttcatgagcagcgagcggtacacgggcaggatgtcaaattccccccacccgtcgcgcacgatcgcacgattggcctggtgcaccatctcacgcgcctcaagttggtcgaaccgttcgcgcatctcgtcaagcgacccatactgcgcgcccagttcatgcacgcagtcatataaagcctgccaggcggcttcgctttgctcatcggtacgaatatcgatcagcgttccgtacaggtcgaagaacaccacctcatatcgtggatcttgcgctccggtttccactttcgtgtcctttctggtcttccggcctcgttgccgtagcgggggcacggcgaccgccactttgcgatcgccgcatgggttctctcttcgagagtattactgcaacctccagattgcaaacgtatgcgccggcatgatcagataatcgtcgtcacctccccctgtgctgacgccaccccctctgccggacactccaaggcagcaccagtaacgatgcatctcaccggaatcgccttccacagccgcggcggccacgtccaccacgccggtgcgatcggacggattgacggccaccaagtaatcaccgacgcggaacaccagctcatcgccttccgtgtcgacgatcttgcgattgccgtcgaaccatcgcgcatcgcttttgcgcagggcgatcagcttcgcatagaaaccgatcagatcgcgcatatgccaagcgcggttccaatccagccagttgagctccttggtcgaatcgtacgaatcggaattgccgtatttggtgcgcgcgaactcctcgccggacagcatgaacggaatgcctgccgatgtgagcacgatgccggcggacagacgattggcccccagcacatcgtgcaacgcctgtgccatctccggtccgacggcgtccagtccctgttcggagaaatcggcgtcatgcagcgtcttcggcacatccaccgtgttttcctcgtcgccttcggccacggcgctgcccagcgagctcgccgcaagactggcgcatagcttgtcccacaaggtcaggtcatcatgcgcggaaacgtattggatcacctgcccagcaacgccttccggccggtcgctatggcgccaggcgtccaccgcctcgcgcacggccacggcgttggcgtgcatgccgccgttcacgtagccggggcgatccgaatagaacacgtggcctttgatggtgtcgcgcgtggtgtcgcagaagtggccgatgcgatcgtccaactgcgcaagcccctgcttgccggcgagcagcgtgtccgcgggaagtggcgccgacgcgcctgcggaccacggttcgccatacatgaggatgtcacggccgcggccgggaatctcgttcaacgcggcgcgcacggcgttcatggtgtccacgtcgatcaggcccatcagatcgaagcggaagccgtccatgtggtattcgcgcgcccagaacgtcacggattccacgatgaaccggcggaacatcttgcgttcggtggccatatcgcagccgcagccggatccgttggccagcgcgccgttgggcttgcggcgcaggaagtatttcggcaccgtacgttcgaaccaattgtcggtggagaacatgtggttgtaaaccacatccatgatcaccttgatgcccgcactgtgcagcgcctgcaccatctgcttgacttcgcggattcgtgtggtgccgtcgaacggattggtggagtacgagccttccggcacattgtaattgatcggatcgtagccccagttatagcggtcgcaggtcgtttcgtccactgaaccgaagtcgtaaatcggcatcagctgcactgcagtgacaccaagcttcttcaggtacgcaaggccggtcggaaagtcgggatggccttccaacgacgtaccgtcatcggtgaacgcaagatacttgccgcggtgcgattcggggaaaccgccggcgggatcattgctgaaatcgcccacatgggtttcccagaccaccgtctgcgcaagcggcacgtccggcatatggtcgcggtaccaaccatccggattggtgcggctgaagtccacgaccatgctgcgccggccgttcacaccggccccgcgcgcccacggatcggcgacgcggtccacggaaccgcaatcgcgttcaatcaaaaagtcgtaatacacgccgtgcttgttgtcggcgaaaacgaaattagcggcacttcgctgcgtctaggtctgcaaagctttgcaattctcgaagccgagtagcagacgagcaatgccccgttgaaataatcgtttgcaatgcggagcgctgcgccttcgtattgcaaacgatagtcaatatgaaaaaacaattccggttatctatattcctgaaattagagcaaaatcgcaatatagcaacactctcttaccgcaaaacacgctttgaaaacgatatcataccgtgatatagttatctttggtgcgaatgccaccagcatcgaagctgcggcaatcgcaagcaatgtagcatgtcagccgtcacaaacggcgcggaaagaagggacccatgacacagacccagcagaccgaaagcgcagaacgcatcgcacggcctcttatccagctcgccaagctcaatggcatttccacgtcgtatatcgaccagctcggcacctatgtggaaatccgcgacgaagtgctcgtctccgtattggccgcactcggtgtggacgcatccagcgacgaagcgatcaccgcctcctatgcggcgacccagcagcgcatcgcagacacacttgttgagccgaccgtcgtgaagttcatcggcaaggaagccgtcacgccaatccgcgcgaaaggaaacgacgtggcgctgaagctgacgttggaagacggcacggaatatgcgggcgatctgaccgcgtatctgacgggctcgaacgcagatgacggctcgctgcaactgacgctgccggacgatattcccgccggctaccacacgctggccgtcgatgccggcccgctgcacgccgaagccgcgctgatctgcgcaccggcacgcatcgaactgccgccagcagtagcggaaaagcaacgttggggctggatggcacagatgtattccatccgttccgctgaatcctggggcgtgggcgactatggcgatctgaagctgctgctgtccgacgcggcaacgaaatcgcatgccgatttcatgcttatcaacccgattcacgccaccgcgccggtgccgccgctggagccgtcgccatatcttcccgaatcgcgtcgttttctcaatgtgacgtacatccgtccgcaggatatcgctgaatatgcggaactcaacgaggcggaccaggccgaagtggcgcgtctgcacgcggaagtctcgccagccaacgacagtatcgagccgctcgacatcaattccgcttggtggcacaagcgccaggcgctgcagcttgtgtacaacgtgccgcgttccgtcgagcgtcaggccgcgttcgacgcgttcaaggaggccgcgggtccggatctgcgcgcgttcgccgcatggtcggtggcgttccaggtgtggggcgcgccgtgggaaggcacgtggttcaaggacacgaaccgcgattcgcctgaagtggtggagctcatgcgcgagcacgccgatatggtcgatttcgaatgctggctgcagtggatcgccgacgagcaggtgacagccgcgcagaacgccgcccgtgacagcggtatggcactcggcctcatgcaggatatggccgtgggcgtgcactcgctcggcgcggacgtgtggtggaatccggaacgtttcgcagtaggcagcgtaaccgtgggctgcccaccggacttctacaaccagcagggtcaggattggggccagccgccgttcaatccgaattatctggccaaaactggttatggcgtgtaccgcgagatggtgcacaacatgttctcgcacgcgggcgcggtgcgcatcgaccatgtactcggcctattccgtctgtggtggattccgcagggcgaaggcgcgcgcggtggcgcgtacgttacgtacgactatgaggcgatgatcgcgatcctgaccattgaagcgtcccgcgtgaacggtttggtggtcggcgaggatctgggcaccgtgcctgattacgtacgcacggtactcggcgagcacggcctgctgggctgcatggtggaatggttcgcccgcgtggacgactcccccaacgccggcgacccgtacgccgatccgtccacgtaccgcaagtacgcgctggcttccgtcaccacgcacgacctgccgccgaccgccggctacctgcagttcgagcacgtcaagctgcgcgaacagctgcacctgctgtccggcccggtcgaggagttccaggcttccgccaccgccgaacgcgacgcgatgatggaccgtcttgtggagtccggcctgatcacgccggaagtggcgggcgatgtggaaggccacatccaggaaatcgtcgaggcgatgcacaagatgctgctcaagtcgccgtccgtgctgctgcaggccgcgttggtggatggcgtgggcgagacgcgcacgcagaaccagccgggcacgtccagtgaatactccaactggcgtgtgccgctggcaggcccggacctcaaggtggtgcacaccgatgaggtgttcgatctgccgcgcgtgcaatcgcttgccgccatcatgaacggcgagaagtagcgtttagacttaccattcccctttccttacaaaccaaaattccggtcctccttgtggagggccggaatttttcatatatgcaaggcgatttgggagcggttaggccgcctgagaacaatcgcaacctcagccagcagtgcaacggccaggttcagcggtcgatcagcccagcagcagccagacggaggcgtcgctatccagcttgccgtcgtccgtcaacggcacggaatttgcgatggcgaccgcatcgtccggcagggcgatcggctcgtcgccgaaattggtgacggacaggaatcgacggccttccgtggccggacgcgagtaggcgaccaccgtatcgcccatgtccagcaggtcggcggacgtgtctccggtcgccgtcagcaccgtctgccgcagctgcaacagcttgcggtacaagtgcagcatggaaccgttgtcatcggcctcgacgtcggccgcgaaatccttgaaccaggccggctgcggcaggtgcgcgtcggcggaatcgccctgctccgggccgaaaccgaacgtgccgccggtgatgaagtccgggctccacgaagccggttcgccgcaatcggcagccttccacggcatcggtgcacggcagccgtcacgacccttgtcggtgaagttgcgacgggtgttgaacggcgtcggatcctcaagacgatcccacggaatgttcgccacttcgaacaggcccagttcctcgccctgatacacgtaggcggaacccggcaggcccagttccatcagcgcggctgcgcgggcgcgacgggtgccgagctcacgattctcgcggtaggtctctccgtcacgcaacagccaatcgtgcgccagctggtggtacggagcgtccttcacctgcggcagaccgaaacgcgacggactgcgcggcacatcgtggttgttcataacccacgtcgtggtggaaccgtgagtttcctcggcggcgcgcaagccgtcagcaatggccgtacggaactcgtcggcgaaccagttggcttcggcgaactcgaaattgaacacctggccgagctcgtcggtggacgcgtacagatgctgcgattcggccttcacccacgcctcgccgacggcgaaacgcggcggattgtactcgttgaacacctgacgccattcgcggtagatgtcgtgcacttccggacggtcccacagcgggctgaacgcgccgtccgccggcagcacatgctgcaccgcggccggatccatgtcggccagcggcacggaatcgaggtccttggccaagccgtgcgccacgtcgatgcggaagccgtcggttccgtggtcggaccagaatcgcaatgtcttcttgaattcctcgtgcacgtccggattcttccaattcaaatccggctgctccttggcgaacatgtgcaggtaccactggccgtcgtcgacctgctgccacgccgggccgccgaacagcgactgccagtcgttcggcggcagctcgccgtgctcgccgcggccttcgcggaagatgtagcggtcgcgtgcggccgaaccgcggccggcggcgagcgcctcgatgaacatcttgtgcttgttggacgtgtggttcggcacgatgtcgacgatcaccttgatgccggcttcatgcgcggcggcggccatcgcgtcgaaatcggccatggtgccgaggcgcgggtccacgttgcggtagtcgatcacgtcgtagccgccatcggccaggtcggacgggtagaacgggctcagccagatcgcgtcgatgccgagattcttcaggtaatccattttctcggtgacaccggcgatgtctcccaacccgtcgccgttcacgtctttgaagctgcgcgggtagatctggtagacgacggcttgcttccaccaatcgtcacgcatgttgtttgctgtcacgataaccccttttgtcgtagtccatcggatgcggagcactgtctccgctacatgaaaacgataacatcaagcaaagcgaaacgctaatgaaaacttaatcattgcagcacatcaaacgtttgacgaaaatgtgcatactccagctgtatcgagtagaatcgcggaagattcgacttgcatacgttgccaacggatgccatacgaaaggcgattatgaagttcctctcccccgattccggctttatgcgcggcctgagcgacgccgtcgacgcgatctggatcaacattctgatgctcgtcaccagcattccgatcatcacgatcggcgcggcactgaccgccggccacgacgccgtccgtcgcacgctgtccggcgaaggcacggcgacgcgcaattatttcaaggcgttccgttcgaattttgcgaaatcgaccggctattggctgattttcggcacgaccggcacgctgtgcgtctactcgtggatcgtgctgcagatcacgccgctgctcattccgaaattcgcgttgacgattgtgtggctcatcggtttcgaatgggtgtgggcgttgcaggcgcggttcgagaactcgttctggcgcacgcttggcaacgcttttgtgttcggcgtgagcaacatcggccacacgttggcattggttgcgatcgacgcagtgtacgtggcgctgctcgtggccagctgggtttacatgccgcagggcctgttcctgctgctcatactggggtatggcacgatgctgatgctgcattcgccgattctcgagcatgtcttccgcaagtacatcagcaagtaattaggcacgaaaaaagggactgattcgcatcagtcccttaaatttttctgggtgaaaatcagcccttcaccgcgccgccttcggccctgcaattaaggaccgcgctacgcgcgggctcaacgttaccctcgcggcatagccgctcgggctggagcctgggaacagcgcactgcgctgttccctaagggctgatcgaagatcagcccttaacggctccagccataacacccttcacgatgtacttctggcagatcaggtagaagatgatgatcgggatgatggccatgaccaggcatgccatcatggcgcccatatccacggaaccataaccgcccttcagatactgcaccgccacggaaatggtcttgtacttgctcaaatcgagcgtcaggtacggcagcaggtagtcgttccagatccacatggcctgcagaatggccacggacacaatggacggcttcatgatcggcaccacgatctggaagaagatacgcggcacggaagcaccatcgatcatggcggattcttccagcgattccggaatgcccttaaccacaccggtgaagatgaacacggccagaccagcgccgaagcccagatacacgaagcacagaccccacggggtgttgagcttgagcatatcggccagcttggagagggtgaacatgaccatctggaacggcacgatcatgttgaacaggaacaacgtgtacagcagctttgcagcccagttgttcacgcggacgatccaccatgcgcacatcgaagtgcacaccagaatcagcgccacggaaccgacagtgatgagcagggtccagccgaaactggcaaagaagttcgtggtctcgaggccacgcgtatagttttcaagtccaacgaacgccttaccggtcggcagggagaacgcgttacgagaaatatacgccttctgcttgaaagagttgatgatcaccagcacgatcgggaagatccacgccagcgaaaccaccgcgaacagtacggaccacagtgcgccgtgcttgactttttctccggagttcatgcctccacctccttgctcgtggtgagcttgttctggatgagcgccacgatggccaccagaatgaagaacagcactgccttcgcttggccgacgccttcccagcccatacggccatagaacgtgcgggtaatgttcattgccagaccttcagacatgttcgacggagcgccgttggtcaatgcaaggttctgatcgtacagcttgaagccgttggtgacacacaggaacgagcatacggtgatcgacggcatcatcagcggaatgatgatcttgaacatggtctgggtgccgtttgcgccgtccacggaagccgcttcgagcacgtcggtcggcagcgactgcatgcctgcgatgtagataatcatcatatagccgatctgctgccagcacaccaagatgaccaagccccagaagccgtaggttgcgctatacgtcaacgcgcggccccagtgagcgagaatgccgttgagcagcagcatccagatgtagcccaggataatgccaccgatgaggttcggcatgaagaacaccgaacggaagatgttggagcccttgatggccttggtcagcatgtatgcgatggcgaacgcgactacgttgatcacgatcgtcgtgatgatggtcagtgccgtcgagaagcccagcgcgtgcaggaactccttatcggcaaaagccctcttgtagtttttcagaccgacgaattcggcgtcggtgacggtggtgaacttgcagaagctcagatacacacccatgatgaacgggatcacaaacccgatgatgaacgcggcgaacgttggcagcgcgaagagcgcccaccactttcgtatcgccttgccagccatgctgatcatagcctgcctgctttctttccttctccattccgcgtaccgcgtcaacgcgggcgggaattccattccccagaggaaccatccacagcattgtttcctgtttctccagtgcttacatcagtcatgataaacggcatgactgcaaatgtcaaacgttgtcattttcgtatgtcacgcacggcaaaatatgaaacgttgtcaccaaaaaccatctctagagaacgcttatattccacgcaatgcccaactaccaccactttatgaaaacgtttgtaatgaataagttgcaaattggacaagaacacggtcttaatggtgaggggaggtagcattacattattcaagcaatcactgtacaggggactcgatgaaaagcagtagcattcaggatgttgcgcaactcgcgcacgtgtccatttccaccgtctctcgttccttcacgcgccctgacctggtgtcgaaagccaccagagacaaggtgatgaaggccgcggacgagctgaatttctccatctcgcgttctgccgcggccttgaaaaccggccgtgcgctgcgtatcgcggtactcgtctcaggccggctcaacctatggttcagctcctccatcatcgaaggtctgaacgaggtcttccacgatgagggctacgacatctccatctaccagatgtccagcaccgaggaacgcagcgagttcttcgacatgctgccggtgcgccgcaacgtcgacgccgtgatcgtcatttccttcgacatcgccagcaacgaaatcaggcaactcaggtcagtcgatgtgccaatcatcggcatcaattcgagcttgccggaagagcgcggcttcaacgccgccgtccgcatcgacgacaagcagggttcggaactcgccgcacgccatctgatgatgcttggccaccgcgacatcgtctacatccgttccgaccgcgaagtgacgctgcacttcagcgtgcagggccgttacgaatcgttcatggcatgctgccaggccaacggcgtcgaaccgcgcgtgcttgtcaccgacgctggcaggaacaggatcagcaaggtcgtgacgcagctgctcagcctcgaccacatgccgacggccatcgcctgccaggaggatggcatcgcggtgccgctgctgttccagctggaacgcaacggtttcaccgtgccgaacgacatctccatcatcggttacgacgacagcgtctacgcgcgcgacctcggcctgaccaccatccgtcagacccctgtcgagatggcccgcgaagcggcccgcatgacactcgcgctaatcgagaagcagccgctcgacgaaccgttcaagacgttccccgcgcagctgatcgtccgttcgaccaccgctcgtctgcatagctgattttccggcaacatacagcgaacgtagcgacatacacgaagggccgtcatcgcaagtaattacgatgacggcccttcgtgtatgtcgtcacaaccaactgcggccgagagaaggaaaggaaaaactctcggccgcagttgttctattcagttattggtttgatcaagcggtgatcagtgaacagcgtcgtactcggtcttccaaccgtccacgaacgccttcttgactgcgttccagtcgccggtgccctgagcgtattcgaggagggcggaaccaagcttgttcttccactcttcggacggcatcatggtgaagttccaagagactgcagtcttgccggagttctgatcatcaacagcagcctggaccagcggattgtcggacttgacgtcgctgaaggacttgaacggggtggtgaagcccatgtcgctggacagagacttgatgccagtcttgctggtgacgacccacttcaggaagtccttggtggccttcttatccgcgtcggaagccttggagttaatgcaccagtagttctcggaaccggtggccagaccctggttcttctcgcccttgacgccggtgtagatcgggatcatgccgacggactcggccttcatgccagccttctgcagatcggtccatgcccaagtgccgttctgatagaacgcagcctcgccgagggagaactcggaggtagaatcatcaccggtcttggagctcagctgggtcggctcggtggtggagtccttcagatacaaatcgaagatgttcttatattccggcagataggtgcccttgatggtctccggctgcttggtgacgttgtcatccttgaactcatagtaaagcggcaggttagccaaatgggtcttgaaacgccagtcggagctggaatcgaaaccggcggaggtgaacgcgcccttgacaccaagctggtccttcttagcctggatgtcatcggccacggccttcaaggtatcgaagttgtcgatgtcatcgacgctcttgatcttggcgccgtcagtggcaatgtacttggccagcagatccttgttgtagatcaggccataagtctccatggcatacggaacaccgacgaccttatccccatccttgagggcgacatccttgttgataagctgcttgtacggctcagtatcggacatgtcttcggtgtaggacgaccagttctggtagccgacagggccgttgacctggaacaaggtcggagcctcggacttggcgatctcggacttcaaagtctgttcgtatgtaccggaagcagcggtctggaccttgacctcgacaccggtttccttggtgtaatccttggccagcttcttccattcgtcgctggattccggcttgaagttaaggaagtacaccttgcccttgccgttatcggaacttgagctagaaccaccgcaagcagccaacgtgccaacagacattgccgcgatagcgaccattccaactgctgccttaatagtacgattcatcatcgaacctttctcttccattcctgttcccagcttctcgttgggaaacaatttgcggtatcgcgtcatcacgattcctaacaaccactattatgccgcattcccccgatttttgcaaacgtaggcaaaatgaattcaaaagtcagacgtcataccatcgaaagaaatcccgaaaatcatttattttcaatacttttagagagcatacttttatgcaagcgtttgcgacacgccgcagcaaagtggcaagtcatgcatgcaataaagaggcggttccaaggagggaccgccataatattcagcgatatcaaacagttccgttcaataattcagcaattccaatgttcgataacattgtcacctttatattggcttaatacacaataatgcgcagtgtccaatcgcagcaaccgcgcgaaatgcggatcaacaccgagccattgcgacgtcaagatacgaagaacgtgcgcatgcgccaccagcagcacatcgtttccagcgtcgagcaacggtttgaccgtggcgatcgcctcacgtgtgcgcgccgcagcttcctccaccgtctcacccggaccgttgtgcacgggcacctgctcgccgttcggcaacgtctcgacccaatcgccctccagtgattcggggagcgaccgcggtccgtcgcgccacacatcccaagcgaaaccgcccgccgcgctcacatcctgacgcgtacggccctcggcacggccgtaatcccattccgcgatttcgggaagcaccttaaaatcgccatatccggccagctgcgccgtctgctgggctctgcgcaacggactggcgaacatgcacccctgcgcgaaaccctggggaaacgcctcacgcaaccgttcgccggcggcacgagcctgatcgcagccaatgtcagtcaacggaatattggtgcggccggtgtgctgtccggattcgctccacacggtctgcccgtgacgcaacagcaccaagcggccaggggtgattgcggaagcggcattgcctcccagttgagtttcagtcatgtctctactctagccgacgcaagctgcgttttcatcccattccgccacgtgtcccgcacatattccggcatgttttccgacgcgttacactggtttcatgagtgaaatgccgaatatggaatccagtgcggaccgcgtggtggcggccctgcacaccgtcgacgagaaggtgaatgcgatgcgcgaccagagactgaacgatcccgattcatttggcgataagattttcaagtccgtcgtgcccacgttggccggactggtgctcggcaaggcgttcgagatggtgtggaagaaaagcgtcggccgcaaggccgtccgtgccgacggtaccaagaacgaggctgcggaagcggcgctcggcatcgtattcgccgtggtttccgccggtttcggcgcgctcgtatcgcaactgtccggccgcgggtcgaaggcgattgtggacaggcggcacgcacggcaggcgcatcgcaagtaaatacgtcgcaaatatcgcaaagcagtctcaagtagatatgttctcacagggagacggatttagcccgattcccttgcaaaatcgcgccgcgcggacaacaatggcggtatgagcaacattcttcataacgcaactgtcgacactctgctggagcgtcgttccatccgtaaattcaagccgaagccgctgccggacgacgtcgtcgaaacgttggagaccgtagcgcagcatgcggcgagcagccagttcctgaacgactggtccgctatccgcgtcaccgagccagccgccaagaagcgtcttgccgaaatcggcgggcagccgtatatcgcgaccgcgccgctgctgtacgtgttcgtgctggacgagcatcgcaatgccgcgatcgccgcgcgcaagggcgtggaagtggcgtccgacgcgttcacgctcaatggcagctatcgtttcacgcaggcgcagaacgacgcggttctggcactgcatgcgatggagacggccgcgtactcgctcggcttgggttgcgtgattctcggctcgctgctcaacgatgttcccgcgctgatcgacctgctgaatctgcccgaatacacgtacccggtgctgggcattgcaatcggcaagcccgatcaggagccggccgtcaagccgcgtatgccgcgttccatgcagttcttcgagaacgagtatccaagtagcgatgagaagctgctgtccggcttggattcgttcgacgccgaagtgcacaagtattacgatttgcgcgatactgaacggccggtggacgcgttcagcgaccagattgcggcaaatgcgatcgacgagggcgtgaacgccaaggccgttgccgtgcaggcgaagcgacagggcttccgtttggagcggtagatacatggcagcgctcgtatcattgatacgaagctgatacaacacaaggcccggtggattgcaatgaatccgccgggccttggttttatatgttgccttgttctcggtattgtcctgttatgccctgctattgctctgctattaccttctgcggggcttgtagcccttcttgcgggaatgtggcttgagctgctggttaagcggaacatgcatgtagctggattgtggatcgcgatgcgtgagatgccaagtaccgcagaaatcgcaacggtatacccaaagctcagtgccgcgttcgcgccaactctggtcggcggcctgctgagccgttgccttgtcgtgatacatgatcttgttcgactcggtgcaacgtttgggtacgaagtaatgcatagttgcccagtctataaacccattacgataaaacgcttgcgccctacttgtgttcagggataaaaaatggggtttccggagcgtaagctcgacgggaaccccggaaacgaaaaggggcctcccgggagccaaaggctcgaccgggaggcccaacatgtgaagcggcggcgtgctactctcccacaccctctcgagtgcagtaccatcgccgcgcctggccttagctaccgggttcggaatgggaccgggcgtctcaccagggctatgaccaccgcaaaaccgcgatcacggaacgacaaccaaaacatggcggccattccggccattatgttatgaaccgtggcggtctgggaaccggctagcggacgcgaggcaaagcctaccgttgtatcgttcagtgaccatcccaacgcatattgccgtccaggacgatccagcacaggaaagacgcggaaccaatcccgcaaaaggatcggaatgttatgtcgccgtcgcccgttagtaccggtcggctccacccctcacggggcttccacctccggcctatcaaacacgtgttcaacatgcgggctacaacagttcaagaccgtacggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccacgaatgctggcgcacccgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccggacgcaaggtccttcaccccagtgggtctcccttataccgaaggcacgggagtgatttgccgagttccttgaccaggattcgctcgatcgccttggtattctctacctgaccaccagtgtcggtttggggtacgggcggccatggccctcacgccgaggcttttctcgacggcctggacaaccggatatcgaaccataacggctcccatcatcacacctcgccatgcacgccatgcggatttgcctacatgactggctgcgtgcttgaccacggaaaaccacctccgcggccggctcccattccgtgtcacccctgcgctgacctactgcggctacgctcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggccggtttccaccgccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccaggacaagcgactgaaaacgccctattcggactcgctttcgctacgcatacgccacacggcttatgctcgccacccgccactgactcgcagactcatttttcgataggcacgccgtcaccccaccagggaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtaccccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaaaaccatcgtcccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgatccgaccagccacccaggaccggccaccacgcatgggcatcgaaccgcgccacagaaaacccgtggggtggcggtccgggagcccaaaagcatacccataccactcccggacgggacgaatcccatccaagccattgatctcttccacaccagcatccacaacaacgacgccgactgccggcgcccatgtggctcacactgtccaaaaacatggactgtattctccgtagaaaggaggtgatccagccgcaccttccggtacggctaccttgttacgacttagtcccaatcacgagtctcaccttagacggctcccccaaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctccccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatagaatctttcccagaaggacatgcatccaactggagcatccggcattaccacccgtttccaggagctattccggtgtatggggcaggtcggtcacgcattactcacccgttcgccactctcacggccggagcaagctccagccgatcccgttcgacttgcatgtgttaagcacgccgccagcgttcatcctgagccagaatcgaaccctccacaaaaaaacttatgcggaaagccaacacgtgactctcatctaagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccactcacccacctcatgtcccggactcgtccgggccactcgctgagcggcagcaagggattaacttacacgaacccgtccacttgcgcaaatcggcattccgcaaaccccgtaaaaacccttgcggcgcaacgcattcatcggcgtgtcgaaaaccgcctatcgcacgccgcatcatcgcagaaatacttcagacaagcctcaaaacggcctgaaattcatcagaaaaacctgtctacgggcgtgtcgtgagcctgcaacggtttccaaatacggtcggaaagccgaaaaagacgcatacggaggaaaccgcgcggtggtatgtatggaggtatgagcaaaaaaatcgcagtattgacgggcgcaggcatctccacgtccgcaggcatccctgacttccgcggcccggacggcgtctggaccaaacatcccgaacaaatgaacgtgtacgacatcgacgcgttcctagccaataaggaagaccgcgagtattcctggcgctggcaaaaggaatcgccagtatggaacgcgcagccgggcaccgcacacaaagcgctcgtcaagctggaacaggcagggctgctgacgctgctcgccacgcagaatttcgacgcgctgcacgagaaggcgggcaatagcagcaacgtcatcgtcaatctgcacgggaccatcggcacctcgcactgcatgaagtgccacgcgaaatacgacaccgccgaaatcatggcgaatctcgacaacgagccggatccgcactgtcatcgcaagctgccgtacagcggcaatatgccgtgcgacgggctcatcaaaaccgacgtcgtctactttggcgaggcgctgccggatggtgcgatcgaaaaatcgtaccgtctggcggcgcaggccgacgaattgtgggtgatcggctccacgctggaagtgatgccggcggcgagcattgtgccggtcgcggcacaggcgggcgtgccgatcaccatcatgaacatgggacgcacgcaatacgatcgcttggccacacggcttatccgcgacgatattgcgaccgcgctgccgcagttggttgatgagacgatcgctgaagaacagggcaaataacaccgaatgaacaagcaaggctcctcaacctgattgggtttgaggagccttctttgatgcggaagatatgcgagaatccgcgcttatccaccgtgggaaatcagtagatgcgcttgggctggaaaccggccgcgcgcatcgcgtcaaggatgcggtcgatgtgctcaggaccgttggtctcaacggtgacgcccaaggaaaccgaatcagtgtaatggctggaagccttgaactggtcgtgatcgagtgcgatgacgttggcgcgctgctcggccagaatcgtggccaccttgaccagctggccaggggtatccggaagctcaacctcgaagttcatgatgcggccacgggcaatcatgcccttctgaatcaccgcgctgatggagacagtatcctcattgccaccggaaagaatcggcaccaccacatgcgggcccttcgcctcggcgaacttgcgcgagcgcagattcaggtgctcgagcgcggccagagacacggcaccggcagcctcgaccaccagcttgtgcttctccagcatgagcaggatcatctcgttgatgtcgcgctcggtgacggtgaccagatcgtcgaggaactcgttgagcagcgcgaaggtcaggtcgcccggacgcttcacggcaacgccttcggcggaggtacgcacctggtcggctgcgacgacgcgaccggcggccaacgaattcttccatgccgggctgccttccggaatggcgccgatcacacgcacctcaggcttgaacgtcttgatggcgagcgccacgcccgcgcccagaccgccgccgcccaagggcacgaccacgtcggtgacgttcggcacgtcttcgaggatctcgagaccgatggtgccttggccgcacagcacctcataatcatcgaacgggggcacgtagatcatgccttcgttgtcgctcagttcctgcgcgtgcgctgcggattcgtcgaacacctcgccgcacagcaccacgtccgcgccgtacgctttggtggcatccaccttcagcggcggagtgatctgcggcatgcagatggtggccttcgcgccacgttcacgggccgcgtacgccacaccctgcgcatggttgcctgcggaagcggtgacgatgccgtgagcgagctgctcgtcggtcagcgatgcaatcttgttgtacgcgccacgaatcttgaacgatccggtgacctggagattctcgggcttgagcagaatctcatgtccggtcatttcggacagcacaggcgacggaataatctccgtgtggcgtgcggtgcccttcagtcgttcggcggccagtttcaattcagcggcatgatcgcgccgcaatgctttgagcacctcgttttgttccatggacgttattgtaagcgcacgtctgccgaagccgacgcgtggtatcggcatgtgggtgccgggcagacgggcggcttggcggaacgggaggagcatcgcaagaaggtagtaaaaatgcccgagtggttccgtgatgagccactcgggcatttctgcagagagttatagggaaagatcgatcagagctgaatcacgactccctcccagcgagcgagctcgccacgagcgatcgatttaacactatgcatagcatcataggtgctgagcagtacttgcggatcggacacgccgtcggaaagcagctccgccacgtccgaaggcagcgccgcggacctgtcggtgaggttgaccacgacaagaatcgtgtcgtcgccattggtgcgcgtgaaagcatacacctgatcgctgtcggcggcgagcagatgccattcgccagtggagatggtggcgctgttgtgccgcatggcgatgagcttcttgtagaacgtgtacacggaatccggatcgtcgaattcctcggccgcgttgatttccacatgattcgggttgacgctgatccacggttcggctgccgcgtccgccggggtgaaaccggcatacttggaggcgtcccactgcatgggggtgcgcgcgttgtcgcggccgatgagggcgagggcggccatcatggattcggacgactggcacttggcttcctccacgcgctggcgatagccgttgagggcttccagatcgcggtattgttccagcttggtgaagtgggcgttggtcatacccagttcctcgccttcgtaaatgtacggggtgccgcggtgcatgtgcagcaccatgccgaacgccttggcgctcagttcgcgcgaatcgcggtcggagtcgttgccccaacgggagaccacgcgcggctggtcatgattgcagaagaacaggctggcccaaccggccttcctcacggcctcctgctgctcggtcatacggtcgcgcaggtttttgacctcgaacggcacggtattccacttggagccttcctggtcgatgccgacatggtcaaacaggaatagcatgtcaagttccttgttggccggatcggtgacgtgctcgttacgggccggggtgatgcccggagcctcgccgacattcatgtagccttcacggccttcgaatacctcacggcgcatttcggcgaggaactcgtcgatgcgcgggccgtcggagcagaacggatacgggctggaataaccttcctctccaaccggattatcggcgatttcggatcctgcctcccccggcaacttgccgttcttgtcgatgaccttggaaatctgggtgatcacgtccatgcggaagccgtcgatgccgcgatccatccaccagttcatcatcttgtagacggccttgcgcacctcgggattctcccagttgaggtcgggctgcttcttggaatactggtgaaagaagtattcaccgcgcttcggatcgtactcccatgcggagccgccgaaataggagccccactggttcggctcggcaccgggcgtgcccggctcatggcccggcttggccggacgccaccaataccaatccgcatgaggatcgttcttgtcgcgggaagcctggaaccaggcatgctcgtcggacgtgtggttcacgaccaggtccatgatgaccttcaggccgcgcttgtgcgcttcggcaagcagctcgtccatatcggccattgtgccgaacagcggatcgatgtcctggtagtcggagatgtcgtagccgttgtcgtcctgcggggacttgaagaccggggacagccatagcacgtccacgccgagatctgcgagatagtcgagccggctggtgatgcccttcagatcgccgatgccatcgccattggaatcctggaaggaacggggatagatctggtagaccaccgcgttcgcccaccacggattcggggtggcgccattcgaacggacggtgtcagaaagagtggaacgattgaaattcgtcatcgcgattgagctcctttgcctaagtggaatggatgaactttgctatatcccatggtacgtaaagcgttttttctttcttgcctgcggcgcgttttgcaaagcaggaaatgaaagatatattgcaagcgggatgcgcccttcggaatcacatcaatgcatacgaaaagcgggaatcctcgaaaaaggggaaacgaggattcccgctcggcgctgtgaagttttacttcacaagcagacggcctacggccgcgttgttcctgccttcgctcgcctatcggctcgctcaggaggaacctatgaacagtccacaggactgttcacttcacggctcctctcatcacaccaccgacgacccacttttgggcgaagacgtagacgataagcaccggggccatggccatcaggtaggaggcgaaggccatcggatagttcgacgtgaactggctctggaacacgtactgcgccagcggaatcgtctgattgctctggtcggtcagcgtgatcaacggcagcaggaagtcgttccatgcccacagtgcggtcaggatggcgatcgtggcgttgatcggtcccatcagcgggaaaataatcgtccagaagatacgccaggtcgaagcgccgtcgatgcgcgccgcctcttccaacgaaatcggaatcgaacggatgaagccgatcgcgatgaacaggttcgtgccgatgccgagaatcgtgtacagaatgatcagaccgagctggttgtccaggtgcagggtgcccatttccttggcgatcggcagcatgacgacggtgaacggcacgaacatcatggccaggaagaagtagtacaggaagcggaagaaccgcttatccatgttccttgccacggcgtacgcgacgaacgtgttcgtcagcagcgtcagcaccacagcgcacacggtgatgatcgcggaattgagcgcggccttcggatagttcaccttgttccacgcgtccgcgaaattatgccattcccacgtggtcggcaggctgaacgtgcccgcttcgcccggcgtcttcagcgcggtgacgacggcgaagtacagcggcacgagcaccgtcaggctcagcacggcgacggccgccgtcagccaccagttgatgctgtggtccttgcggatcttctccggcttcgcttgcgattgtccgctttgcgcggcggccggcttggttgcaacagttgcgctagtcatgatttcttccccttactctcagaccttttccttgccgctgaagaacttcagctgcacgaatgcgaggattgccagcacgatgaagaacgtgaccgcgttcgccatctggtaggagtattcgccgttgcccaggccgttctggaagatcaggtaggagacggtttcggtcttggaatccggaccgcccttggtcaatgccatgacctggtcgaacgcgccgagcgagttcttgaggctcagcaccatgttgatggtgaagaacgggccaatcagcgggaacgtgatctgccagaagttctgccaggcgttcacgccgtcgatggacgcggcctcatagatttcgttgtcgatggtctgcagacccgccaagtacagcagcgtggagtaggccacaccctgccagatggacaggaacacgatcgggaaccatgccagatccggattggagatcatggatgtggacagccaatcgatgtgcagcgcctggccgagggccggcagcggggtcatgaagatgtacttgaacacgtagccgatgaccagcaccgacagggtgtacggaatgaagaagatggctcggaagccgttcttgaaggcgattttggagttcagcagcaccgccaggaacatgccgaggatgttcgtgccgagcgtgatcagaatcgcgatgaaaatcgtgaacagatacgcgtggccgacgcgtgcgtcctggaacatcgcgatgtagttcttgaagccgatgaacttgtaatcgccgtaaccctgcgaattggtgaacgagtacatcgcgccctgcaggaacggcaggtacaggaagatgcacacgagaatcatcgcgggaatggtcatccagtagaacgccggatcgaccttgcgcttggagtatttcgaaaccttcttcggcttctttgcggcggccttgtcggccttggccgagatattgccagtcattgtcgttcctcccctcacctaaagttcctggcttcgatcttgtcgtattccgactgcatgctgttcaggaatcgtttagtattgcccgactgcaccaacgtctgcaggaaaccggcgaggttgatgcttgccggcacgtagtggtcacagaaatcagccagcttgccggccttgtagaagtcgagcacgccattcaacgcttcatcgccgacgtacgtatccttgtacggggtgaacgcagactgctgcttggagtaatcctgcacgttctcctcgctcatcaggaagtcgacgaattcgcgagcctcggtgtaatgcttcgtatgcgcgccgatcgtcagcatcacgtcgtcgccggcggtcagctgctgttccttgacgttgtcggtggccggcatctgcgcgaaccgcagattggcgtccttgttgatcagacggatctgcggaatcgcgtacgtgccgagcggcagaatcgcggccttgccggaagcgatgtcctgcgtagcctgctggtaggtgacggccggattcttctgcgtgtagttctggtaaatttcaatcagcttgccgctgacgggcgtccacaagtcggagaaggtcttgctgccgtccttgagatacgcgtattccgattccggcaccagcgtcgaattcagcgatgcaagcggcgcctgcaacgtccacggatcggcggtgctcgcctcaaccggcgtgacgcccttggccttgagccgcttgagcagcgcgatgaattcgctccacgtctgcggcggattgtccggatcctcgccggcctgcttccacacatcggcgttgatgatgtagccgcttgcgttgcccgcgtacggaataccgtacagacgcttcttggacttgtcggtggtctgcacgaggctcttcgcgatgttcaccatgcccggattgagctcgtcgacgatctcgtcgtcggtgaaatcgtggaagacgcccgcttcggcgagcatgccgtaattgatgtcgccgttgatggtgatgacgtcgggttcgcggttcttcaccagtcgcgtgcgcagatcggtggtggcgtccgacgaattgttgacattgactttgatgttggaatgggttttctcgaattcacgcgccttggcggtgaaccaatccgccgcctcggacttgaattggaagaaatccaaggtgaccgtgccggcggtgctgttgccgcagcccgcgagcccaaccgtcagcacaatcgcgcatgcagccgtaatagcacggcccgcgatccgcctgaaggtgcctgtgttggcattggaatcaggtttcattctctcgactcctttgtattttcctttttcacggcaggccggcttcattaccagcctccgttgctttttaattgtagaatcggcttgttttcattcccagtttccgcgcgcccgcatcgaacggaaataaaaaacggttattttgttattcttggaaagtaaataggcgataaggacggtacgatatggcgatttccccgattccacactggtttgaaggctcggagtacacgcataaggttgcggcctgcattatgaagtacggtccgatttcgcgcatcacgctggcacagatccttggcctttcgcaaggcgcggtatcgcgcatcaccagtgatttgatttacgctggcgtgatcgaagagacgccaatggcagcggggcatggcggcaagttaccgaaagatttcttgcggaaatcggcacaaaagtcaatccagaaagaaaatacggaacgtcgcggccgtccgcagaccggactgcgcatcatcgccaatgcgcgcacgttcgtcggcatgaaaatcaacaccacccatatcactgccgtaacagtaaacgcgcttgggcagatcgtgaccggctgccatgacctgccgctcgacgacgattcgccggaatcggtggtcgacgtcatcaaacagctgaccatggactgcgccgacgaggcgataatggcgggattgccttcgccatgcgcggtcggcgtctcgttgggcggacacatcgtggatgattcgatggtgacgttcgcgccgttcctgcattggtcgaagcccgtggagttttcggcgttgatccaggaggcgaccggcctgccgaccggcatctacaacgacatcgactcattggtggtggacgcgtgcatgttcggctcgggcgtcggattgaacagtttcgccgtggtgacgatcggcatcggcgtgggatattcgctcaccgtcaacggcgagccgatcgacaatcccgacaaaagctatggcctggtcgggcatattctggtcgaccccgacgggccgcgctgcatttccggacataaaggttgcgcgacgtgcctaactgacaattcaatcgcaacagaatattcggaaatgatcggacatccggcgacgttcgacgaattcgcggccgcagcgcgcgccagcaaaacgcaggccacgaatctggtgaaccgcacctgtttccgtttgggtacattgatcgcgaccatcgccaatcttgccatgcccgacaaaatcatgatcgctggcgaatcgtcgttcattgcgaaactcggcatagacaacctgcgtaacggcatcaatatgtatcggcatagtcaagccgcgccggtcgatttcgaaatcgccgagcacgactggtcgctgtggagcaaagcggccgcagcgcaagccattcgccagtatgtagggtaagtcgttcggaatcgctgtcgcagtgtgaggccggtacgcgaaagtaccagcctcaccatacaaaacagatactcagatgcggactactttgaaaaggacggcctgcgcaggatgcagcgccggcggacggatgccataggcggcgagcgcacggccggtcatcttcacaccatcggcggtccaccagccgagcgggctttgtccgttgccgatgtcctgcttggccaggtcgaggctcacgtcgagcggggacaccacgtacacggcgtccgggtcgaggccaggcagacgtacgggggcggacggataggtctgcgacgtggtcagctgcgtgaagcggtagatcgcggcagccttgttcggcatgacgcagccgtccacgcgcacggccggatcggcggcgtcagaatgcaccgcggtgtcgacggcgaaccattcgcgatgctttttgaattcggccgtccattcggcgagcttgtcgatgtcctcctgcggttccttgagcagattccattcgatgcccatgtggccgaagaaggccatggccatgcgcatctcctgggaggtggcgcggtgcgtggaatgcgccggggaagcgcccacgtgctctccgatcatctccggcggcacgagcagcgacgtgtagcgctggatgtcggcgcgttccaccgggtcgacgcagtcggaaccccagatacgatcggcgacttcgaggataccgaggtcgacgcggccgccgccggacgagcagctttcgatttccagaccgggatgggccgctttcaggtcggtgaagatccgatacacggcgagcgtctggttgtgcacggcgggacgtccggtgcgcggcgacaccgcttcggtgacgtatttgttgtgatcccatttgatgtagtcgatgccgagttcgccgacgagcttgtccatggcgccgtagatgtacgcgtacgcgtcaggattggtgagatcgacgacctgctgagtgcgcccctgcatcggcagacggttggcggtgggcttcagcacccagtccgggtgggcgcggaacatatcggagtccgggttgaccatttccggttcgaaccacaggccgaactccatgcctttgccgtgcacgtagtcggcgagcgccttgagggacttgtccccatcgggccaaacgtcctgtgagatctgccaatcgcccagaccggcggtgtcgtctcggcgggcaccgaaccagccatcatccacgacgaagcgttccacgccgctttccacggccttgtctgcgagcgcggtcagggtgtcgtaatcgtggttgaagtagacggcttcccatgtgttgaggatgaccggacgcggcttgggcgcgatgccatggtccacgagccagtcgcggtgcacgcggcggatgtaaccatggaagcgtgaggcgacttcgttgagcccctcgccgtaagagccgacgagccatggcgtggtgtagctttcaccgtgttccagaccgacttcgccgccgaagagcacttcgctgccaccgatcacgccagtggtgtagggcagtcgttccgcggacagcacgctgttgccgctccatgccacgtgcgcggagtagacgttgccgtgggtgaaaccgaagccgtgttcgccaacgctgagcagcagggtggcgtcgaagtcggggcggccgatcatggaggatttggcgaagcgcccgatggtgaagtcctggcgctgtggggaacgctcacgcagatggtgaccggtggtggtgaggatctcgttggcgtcggcgggcacgctgaatgcaagttcgatcttgccgatctcgagtcgtccctcgccggtgttcgtcacctccgcatgctggcggatgaggccggtttcatcgagctcacaggtccacgtaagtttcacgcattgttccacgtcctcggcagtgacggtgacggtaggcgtctgcttgggctcggaggccacgctccagctggggtagccgtctttttcggccatggtgtaggttttgccggcggccacggtttcggctttgatgtcggtgacctggaacttgcagaacagttccacgccgtcacggcgcacgtcgaaacggtcagagccggaccacgcttcggactgtgtcggcagcacgctcggccatgcggtgtagtcgagggctccggaaacacgctgcggagcgagcgcgtcgaacgtgttgatcacggtttccggtgcggtgagcgggcgaccccaatgcacgaatctcggcaaatcgctgccggggaacaccagagcaaaagctgcggcggcagccggctgctcggcatacacggcggtaaggggtgtgccgttggaagcggtgccgtggaaagtctgaatgagcgtcattgcagcatccttttcttgcgattcttggttggtatgacgctttgatgatactgcataccgcttttcttcccatcgccctgcgtgtttgtttctttcggaaagtaattagcgtcggcgcgcgaagaaatcggtcatcaatcgcccgcattctgcttcgcgcacaccgccaatcacttccggtacaagtccgacgtgcggatcgcggggaatatcccataccgaaccgcatgcacccaacttggcatcccacgcaccgaacacaatacgtccgatatgcgtctgcaggcaggcaccggcgcacatagggcacggctccaacgtaacgacaagcgtgcaatcagcgagattccaagtgtcaagcgaggcggccgcttcagccatcgccttgacttcggcgtgggcaagcggatcggcatgcgtctcacgcaggttccgcccgcggccaatcactcggccgtcagcggcaagcacgacggcaccgaccggcacctcgccatccgcggcggcttcgcgggccagcgcgaccgccagttccatatcatcgtcccatcgcatacgccacagtgtagcggcggccatacgaccgctccgcacgactggtccgcacgtccgacctgcatgcccgacctgcgcgcccaaccgaagcggcacgaacgtcagcccatagcgaaacacgctcataaccgcctcttggtaggctggaaaaggttggaaatacgcgcaaaggaggcacgttggcggtattcgagttgattctatgcatcatcgctgccgtcgtactgtcctcgttcctgagccgattcatacccaaggtctccacgccgctcgtgcagatcgcgttgggcgcgctggcatcacaactgccgttctttccggacgtaacgctcagccctgaactgttcatggtgttgttcatcgcgccgctgctgtatttggaagcgcacgaaatcgataaatcggaactgctcaaatcggtgaaactgtcgttgtcattggcgatcggtttggcaatcgcgacgatggtggcggttggtttcgcgttgcatgccgtatggccggcgattccgcttgcagcggctttggcgctcggtgccgcgcttgggccgacggatgcggtcgcagtgtcgtcgctcggcaaggaagcggcgctgacgcaacggcagacgagcgtgctgaaaggcgaatcgctgttcaacgacgcgtccggcatcgtcggcttccagttcgccatcgcggcggccgtcagcggtgtattcgaagtgggcgaatcggccatgcaattcgtggcgtccttcttcggcggcgcattcttcggcatcgtcgtgggcatggtggctgacgtggtgttcgaaacgatgcgttccctcggctgggaaacaatgaccacacgtattctgatggagctgttcctgccgttcatcctgtatttgggcgcggaagcggtgcacgtttccggcattctttcggtggtggccgccggcctgatcatccgtttcgaccgcaccggcatcggcccgaacgtggcgcgcacgaacatcgtctcgtccagcgtatggggagtgctgtcgttttcgctgaacggcaccgtattcattctgctgggcatgctgttgccgaccgcgatgaccgccagctgggacgatccacgcgtcagcaattggctgcttttgattgcgattctgaccgtttcggccgtggtgatcgccatgcgtttcctatggatttcgctgatgctgcgattggcgcgcgacaccaccaccggcaagcgacgcaagatgacggcgaagcgctggcgatcggcggccgtcatgacgttcggcgggccgaagggcaccatcacactgtcgctgatgttcacgattccgtacacaatcgcggcgggcgcgaatttcccgatgcgcaacgaactgatcttcatcgccggcggtgtgatcgtgatgacgctgctgctggcgaatttcctgctgccgctgctcgcgccgaatcgcaataaggacacgtccacggaaatgacggaaatcaccatcgaagtgctgcggcggaccgtcgaggagctgacgggacgcgtcacgcccgacaaccgacgtgcggtgctcatggtcatcgactcgtatacgaaacgcatcacgcgactgaagcaacgcaccggcgaaatcgatccgcaggggtatatgaggctgcagatcgacgcgctgaattgggagaaggaatacgtcaagaaccgtctggcgggcgtgcgtgcggccatcaaagcgaatccgaccgagaaccgcgccgcgaacgacctggaggccgaggcctgcgagcgcctgctcgaccagatcatgagctcgctgcgccacatcgagacggagcacaattccggacgcacgatctggcgtctcaagggacgtctccgcgcgttgcagaggcgtacgggcacgctggtgcgccgcgtgaacagccgcatccgccgcaccaccccgctgttctccgacgacgaactgttcgcgcatacgcgcgtggtgcaggtggacgccatcgagtatgtgatcgaccgactgtatgaggagatgggcggcgacacgtacaacaccgagcactgctccggcctactgttggactaccgacgcagcgaatccgcgttgagggcgcgtccgaatatgggcatcagcgccgaagcgcaggaacaggccgaggaggtcaagcgcgaaagctacggcatcgagctgggcgtgatccaggacatgtatgaggccggcgacatcacgcgtgcgcaaagcaagcagctgcgacgcaacgtgtatgtgatgagcgtggatgcggacgcgcagatctgacgttttttcgatttccggcgttcggatcgcgtggcgacggacgattgcgcaatggcggacgatcggctggaatcgcatccagccgaaatcgtgttcgtcgggaactgtgccaaattgcgcctgaacgaaatcgccatcggattctcaggaagttttcagaaaacaccagacatgcgctcagcatcaggtgtttatatatgaattgtcagcagaaacaagccgaccaggaaccttgaagttcccgacaattgaaccctttcttcttctctctcctttctctccccggcggccaatcccgccggggtcttcttttttcgccgcttgcttcgcctccctttcccagcttgtttcacggcttgtttcacgtcccttttcacggatcttttcgcactgcgagcgtacgccacaatcgcacgctatattggaaatcatgagcgacgcaatcgaaaacacaacaggcagcgcagacagcaatgataagaccaagctgatcggccgcgaatcggacgtggtgccgggacgtttcggtgaaccgctgcaaatcacgcatgtgcagtattcgcacggcggcggcaacaccgcgccgaaacgaccgttgttcctgtgcctgcacggctgggggtcgaacgagacggacttggccgacatgatgcgctacgtcgcgccatacaacgattttgcctcgttgcgcgcgccgctgacgttgcagccggctggccgctttgcacccggcgcgtactcgtggctgcatgattgtgtggataccggcgaggatttggaccgtgacgcattcgccgcagcgaaagcaatcgacgattgggtttcggcgaacattcccgacgaccgtgccgtggtgccgatcggtttttcgcagggcggtctgctggcgattcacttgctgcgcgtgcacccggaacgctacgcggcgacgatttcgttgtccggttttcttgcgcccggcactgttgcgggaaccgcgccggcggacgatcgcgtggctgaactcaacattccgacgttcttcggctatggcaagaacgataccgtgattcccatgccggaactgttcgcgaccgccgcgtggctggacgagcacacgttccttacggaaaaaagctatcgtgggctcgaccattccgtaagtatggaggagttcagcgatttgcgcgattggcttgccgcgcacaacatcgcgccgggaatcctgtaaatccggaccagttagaacaatcgcctcagtcggatcagtcggtgatgtcggccttgtagaagttcacgtaggaacggctcggggtcgggccgcgctggccctgatagtgcgatccggtggtggcggagccgtatggatgctcggccggcgagctcagctggaagaagcacatctggccgatcttcatgcccggccacagcttcaccggcagtgtcgacacgttggacaattccagcgtgatatgaccttcaaagccagggtcgatgaagcccgcggtggagtgggtaaggatgccgagacgaccgagcgagcttttgccttcaagacgagccgcgatggatgcatcgagcttcacatactcccatgtggacccgagcgcgaactcgcccgggtgcaggatccacggttcgtccggtttgacttcgaactgttcggtcagctcgccctgattctcagccggatccacgtacgtgtacgcatgattgttaaacaaacggaagaaacggtccaatcgcacgtcaatcgatgccggctgcaccatctccggggtccacggatcgagtgagatatgaccgtcggcctgtgcggcgagaatgtcgcgatcggacagcagcatcgaaattcctccaaacatcaccggaacaatcgtcatatgagcgggcgcgcagccaacgcgcgcccaccaactgtcgtccagtctagcccgtcgacgctataagccagcatcaccgccgatgcatcgcacgtagcacgcacttgcgcagctcggaggcgacgagcacaatcatcgccaggccgaggcattcgacccacgcacccgcggacagcggcacggtaccgaacgcggtgttgaggaacggcacgtagaccaccgcaagctgcagcagcgtggacagtgcgatcgcaccccacagccacttgttggcgaacagccccacgaacaccgactggtcatgcgagcgcgagcacaacgcgttaagcatctgcgcgaagaccaggatggtgaagcccatcgtgcgcgcttccgtcatctgcgcgtcatgtccgatggcatccacggaacggtccgtgaacagacctccggcgaggtgcatgtccatgccgatcagcgtgacggcggccatgatgatgccgatgaagatgatgtcgccccacatctgcccgtcgatcacgcggtcggtgagtttgcgcggcttgcgggccatcacgtcgtcggtggagggatcgacgcccatcgccaaggccggtgccgcgtcggtgagcaggttgatccacagcagctgcgtggcgagcagcggcacggtcacgccttggctgcccggctgcgagatgccgaggaagccggccagcatcacaccgccgaaaaccgtgaagacctcgcccacgttggagctgagcaggtatcgcaggaatttacggatgttgtcgaaaatgccacggccttcgcgcaccgcttcgacgatggtactgaagttgtcgtcggcgaggatcatcttggcgctctgcttggtcacttcggtgccggtgatgcccatcgcgacgccgatatccgcggttttgacggcgggcgcgtcgttcacgccgtcgccggtcatggccacgatattgccttgccgttgcagcgattcgacgatcttcagcttgtgttccggcgcgacgcgcgcgtagacggagatgttgcgggtggcgttgtcgaatgcggcttcgtccggcagctcgtcgagttgggtgccggtaagcacggtgctgccgaggtccgcggcaccggtcgcgtcgatgatgcctaaatcgctggcgatgcgtgccgcggtcagcggatggtcgccggtgatcatgacagtacggatgccggcgcggtgcgcttcggcgacggaatcgcgcacttcggtgcgcggcggatcgatgatgcccaccatgccgacccagatcagatcgttttccagcacgtcgctctgctcggctatatcgaccacatggccggcggcgttgatcgccacacccggcacatcggcaagcgacgcggtgccgagcggacggtatgcctggccaagcgtgcggtacgcttcggcggacagacgttccacggctgcgagaatctgctggcgatcgccttgcgtcatcgggcggacggcaccgttgactgcgattcggctgcagtagccgagcagtacatcgggggcacccttggcgaagacggtgagacgcccggcatcggcgttgtcctgcgcgacgacggccatgcgtttgcggtcggaggtgaatggaatctcgcccacgcgcgtgtagttcgcgtacttacgatcggccttcaccttgcgtgcggcgacgataagcgacacctcagtcggatcgcccacggcctcccataacgtattggcagaggaagcggaatccgcgccgttccgcacggtttcgacggcggtctcgcgaagctcgccgtcgtttgcgatcgcgcccacggccagcgtggtgacggcctcggcctgcgccgcttcggcggctcccgtaattcccgcggcttccgccgcgtcaatcgcaatcattctgccttctggcgcatagccggtgccggtcagctgcacctcaccgctcggcgtgaccacgcgttccaccgtcatctcgttgcgggtgagcgtgccggttttgtcggagcagatcaccgacgcggaaccgagcgtttccacggaatgcagtttcttgacgatcgcatgatgttcggccatgcggcgcacgccgagcgcgagcacgactgtcagaatcgcggcgagcccttccggcacggccgcgacggccagcgaaacggatagcagcagcgaatcgattacgtcgtggatgtcgttgaagccttcggtcagcgcaagcgccaccagcacgaccgccgcgataatgcacaccgcgatgccgagaatcttggaaacgtagttcatttccttctgcagcggactgtcatcatcatccgtggcctgcagaaggtccgcgattttaccgacctgcgtgcgcatgccagtgctcgtcacgattgcgcggccggtgccttgcgtcacggacgtgccgttgaacaccatattggcgcgatcacccaaggccttggcttcggcaagtgtgtcgacgtttttgccgaccggtacgctttcaccggtcaggctcgcttccgccacgcgcaggctggcggcggcgagcagacgtccgtcggcgggaatggagtcgccttcaccgagcacgaccatgtctcccggcaccacgtcgacggtgttgatgcgtgcgattttgccgtcgcgcagcacgttggtttgcggcgcggtcatttgggagagcgcttcgacggcttcttccgctttcgattcctgaatgtagccgagtaccgcgttgacgataaggataagcacaatgacgatggcgtcgaacggcagtatttcgccgccttccgcgcctggcgcagcgttggctttttcgatgaaccatgcgatgagcgagatgccggtggcagcgagcagcaggtagacgagggggtctttgaactgcgccaggaacttcttccattttggcacgggtggtgcggatgcgagctcgttcggcccgtattgcgcgagtcggcgttcagcttcggcttggctcagaccggtgttcggatcgacgccgagcgatgcggccacggcttgcgcgtcggcaagcgacgggtcgatttgtggcggctgctggttttgctgatcctgccgaatctgcgtgcgatcgcccgtagcggaatcgccgtcaaaattggcatgggactggatggactgatctttcttgcgatcatccatggtgatctccttgggagcgccgcggagtagtcagctctcccccgtcttacgtatgcctcgaatcgcggaaatcgaaaatccgcggaatcgcaagcattttgcaaaggcgaggcaacgctgcgcggttgtgggcaccgggcggacgccatcggcgcatcctgttattatcgcacatcctcggcgtgtgaaaaatggacatgtggcggaacgatgcatggcacgcgacgggtgcacgataccatgaagtatgatatattatcggcagttagtaaaattcattactaaacggtcgtgcaacatcgcacggcgcaaccgcaacgatgcagtgacaccaagtaatacagggggatgcaagatggcagatacagccgaactcgcaatcgtacatgcaaccacggcaagtgcaagctggctcaccgatccgacggtgttcgcagcgaaccgcaagccggcacattccagccaccgatatgtcatcggcgagacgcgcgagccgaagcagagcctcgacggcgaatggaaggttcgtatcgaacaagcgcgcaacgtggacgtggaaagcgctccgttcgcggccgtcgatttcgaggatggcgatttcggcgcgatcgaggtgccgggccacttgcagatggccggctatctcaagaacaagtacgtcaacatccaatatccgtgggacggtcacgaggatccgcaggcgccaaatattccggaaaacaaccatgtggcgatctaccgccgtcgattcgcgctcgacgcgcagcttgcgcgcacgctggaaaacgacggcacggtcagcctcaccttccacggtgccgccaccgcgatctacgtatggcttgacggcacgttcgtgggttacggcgaggacggattcacgccgagcgaattcgatgtgacggaagcgctgcgaaacggcaatggcaacgccgccgattcccccgaagccgagcatacgctcaccgtcgcctgctacgaatattcgagcgcctcttggctggaagaccaggatttctggcgactgcacggcctgttccgcaccgtcgagctcgccgcccagccgcatacgcacgtcgaaaccgtgcagcttgaagccgactacaccgcagccgacaccgccggtacggccgacaccgccgaactcaacgcggcactcaccttgcgcaaccccgccgacgcgatgactatcgaaagcacgctgcgcgacggcgacggaaatgtcgtatgggaatcaacgcaggcctgcaacggcgaaatcgcccttaattccggcaaaatgacgaacatcgcaccgtggagcgcggaatcgccgacgctgtacacgctgaccgtacgcgtcgtcggacatgacggcgccatcatcgaaaccgtgacgcagaagatcggcttccgcacgttccgcatcgaaaacggcatcatgacgatcaacggcaagcgcatcgtgttcaagggcgcggaccgccacgaattcgatgcgaagcgcggccgcgcgatcacccgcgaggacatgctttccgacgtggtcttctgcaagcggcacaacatcaacgccatccgcacctcccactaccccaaccaggagtattggtacgacctgtgcgacgagtacggtctgtatctgatcgacgagacgaatatggagacgcacggcacgtgggtggcaaacaatgtcgagcgtcctgaagacggcatccccggcagccgccccgaatgggagggcgcgtgcgtggaccgcatcaacagcatgatgcgccgcgattacaaccatccgagcgtgctgatctggtcgcttggcaacgagtcgagcgcgggcgaggtttttcgtgcgatgtatcgccacgcgcacacgattgatccgaatcgtccggtacattacgagggttccgtgcacatgcgcgaattcgaggatgtgacggacatcgaaagccgtatgtacgcgcatgctgacgaaatcgaacgctatctgaacgacggcagcccggcacatacggacggtccaaagaagccgtacatttcctgcgaatacatgcacgcaatgggcaattcgtgcggcaatatggacgaatacacggcgttggaacgctacccgatgtaccagggcggtttcatttgggatttcatcgaccaggcaatcgagaccaagctgcccgacggcacgacacgcatgtgctacggcggcgatttcggcgatcgtccaagcgattacgaattctccggcgacggcctgctgttcgccgaccgcaccccctcgccgaaagcgcaggaagtcaagcagctgtatgcgaacgtgaaaattgcggtttcggtcgatgaagcgcgtattacgaacgacaatctgttcgtgtctacgggcgattatcgcttcgtgctgcggattttggccgacggcaagccggtatggtcgactacgcgccgtttcgacgtggccgccggcgagagcgcttcattcgaagtcgattggccggttgatgactaccgcagcaacgccgaagagctggttttggaggtatcgcagcagcttggcaacgcttgcgattgggcaccggccggctacgagctggcgttcggccagtgcgtggtggcaggtgcgaagaccactgcagatgccgttgacgcggccggagctccggccgacggcaccgtcacccttggccgctggaacgccggcgtgcgcggacagggtcgtgaagcactgttctcccgcacacaagggggtatggtttcatatacgttcggcgagcgcgaattcgtgctgcgccgcccgtcgatcaccacgttccgtccgctgacggacaacgatcgcggtgctggacacgctttcgaacgtgccgcgtgggcggtcgcaggaaagtatgcgcgttgcgtcgactgcgcgatcgcaaatcgtggagaaaatgccgtggaagccacgtatacgtacgaattggcgattccgcagcgcacgaaagtgacggtccgttacgttgccgacacggccggcctcgtttcgctcgacgtcgagtatccaggcgagaagaacggcgatctgccaacgattccggcgttcggtatcgaatgggcgctgccggtggaatatgcgaacctgcgattctacggcgccggtccggaagagacgtacgccgaccgcaggcacgcgaagctgggtgtatggagcacgacggctggcgatgattgcgcgccgtacctgctgccgcaggaaaccggcaatcatgaggatgtgcgttgggcggagatcacggacgattccggccacggtgtgcgcgtgaagcgcggtgccggcgcaaagccgttcgcgatgagcctactgccgtattcgagcacgatgctggaagaggcgctgcatcaggatgagctgccgaagccgcgtcacatgttcctgcgtctgctggccgcgcaaatgggcgtcggcggcgacgattcgtggatgtcgccggtgcatgagcagtaccagctgcccgccgaccagccgctcagcctcaacgttcagctcaagctgttctaagctaagccagcttcagcctcaagcataaccgccgattcgcggcataattccggccgacttgccaataggcaggccggccgattctgttgatggctgaaaacaggcagggtgcctaaaatgaaagcacgtctttgaagcaaacgacgcctcaaagcatgtttttctgaaggagggcatcatgagctatccaaatatgaatcccggcaatcccaatgaccccagtcaaccaccgcagccgggatacggcgcctatgcaccgagccagcaagcacagcaatcgcaacagcaggacggtccacaaagcggcggaccagatgccgagcagacccctcgctattccggcaatccatatggcaacccctacggcaatccgtatggatatccgtacggtaatccgtatggttacgacccgaatagccatagcaacgacagtggcgagtgggagccggtaagcccgttcaagttggtggaatcgtggctgccgcaacgcgcgaagaatgccattcgcggtgtgtatggcgtgctcggcgtgatggcgattgtgctcggcattgcgctactcatctggccgggggtgacgctgaagatcgccgcggttgcgttgggcgcgtatttcgtgatttccggggtgatccgtatcgtcaccgcaattgtggagctcggtctgccgggaggctggcgcgtgcttgacattctggtcggcctgttgctgacagtcggtggcgtggtcatgctgaagaatgcgaccctgtccggcgccatgctggcagtgctcgtcactatggtggtgggcctcggctggatgatggaaggcgtgatggcgctggttgagtcgtggcatatgccaagttccgcatgggctgtgatttacgcgctgatttcgattgtggccggctgcatcatgctgttcagcccgctggcctccaccggttggctgattctgtttggcggatgcgcgttggttgcacttggcattgtggcgatcgtccgcgcgttcacgtttggcaaggtcggcaagtccggcaagaagcgctaactacgcgtagttctcccgtataggcgataaacccatacgggagaacgcgacgtgccgtacgattgacatgattttatagtcgcgctatgctaagtgaaacgtttcgacgaaacgattcgataaatagcggatagaacggcacaagagggaggcgagacgcatggcaggcatcaaagacgtggcccgcgaagcgggagtttccgccagcaccgtctcctatgtactatccggcaagcgttcaatctctgcgaaaaccaccgacaaagtcatggccgccgtagagaagctcggttacactccggacgccagcgcccgtaagatgcgcggcatgcgcaaccagatcatcgcgttgagcgccccgattcgaggcgacatcaaccaggccaggtacaacgcctacttcctgcgcaccgcatgggccgcaaggaatgcagggtatgacgtgatgttgctgaccggtccggatgcagtgaaggatatccgccgcgtgacgcaaagcaatcttgcggatggcatcgtgctgctcgacgtagagcaggatgacgagcgcgccgctcaatccggcactttttccaagccgtgcgtggctatcggctatccgtcgtcgcacgccggctgcgcctgcgtggacatcgatttcgcgctgatgggccgcaaggccgtcgacttcctgtacgagaagggacaccgcaccatcgtgttcctgcgcaacaacgaatccgactacaaccgccattccggttacgtcgtcatcttccgcgaaagcctgctggcgcacgcgaaggagctcggcatgacggtcatcgaatccgaacattacgaagcggacagcttcgacgcgcagcacttcgtcagcaccgtcttcgcgcaccccgaccgcccgaccgccatcatcaaccaagcgaacgcaagcgtcctcagccaggtgctgatggcgttgcacaacgcgggcatgtcgattccgcaggacgtttcggtcctgtcgtgcggcacgtatttcgaaggcgagccgacgcgcttccccatcaccgaaatgccggtcatgccggaggagctgtgcgccgaagccatgaacctgttggtctccgccatcgaggagcacaccgacatcaaaggttccgtggaactcatcgaacccgcgctgaagcgacgcggatccgttgcggaagcggggtccggcggaacaatatagattttcctgcgattaccggaaggcagagcggccggacggaatcgcaaggcaacataatttcatacggataatcgaaacgtttcaatgacgatataacggtctccgaagaaaccgaacaaacgaacaagccgggcgaaatccggcgaatccaaacggaccgcggaatcgcacgcacgtcatcgaaacgtttcaatacaaccagatgtgagccgtgccgcagggcgcgcctcaagaaggaaacaaggagaatagcaatgaacatcaaacgaggactggccacgctggccatcgcagcactgtcgctgacctccctcgccgcatgtggtagcgataccgcacaggacgaggaaaagccggacagcctgtcgttctggtattacgaagaggacgacgcaggccagactcaggcttggcgtcgcgcggccaaggccttcgaaaaagagaccggcgtcaagatcaacttcgagcgcaagtccttcacccagatcgcgcagaacggcagccaattcctgaactccgacgaagccccggacctcatggaatccaaccgcggcaacggctccgccggcgtgctctccaccatgggcctgctcaccgacctcggcgactatgtcaagcagtacggctgggacaagaaggtgaccggcgcaaacgcagcagtcgccaagtacgacgagaacggcatcatggacggcgatacctggtacggtatgaccagctacgctgaattccagcgcgtctactacaacaaggacctgttcgccaagtacaacatcaagattccgaccacctacgacgagttcgtggacgcctgccagaagttcgtggacgccggcgtgaccccgattgcagccgacgcgcaggaatacggcgtgatgtggctgtggtggcagctcgtttccaagaatgccgactccaagttcatcgacaactggcagctgtacaggggtgacgtcgactggaattccaaagtgctgaccaactccgtcaagaccatcaacgagtggcttgacaagggcttcatctcccgcaacgccactggcatgaaggccgaggacaccacgcaggccttcatcaaggacgaatatccgatctaccagactggtacttggaaccagggccgtttcgtcaagcagatcaagtcgttcgattgggacgcggccgtcatgccggaatccaactacgcagtcggctgcgcaggcaacctgctggtgattcctgagaagtcgcaccacaaggatctgtccgccaagttcatcgactacgtcctctccgatgatgtgcagaacttcctcggcaacgcaggcggcattccggtagcggcagacaccagcaagatcaccgacgcgaagagcaaggccatgatcgaggaatacgattcctacgccaaggacggcaagctcagctactacccggattacgcggcctccaacctcaccgacgcggttccagcggagttccaggagctggtcaacggcaccaagaagccggcagacgtgctcaagaacatccacgagaagtacgacaccggcatcgaggacatgggcgtcaagaacaactaaaaacaaccgatccttcctttccattccaactccaataatggtgcggcccgtcttcgggcggaccgcaccaaccctttcctcccccatacattccgcacgtcgcatcgcgccaaatcgtgcgtcatcacagaacaatccatcggaaatccctcggatcatcaatatttcaaaggacttgcaatgtctcaaaagaccaagcacgaagcctccatgtcgagacttcccggcaaccgctccgcgaaattcgttccatacctcatccccggcctcatcggtctgttcgcggtagttgttgttccgttcatctggaacatctacctgagcttcacccgctggcgtggcgtcggtcccgtcaagtgggtcggcctgaaaaactggaaacgcctgttctccgattcgacgttctggatttccttcgctaactcgttctggatcatcgtggctatcgtggtcatccctaccatcctcggcctgttcatctcgtctctgctcaccgacgtgatccaaaagaagttcggcggcaaaaccgcttccttcctgcgcgcgctgttctatttgccgcagctgcttccggtggccgtcgccgcaatcatcatgggctggatcttccgcccggaggacggtgccgtcaacgcactgctcgccaagatcggcttgggtgcattgcagcacaactggctgggcagccctgacagcgcactgccgatcctcatgttcatcctggtgtggatccagctcggctacccgatcgtcatcttcatgtcgggcctgcagcgcgtcgatccggaactctacgaggccgcaggtcttgacggcgccaactggtggcagaagttccgcgtggtcaccctgccgtccatcatccctgaactgctggtggtcatcctcaccgcaaccatcggcgcactgaagaccttcgctccggtctacctgctcaccaagggcggtccgggcacctccaccacggttccgtcgtactactcctacaaccagttcttccaggtgcagcaggtgggctacggtgccgcaatctccacagcgctgactgtggtaatcatcgtcttctccatcgtgttcaccctcgtgcagaagcacgtcgagaaggaactcgtctgagagaaaacccgaaaaacaatcgcaagaacatactaaaaatccgaaaagcaaaggtgccatcatgacttattccatgtccacggccgccgcgcgcaaggcctcgaagaaaacgcagcacgtgcgttccgcaggtgactggatcaccctgatcctgctcgtcgccggagctctgctcgtcctgttcccgctgctcgtcctgaccgtcaacgcgttcaagacctccgccgattacaacgccaccggcccgctctccctgccgaagcacttcaccatggaaggcatcatctccttctggactaccaccaacttcccgctgaagttctggaacagcttcatcatctccctagtggtggctgtcgcggcggtcgtgctgtcggtgctcaactccttcgcgctcggcatcggcaaggtcaagggcaacacctggatcgtgctcggcatcatgctcgccaacatgatgccgcaggaagcgctgctctacccgctgtacaccatgttcaagcaggtcggtctgtacaacaccaaactcgcgatcatcatcatcttcaccatcatccaaagcgcctacggcacctatctgctgtcctccgtatacggcacgttcccgcaggccatccttgaggccgcggccatcgacggcgcctctcgctggcaaatcctgcgcaaggtggtgctgccaatttcttggccgaccatcagcgtgctgttcgtgttcttcttcgtgtggacgtggaacgaatacatgattccgatggcgttcctcatgagcgatgacgtacagaccattccgctggcactcgccaccctgcagggccagcgcaccatggaagcgaccacgctggcatcggcttcgctgctgagcatcatcccgaccatcatcttcttcatcatcttccagcgcaagctgtcgcagggtatcaccgccggtgcagtgaagtaacgcgacccaacaacgctgggatgttgtgaaataacgcaaaaacagatacaaccggccgcggcggctttcagcaccgtagccggcattatcgacgcgcccactgcaagggggatctacgatagtcggtagtggtaggcggcgcacccatttccgcgtttcccaagctgtttaacaaaggagagaacaatgaatactatggcgacttccggtttcggcaacggtgccctcgattcgctagcaatcgcgacggaccacggccgtacacgttgcgtcaacgccgaaaacccgaccggcggcaagggcactgcagccaccgctgccagcgcgctcggcccgtcacgtaagggcagcccttgcatccagacgatcaaggcgggcgattcggtcacgctgatggacgtcgatggcccgggcgtgattcgccacatttggatgacggtcaccgaccgcacttccccgaccggtccgaacgtactgcgcaatctcatcctcgaattctattgggatggcgaggagacgccgtccgtgcagtgcccgatcggcgatttcttctgctgcggtcacgcacaggcctgccgtatcaattccatcccgatcatggtggtgccaaatcgaggtttcaactgctatttcgccatgccgttcgagcacgcgcgcattgtgctgcgcaacgatcacaacgaggacgtgccggccttcttctaccaaatcgactacacggaatacgacgcgctgccagccgatgcgatgcgcttccatgcgcagtggcgccgcgaacgcgtcaccgaaattgcccgtgactacacgattctcgacaatgtgcacggccatggcgcgtacatcggcacctaccttgcgctgaccgcgctggaaagccgctggtggggcgaaggcgaagtcaaaatgtacatcgacggcgatgaacagtacccgacgtggtgcagcaccggagcggaagactacttcggcggcgcgtggagtttcgccgacttcgacgagcacggccgcatgcgcgagaacacgttcaccggaccgtacctgggattcccgttctattcgcaacgcctcgccgcgcaccgcgaaagcgactactgggatgtggccacacccgtcatgcgcggcctgtaccgctggcacattccggatccgatttatttcgattctgacctgcgcgtcacctggcagcagatcggcaccgaggaagccggcaatttcgagcggcaggatgacgtcgcgtcggtggcatactggtaccagcttgaaccgcacacgccgttcgatccaatcggtgaccgtcacttccgtcagccccgctgatttacgattattccgctgatttacgccgatatcgccgtatcgtgcgttgacatgggaatggatatgttccgtctcgtgtcagcgtacgatacggcgattgtgttgttatgcgggcacagtaatcacattttcttcaagataacccgatgattttacaatagaaatgacgattgcggcatgccagacgcataccgacgtgcgtatagtaaaggcacaacagaaaaacaacagaagaacgaagaacaagaaaaacaacacaatagcgacgcaccgcacgatgtagagaagaaaaaaagaagcaagaaaccaggcggtcgtccgaaaggaaacatcatgaagaacaacgacactttcaaccagatcctcaactccaacctcgcttccatcgatccgggcttcggccagttcgcacttgccaaggcttccgctgatctgatgaagaaggtcctcaacaagtaagaccttcaagcaggaaggcaagccgaaccgcgtcaggccatctctttgaaacagaccgcgtgaggcaaggcaccgccgcagcgaacgctgcggcaccgattctcttctttccgattttttaaatcgcatagcgggaggccgcgattccaaccgaatcgcggcctcccgctttttcatacgcgcacatgcacccctgtcttgccggcaatgtccattatttgtgccacacaatcacgccaatacatcgctttccgttaacttcgcacgaacttaacagcaacttaccagcgaacttaacagatgcgaagttgctgttaagttatgttaagttgtctggcaagttcggtggcgtatctaccgcacgccacctgcgcagcgcaaccgctacagttcctccatcgcaagattgcgggctgcggcgcgttcgcgggggccgcgcgtcacgtagaaaccaatcgccacaattacgaacatcaccgtgcagcaggtccacagcacgtgactgccgaacgcgttcaaaatccagcctccgacaagcggcgaaaacgcgttggatagcgaccacaccaggttgtacaagccctgatacgtgccgcgtacatccttcggcgcgatattcgccaccgtcgtagcggcaatcgggaatgtgccaagctcgccgagcgtccacagcacggtcgcaatcgcgaacgtcacccacgaatcggcgccgatttggaacgcatagccaaccgcagtaatggacatgcccagcaccagcacacgggtgttgctcatccgctggaacagcgcgatcgcaggaatctgcagcaaacacagaatgcctccgttgatggtcagcaggctggaatattcgtccgtaccaagcccaatctgcgtcatcgaaatcggaagtccgctgacaatctggtaatacgccagcgtgtacaggaacatcagcaccaccatcgacatgagcgctttgtcggtgcaggcacgacgatagctgcgccaaatggagaatttcgattgctgcgattgagccgtttgcgcagtgccagaacgttccacgaagcgtttcacagaccgtccgacaccgtgcacgcccagcccggcctctttgaagaatgccatcatcagcaacgtagcgaataccaacacagccgcttccgcatagaacatcagcgaataggagattttgacaagctggttggcgatgatcgggccgatagcgaagccgaaattcgcagcccatgtttgcagcgaatacgcacgcttctgcttgcgaaacggcaccacgtcggaaacgtaagccgcgaccgcaggcgtcggcatagatgaaatcgcaccgtatatcagcaacgtaatcgccataatccaaggattgccgatacaagccaacaaaaccagcatcaccgcggaaccgagattgccgataacaatcatcgcggggcgcccgaatcggtcagacagcgcaccaccgtacaggcagccgaaaataccgccgaaaccgtacatggagacgatagtgccagccacgcccgcgctcacatgcatgtcggaaacgaggtacatggagaggaacgacgtgacgaagcggcccatccacagaataagcagcgtgacccacagaccccagaacatgaggggcaatccgaaaatctctttgttcttctccattcttgccatcatatcgagcaatatcgagcagacgcgaagccgccgccttttcccggggtgctgggacaatggacaactatggcaatgaaaaaaggaccgaccaaggggtcgggcggaaagcatcgtaacgcgctgaagggcaaggggccgactcccaaggccgaagatcgcgtatatcacaaggcttacaaggcgaagaaggcggcggatcgccgcaagatggccgatccgcgactggcggcacgtcgtcgcgtggcgaagttcacttcggaatccgacgatctggtcatcggccgtaacgcggtgcttgaggcgctgcgttgtggcgtgccggcaaccacgctgtatgtggcggcacgtatcgagcatgacgatcgcacgcgcgaaatcgtgcgtctcgccggcatccacggactgcatctgctggaagccgacaggctcgaaatggaccgtatcgcacgctcgtcgaaccatcagggcgtggtgctgaaggcgcaaccgttccagtattcctcgctggcagagctcgtggaccgcgccgataagaaggcgcgtgccatggaagcagccgattcggaaagcgcgcgcatcgcggcacgtccgctgttcatcgcactggacggcgtcaccgatccgcagaacctcggcgcggtcatccgttccgcggccgcattcggcgcgaacggcgtgattctgccggaacgtcgttccgcttcggtcaccgccgccgcatggaaggtgtcggcgggcgccgccgcgcatatgccagtggctcgcgtggtgaatctgacgaaggcgatcgaaagcctgaaggaacgcggctactacagcgtcggtcttgacggcggcggcgatgcgctcgtcggcgaaaccggtttcgaaaccgatccgctggtggttgtgctcggctcggaaggcaacggcctgagccgtctggtacgagaggcttgcgattccatcgccggcattccgatgtcgaatatggtcgagtcgctgaacgcgtccgtcgcggccggcatcacgctgtacgccgtggcgcgcgcacgtcgtgaagcggctgccgcagccaagtaatcgttatatatttgcgatacatacaaagaagctcaagcttttccagcttgagcttcttttgttttcctgagcttttcttgtgttagaggctccagcaattacggaccatgctaacgtgcagaatcagtggctccacaccgccgcgtcgggatcgtcgtcggggttgtagccgtcgtcatcgggatcgttgtacgtgtattcgtcgtcgatcacgccggaatcggcttcgtcgttcaacacgtccaaatccttctgatcgagcttgtactgcggcagcacgttctccacatagctcttcacggcttcggtcatggacacgtcgtggccggccttctccgcaaggaaccaacgatggtcgagtacctcatggaagaactgcgccggctcaatctgggagcggtattcgtgcggaatcatgcgcacggtcggctcgaacacctcgcgcatccagtcggtggccacgatttcgagatcctcgccatcacgccacgtggaggtgcggtaggcgtccagatcgttgagcagacggcgggcctggttctcctgcacgtcaagaccggtcagtcgcagcagcttgcggttggcgtagccggcgtccaccacgcgcggacgcaccagcacgcgcttgccgtcctcggcggtcttcatttccagctcgtccacgtcgaagcccagttcgttgagcttgttgacgcgcttttcgatcttccacatctcgtccgggctgaacttgtcggtgtcggtcagcgcgctccacagcgaatggtagcggtccaccaggcggtttccgatttcgatttcgtccacgttgctcggcagcaatgcgccggaagacagatccatcagttcgccgatgatgttcgtacgggccaaatccacatcgtattcacgctggccttcggtgaggttcacctgcagatcgccggtttcggcgtccaccaggaacgcggagaaagcgtcggcgtcacacaggaacagcacgttagacagggacacatcgccccaatagaagccggccaggtgcagacgcaccatcagcacggcaagcgcgtcgatgagtcgttcggcggtgtcgggacgcaggttgcgggcgaacagcgcgcggtacggcagcgagaatttcagatgcttggtgaccaggatggcttccagcggctcaccttgcgcattatggcggccggtgaccacggcgatcggctgcacggtaggcagttccagcttctgcagtcggcgcagcagctcgtattcgcgttccgccacgttgcgtgtgatttccttcatggcgtagacttcgtcgcccacgtgcacgaaacgcaccacgtgcctggagatgcctcgcggcaggttgaccagcaggtcctcaggccatgttgccagcggcttctcccacggcagcgtgaacatcttcggattcgagctcgccgcggtgatcttcaacgcctgcggctccgggctctgcgctgcggggtcctcggccttcacggaagtggccttaagcacacggggatccatctgtggcaattcatgtgattccatagctcttcaatttacccgctgacctacccacggcaggcggcaaagggactacgagtgtcacgatgagaacagcgggaaaagaaaagccccgcaccaacgcggggcttttccaacgagacaataagagaggaaagagaatgtctcgtttaatggttgacggacgtttgcacatccgccaagtattggttcaaccacccgccaagcgttccataaggaacgcccgacggttggttactcgttatcgtctcagttcagacgcagctcagtggacggagcgaacaggtgcatcttggacgggtcgatcttgatcttgacggtatcgccgaccttcggaagagcacgcgggttcacgcgaatcgtggtgagcttgttctgatcggacatcatggtggacgcctcagcagcggagccatcggtgatgatgttgccgtagatgtagccgtcggagcccagatcctcaacgttcatgaccttgagggagaaggcgttggcctcatccggggcagccagggaggcgtcttccggacggaagccgaccacaatctggccgttgtcttcggcggtgagcttgttgacggcctcagtcggcagatccacggtgtcctcgccgatctttgccttgccgttgaccaccgggtgggtgttgatgttcatcgacggggagccgatgaagccagcgacgaagacgttggccggacgatcgtacagctcagtcggagcgccgacctgctgcagaatgccgagcttgatgacggcgatacgatcacccatggtcagagcttcggtctgatcgtgggtcacgtacagggtggtgacacccagctgacgctgcagagcagcgatctgggtacgggtctgcacacggagcttggcgtcgaggttggacagcggctcatccatgaggaagaccttcggctcacggacgattgcacggcccatagccacgcgctgacgctgaccaccagacagagccttcggcttacgatcgaggtactcggtcaggtcgaggatctcagcggccttctcgacgcgcttgcggatctcttccttcggggtgccggcgatcttcagggcgaagcccatgttgtcggcgacggtcatgtgcggatacagagcgtagttctggaacaccattgcgatgtcgcggtccttcggctgcatcgtggtgacgtccttgccgccgatgaggatgcgtcccttgttgacctcttcgaggcctgcgagcatacgcagggtcgtagacttaccgcaaccagacgggccgaccagcaccaggaattcgccatccttgatgtcgaggttcagatcatccacagacggcttgtcattgcccgggtagatacgagtaacatggtcgaatacgacttctgccatgatttgtcatcctttcagaggcaggtacgtgcctcacgatccgttgtaaagggatttttgttcggtgcccatcctcgcggcttactactttgacaaagccacaattcaaagcgtttacttattggttggtttagcgaagatctcttcgttgagccatgacctactatacacacccaaaccgaatcgtcaatgcgtgtcgcgggttttcaccgctcaaaacagtctattagggggttatcatcccctcaaatcgatggtttttcatcacaatatcctcattccgcgagagaatggacggtagtctgaacggtgagacgtggaggttcatcgtgcgcaatatccgaatcggagtcgtcgaggacgaccctgcaagctgccaattggtactcgattacctcaatcgctaccaaagcgagaccggcgagcaattcaccgtctccgtattcgacgacggcgcgcgcatcgtggagaaatatgcccccgtttacgacattctgctgctcgatattgaaatgaaggagatagacggcatggccgccgcccgccgcatccgcgaacgcgacgacaacgtcgtgatcatcttcatcaccgcggccccgcaatacgccatcagcggctacgaagtgcgcgccctgtcctacctgctcaaaccgctgccatggttcgcgttctcgcaggagctcaagaaatcgatcgacatggtgcgccgcaacggcgacgattccatgctcatcgaaaccggcaaggggcagatgaggatgaatctcacggacatcctttatctcgagtcgatccggcacaccatcgtcatccacacgcttgacggcaaatactctatcaacggcacactcaaagacatggaagccaagctcgccgaccggcacttcttccgctcgaactcctgctatctggtcaatctcaagcatgtgacgggcgttgccgaccaggattgcatcatgtccgacgacgagcggctgcgcgtgagcagaccacggaagaaagcgttcctcgccgccttggccgactacatgggcggcggccgatgatcaccaacgcgctgcccgacatcccccgttcgtacaccgccatctgcgaatgggcggcatgcgtggtgtatatcgcggtactgttccgccgcgtgccgccgcgccgctccgtcgttgtgagcgcaatcggactggcggcgctcatcgccgtgcagtatttcgacggcagcatgccgatctggttttggatcgtcggcatgctgctcgccttcggctgcatgtacctgacgattctgttcggcgccggcaccggcaaacgcgaaggactgtacatcacggcgcgcgcgttcgtactggccgaactggtggcgtcgctgcattggcagatcgtcacgttcatcggcatgcgcaacggccgattcgcggattacgattggcatgccgtcttactgctcgttgccacctacgcattgtgtttcggcctggcctggctggtagaacgcggcaatttcagccagaccgcgcccacgttgccgacggcttccgcggcgaccgcgacggtggccatcacgatcgtcaccttcgccatgagcaacctgagcttcatttcgaccaatacgccattctccggttcgatgggccaggaaatcttctacatccgcacactggtggatttctgcggattcgcgattctatacgcgcaacaggagcaggctcggcgcattgaagcgagcgcggaaatcgcgtcaatcaacgcgcagctggaaagccaacatcaggagtacctgcagtcgaaggagaacatcgaatcgcttggtcggctcgcgcacgatctgaagcatcagatcgcggcattgcgtgccgaagtcgatccggagcatgcggcggcaggattcgagcagttggagaagtcggtgcagcgctacagcgcccagcagcataccggcaatcccgtgcttgacgtcatcctcaccacaaaagagcgcacttgcgccgatcgcggcatcagtttcaccgccgtagcggatgggtcgctcttatccaacatgtcgtcgatggatatcgcttcgctgttcggcaatgcgatcgacaatgcgatcgaagccacgtcgaagctggccgatccggaacagcggctcatcaaactggcattgttcgagcagaattccttcaccgtggtccgcatcgagaattattacgattcgcggctgaagaaagatgccgagggcaatctgcgcaccacgaagcgcgatgaccagcatcggcatggcttcggcgtgaagtcgattcggcacatcgcgcaacagtacggcggcgaggtgacgatccgcaccaacgaccactggttcgtactcaccgtgctgcttccccgtcagaccggcctgatggccatgtgaggattgcgagccggcaatgcgaaggctaacgatctgcagctttcgcccgcggtagatgccaagcggcaagcggcttggccagacgggaggcggtgaacgcgctgacggccaccgcaaggccgattggcacgaacaggttaatcggagcgtcagccaactccatcaccaggcaaatcgccatcaacggcgcctgctgcgaggcggcaagcagcgcgcatgcacccagcagcgcatacatgccgatcgaattcgtgtggaacacctgcatccaaagaatgcccagaatcgcgcctccggaagcgcccaatgcgatgcccggctgcaacacgccaccggaagcgccggaacgaatcgtcatcaacgtgacgatcgccttggccacgaaagacagcagcaacaccggaataacggccagatcggccttcgaggagaagctcagctgcgcggcggcgcggccattgcccatcacctgcggcacggcgatcgccacaacgcccgtcagcaggccggcaagcggcatcatccacagaatgcccgctccggacggcttgtttttctccgcccactgggagccgcggcggaacagcgcgccggcgacgccaagcatcaagccggcaatcagcgcgaacaccatgtagtcgggggtaaacaggccattcgccttgccgatcaaatagaacgtgtgcgtgcccttgaccaggctcgccacccatgaggcgagcgccgagcaggcgaacgcgagcgtgaccgtctcgagcgtcacgtcggcgagcaggatctccaccgcaaagaacgtgccggcaagcggcgcgttgtagactcccgcgagaccggccgcggcggtaatggccaccagcatacgcgtgtccttcgcgccgagacgcacccagcgggcgaatcgctggccgaacatcgcgccaagctcgcgcggagccacttcgcggccgatcgacatgccggtaccgacgataaaaatctgcagcagcacatgtacgatggtctgccagaccggcatcagcgcaccaccgacggctttcttgacggatggcactgttgtggtacgcgtgcgcagcagccaccagatcacggccgcgatggaggcgccgaccgtcacggaaatcgcacgacggatggcaggcacgttgaagggaccggattcatgcgcattctcgatgtatccaagcgcgaaacgctcgacttggtacagcataagtgtcagcaggcccgcggccgcgccaatggcgatgccgacgatggccaccgcagcgatcagccccggaatacgtccgatagtcggctgctgttccgtctcgtcctgcgattgctccgacaccattgcttctctcacgttgcgtgtacctcgtcttcagtccgtctcatcggttcgtattaccgcatcaccatcgttccacccacggcggatttatgcgccaatatcccccaccagaacatgaattccaatgtcagtcacacaacttgcgtctgcatagtgaacggccgatcaggctcgtcgtcctcggcaacaaggccggccacatccgccaaacaccataaggcgtacagcggcagattcatcggcggcaaatatattggaatatatagcattcaagacacaagatgcgcaaaatagacaatttcaaatcgccgtttttgcacaaaacagataatttccgccacagccaaagacaaggaaatcaaacctccgccacaccagggaaagcgcaaatccgcaatgtgaaacgcagaagagttacgtgcatggctcgcatgttgaaaacatgagcaaccatgagcaccagagaaggaatccacccgtaacacaaccgccgcagtccggaaatattggcgtcatgttcctgttttgccgttttcataagcgtgatatcgatggaatcgcaatattcgttcggctcattcgaagcatcaacgcaatacggaaaagagaagccatggccagcatcagcacaaccgcgcaagcgatcccgcaaacgccgccgcaaaccccatcacacccttcgatgcctatttccagcaccgtcaaagccgtaccccgctccggcatccgcgacgtgttcgaccgcgcactcgccggcgatgcggatgagctgcgcgaaggcctgcgtcggctgcgctcattcgcggaacagatatgaaaagcccgtccagggaaaagggaagacctggacgggcacaaggaagggaagagagaaatcagtgcagacttacttggcggcctccttcttgtcgtcgctcttcggcatgacccagaacttgagcagcggatagctgacgatcacggcaagcaaggtgttgaccacggatgcgatcgtgcctgcgatgccggcgttcatgccccatccctggcacagaccggtcacgtagcccggcagcacaaggttcaccaccacgatgatcacggcgaggatcacatacttccaagcggcgtccttgaagctggagtcggacttgaagacccacttcatctgcacgaagaagttcaccacctgcgcaagcacctcggcaagcaggaaggtgaggaatccacccagaccgttgcccttggtgtcatagttgaagatcaggaagtggaacggctgcgtgagccccaagctggagatgaagatggcggtgccgatccacgtcaccacgaaacgggtgatggtggagatgttcgacagcacattgaacaggatgaactcccagatattcggatgatccttgatccactggcgaatcggtccgaccttcttctcgccggcagcggtttcggccggcttcgcagcattgttgtcagtcatggttcagctcctttgcggtgcgcttgttggcggattggttgcggaagaagccggcgatcacgccgcccaatccgcggaaagtatgcccgttggcgatgttcacgatggcgtcgaccatcgccgagtcgaccatgccttgggtcatcttgctcatggcgcgaggcggcatgttcaggatgaacagggtgttcagatccggcgagccagtcttctggcggatcttcgcttcgcgcttggtcagtgtcttggcgacggtacgcgccacgaagcccttggaatccacccacgacatgatcggatcgttgacgccgaacgtcgtcggcttgccgggggcaagcacctcatggccgaacagcacggccatttcggcgtcggtcacgtccttgacctgtccggtcagatagtggccaagcgcaggatcggcggcgcaatcggcggtcgtgcaatcgccggccacggtgtgaggaatcgcaagcggcaaatgctccgcattgtcgccgaccagcagcgtccattcgccgctttccgtcttccatgcattggcggcaacatcgaaatgacggaacgtgtagcggtcgaaatcgatatgcacactcttgctttcatgcgcggccaactctaccttgacgaagcccttcagctcacggtcgggatggagcacgccaccctgcggcgcgcgcacatacaactgggccacggtggagccggcgacatcggaatcattggtgacgacgaaatccacaccggtcgcggtggcggtgatcgcgctgtacgtgaacgtggagtagctcagaccgtagccgaacgggaagcgtacgggcacgcccacggtctcgtaatagcggtagccgacgaacgggccctcgcggtagatcgcgtcacgcccgatggccggataccagccggagcttgggcaatcctcgtattgcatcggccaggtttcggccaaatgtccggatgggttgacttcgccggtcagcgcgcgcacggtggcggacgcgccggcctggccggacaatcctacgtacagcatggccgcaacatcgttgaaccacggcaattccaccggggaaccggcgacgagcacgatcaccaccggcttgccggtcttcgccaacgccgttacgagatcgttctgcgcctgcggaatcgccatggtggatcggtcaaggccttcggattcgctgcgttcgtcgaggccaacgacggccagcaccacatccacggcgtccttcttggcgagcgcgacggcgtcgttcagcagcacctcatccgacttgccttggcggtcgtagccctgctcgtagccggccaataccagtccttcggcgttcttgacctcgtcgaggatgttctcctccttggtggcgttcaccttggatgagccggaaccctgatagcgtgcggtcgcggccatatctccgatgacggccacgcgagtgcccggcttgagcggcagcgtggcggcgtcgttcttcagcagcacgctggaatgttccgcgaccgttctggcgatatcatggtgcgccttcgcgatgtcgtccgacagcagatcgtcgcggccgacgccgacgagcttggtcgccgccgcgattttggcgacttccgcggcacgcttgttgatgtccgcctcggcgagcgcgcccgctttgaccgcgccttccagctcgcgcacggaggtgaaacctggcgacggcatttccagcgagccgccggctttgacggctgcgacggcggagttggagccgccccaatcggagacgaccatgccgtcgaagccccattcgtcgcgcaggatctcctgcagcagatgcttgttttcgtgggcgtagacgccgttgacctcgttgtaggaggtcatgatgctcatcggcttggcctcgcgcacggcgatttcaaaaccggtcagatacaattcgcgcatggtacgttcgtccaccacggagttgctggcctggcggcgcagctcctggctgttgaccgcgaaatgcttcgggcatgcggagacgccgttgctctggatgccgcgaataaggccggcggccatacggccggcgacgatcggatcttccgaatagtactcgaagttgcgtccgcacagcgggttgcgtttgatgttcatgcccggtccaagcaacacgttcacgtcgagatcgtgagcttccttgccgagcgcctcgcccatctcttcggcgagcgccggatcccaggtgttggccacggtgcaggcggtcgggaagcaggtggccggcttggatgcgccgatgccgaggtggtcgccttcgccaagctgcctgcgcacgccgtgtgggccgtcgctcatgacgaagccgggaatgtcggcgcgatcgttgccgcgcgaatcccattcggatccgccggacagcatcgccgccttttcaacgatcgaaagatcttcaagttccatgggttctccctcgcactaggtgttgccaaaacctgctttgccgagcctgccctgtccgctccgcccgactgcgctgttttcttgcgatttcccgctgccgtaccgcgctgcatcgcaccgtgccgcacgcgggatttcgccgctagtttgattgaaccagcttttgcgatgccatcaccgccgtattacacaacctgtcgttttgctcgcacaatcggcatatgggcgcggtgaagagggtatgcggtggcgcagaacgcgcataaaatcgcatcgttccattttgcaatcgatggcaagcgtttcgatatgcgtatatcgttgcaatttcaagcgactcgccgatattgatacctttttgcgcaagcgctatcatacttaacgaaagtaagttttgctgacttttcttcaatgcggaacatgctttgatcactcaacgcggagagcgatgtttcgcagcgcacagaaaggataatgagatgcgcgaccagcaaagcagcgacacgagcatcgccctggacgccaatacggacgtccagcaggaggccgataaaccggcagtcaagtggaggtacctcttcggcttcctcgcctggaccgtgcttaacgccatcgtcatcgcactgtgcgctggcgcgtcggtcttgaccatcaagcgcatcaagtaattcaaacgggaccgtaccgtcgcatatgatgacacggtcccaatccagttctcccgatttttcccacactcaaaggagccccacatggtagacagcacactgttctcgctggccacgctcaacgcccatccggcaatgaatccggattcggtgatccagggcgatcattggcgcatcggcctcatcacggacgcgctcgtccgtttcgaatggtccgacagcggccgtttcgtggatgacgccacgcagatggcgatggtccgtgatttcggcgaaaagcctgaattcaccgtcaccgaacgtaatggctggctggaaatcgacaccccgtcgctgcatatctcctacaaccagcgcaagttctctccggaaggcctgtacgcaaccgtcaagcacgtcaacgccatcgaaaacacttggcattacggcgacgtgcagcgcaggaacctcggcggcacctaccgtacgctcgacgaggcgaacggccgcatccccgtcgatccgggcgtcaacagcaccgacggttgggcgatcatcgacgattccaagtcgaacgtcatccgcgaaaccgccgaagtgaacggcaaccacaacgatttcggcacgtgggcgaccccgaaggaagagccgaccaccgacctgtacctgttcggctacggccaccgctaccgtgaggccgtgcacgccctgtaccgcctgaccggcccgaccccgctgctgccgcgcttcgtgctgggcaactggtggagccgctaccaccgctataccgaaaccgaataccgtcagctcgtcgaacgtttcgaaaaggaaggcatcccgttcaccacggccgtcatcgatatggactggcacctggttgacgacgtcgacccgaagtacggctccggctggaccggctacacgtggaacaaggacttcttcccggatccgaagcgcttcctcaactggctgcacgagcatggcatgaaggccacgctcaacgtccacccgagggacggcgtgcgcgcgttcgaagagctgtatccgcaggtcgccaaggccatgaacatcgatccggaaagcggcgaggccgtgcagttcgacctgaccgatccgaagttcatggaggtctacttcgaccagctccaccacccgatggaggaagatggcgtcgacttctggtggattgactggcagcagggcggcctgacgcggcagccgggactcgacccgctgtggggcctgaaccacctgcattacctcgattccgcccgcaacgacggcagcgactacagcgaacgcaacccgcgcccgctcaccttctcgcgttacgccggcccgggctcacaccgctacccgatcggcttctccggcgacaccgtcgtgacgtgggagtcgctgaagttccagccggaattcaccgcctgcgcttccaacatcggctacggctggtggagccacgacatcggcggccacatgttcggctaccgtgacgaggaactggaggtccgctggtaccagctgggcgcgttcagcccgatcaaccgtctgcattccaccgattcgccgttcaacggcaaggagccgtggaacttccacggcgatgcggaacgtgcgatgacgtccgcgctgcgcctgcgccatgcgatgatcccgtacctgtacacgatgaaccgtcgcgccgcgttcgacaacgagccgctcgtgcagccgctgtactgggactatccggaaatcgaagccgcatacaagctcaccgacgaattccgtttcggcaccgagctgctggtcgcgccgatcgtcgatccagccgagcgttccgtgcagcgtgcgaaggccgacgtgtggctgccgcagggcgaatggttcgatttcttcgacggtcgccattacacgtctcgtccggccgaaggccgccgtctggaggcttggcgcgatctcgaccgcatgccggtgttcgctaagcccggcgcgatcgtgccgctgcagatgcccgccgagggtgaggcgctcaactccgtggccaacccgcgcgcactgcaggtagtggtgttcccgggtgccgaaaacagcttcacgctgtgggaggatgacggtgccgcacagagcaaggatcgttgggcatccaccgaaatggcgctgcgttttgagggcgattccgcacagttctcgatcgcccctgcggaaggtgcgacggacgtcattccggcttcccgcgattggacggtcacgttccgtggcatcgctccggaagcgatgcacgccgtccgcgcgaccgtcgacggctctgccgccgctccggaagtcgcgtacgatgcggaaacgctgagcctgaccgtcacgctgcgtgacgtgccgacgagctccgcaatcgccatcgattccgccgacggtcttgccgttgcggacgatccggttgaagccgacgcgttcgccgtgctgaaggatgcgcagatgctgtacatgaccaaggagcacgcataccgcgcgatccgcgagctgggcaaggatgcgctgccggcactgagcacgctggaggatctgcacggcgttggcgcgcagaccaaacaccagtcccacatgccgcagccggtcatccaggccctggccgaagtgctgacccgcaactgacctcatcgcaataattcaaaataaaacgcgtgcgcgtccggatggtttccgcccggacgcacacgcgttttgttttatgtacgaaattacgcaacgcgctactgttcggtggcacatcgccgtttacgactttggctgctcttatcattccagccatcgcaatcggactaacagtggccagtctgcaatggcttcccaaaggattgtatctattgctgatactgggcttcggcatagtggtacaactgcaaataccactgttcgaacatgcactaaaaccctatgtaaataaggtggccgcatagcagcaagcaagtttccaagcttttgagcaaatacaataaagctcaatctttcgggcggtagcagtgctaccgcccatttacgttttcattcgcatttcgtatgaaccgcatgacacttttctctttaaggcatcgaggtggtgacgttttcttggacttcccgaccgggaggagaacccccttatggcgaagtacagcaaggagcagcgcgacagagccatggacctgtacatcagatacgagcgctgcgccgcggacgtggattggctacaatgtattagaccctccgatgagggacgaatgacgtgggattggaggccgacgatggccgacccgaaacatccccgccaccacggcgaggcgttcaaacggcagatcgcgcagtcgtgcgagagcggcaagccatcccgggagatcagggccgggcacgacatcgcgcgatcgaccccgcggcgccgggtccaaggcatccgcgacagcggctccacccgggccgcggacaaccgcacgcccgggcggaacgagccgatcgagccggggaggcgcgaccggcggttggagatggaggtggacgtttcagaacaagcggcgccggtattcgcacgaaggcaggcgtgatacgggccaacgccgcccgctgcccgatatcggcgcgatgcgggataccgggcgttccccgccccacctgttactggatgaccgggcgtcccgggacggagcgtgcggatccgatcgccggcgacgtgcgcgcggtccggcgcgacggccgcgaacgctacggcgccaggaagatcaaggccgccctggaaaggaagggcgtcaccgcgtccaggagacgcatcggcaacatcatgcgcgaacagggcatgcgggcgcgtacgcgcgcggacggtccgaaccgcacaggacgcgggccgacgaggccaggctcgcgaacctgctggaccgcgggttcgacggctacgccccgcacacgcatccggcgggcgatcttacctatgtccgcgtcggcggagactgggcgtacgtgtgtctgctggtcgacctggcggacaggggcatcgtcggccattccgccgggcggaccccaggacgcaagcctggtgctgggcgcgttcgccaccctcggcttcccgctgacggacgtccaggaaacaggggtttgccggccggaagggtccgcaggcccctcttcccgtattctgacgttaggagacaacagcatgcaggcggatcgtgtgagagagacggaacgaatcaacgacgcgttcctcgaggaggtcgtgccattcgcggtgcacggcgccacaatcgtcgacgcgcgtggaatgacgaaaaacggttggctcgtttccgacggacggtcgatagtcgaaacgggatgcgccgaaacggacttcgaaacggcctgccggctggtccacgtcgagcaagatcatattgttaacgctaacggaatggtgatgacgcccggatacgtcgacatccactcgcacggcgcatggggaagctcgttcgatgacggcgagaaggggatcacgaccgcccgagccggacacatggcgcacggaacgacgagacaggtcctgagcctcatcaccaatcccatcgacgtcatctgcggtaacttgaagacggtccacgacatgatgccggaccgcccggatattctgggcgcgcacctcgaaggaccgttcctcgccatgccccggaaaggcgcccatgatcccaattgcctagtcgatcccactccggatctcgtatccagaatgctggacgccgccgatgggtgtctcagacagatcaccatcgcgccggaacttccgcatggaatcgacgcaatccgccgtttcttcctggccggagtggttccggcggtcggccactgcgatgccgactaccagactgccagaaaaggattcgacgccggagccggaatcatgacccatatgttcaatgccatgaacgggctgcaccaccgcgaccccggcccgattccggcggcagtggaggatccgagggtcaccatcgagcttatcaacgacggattccacgtgcaggatcccatggtcaagctcggattcgggcttgcgccccatagaatcgccttcgtcaccgacgccatggccgcgaccgactgtccggacgggcattacctcctcggggctctggatgtagatgtgcgggacggtcatgccagactcgcctccaatggagccatcgccggttctacactgctattggaaaaggccgtgtctcgcgcggtgctggagctcggcatcagtccggtcgacgcggtggaagcggcgacgctgacccctgcgcgggcatttggcttcgaccgtcgaaatgacgtgacaggcttcccgatcggtctgctcgctccgggattcgcggccgacgtgctgctccttgatcaggaaacctggacggtgcgacgcgtctggtgcaacgggcatccggtgagataattgatttcaaggttcaatgacgaacgaaaggaacaatgacaatgaaccaacgtagagaacatcgttggcctcggccgttggagggccggcgggcccgtatctggtacggcggcgactacaatcccgaccagtggcccgaggaggtctgggacgaggacgtgcgcctcatggtcaaggcgggagtgaacctcgtatccgtgggcatcttctcctgggcgaaaatcgaaccccgcgaagacgtgtacgatttcggctggctcgaccgaatcatcgacaatctcggcaaggccggcatcgccgtagatctcgcttccgcgaccgcatccccgccgatgtggctgacccaggcgcatcccgaggtgctgtggaaggactaccgcggtgacgtgtgccagccgggcgcgcgccagcactggcgtcccaccagtcctgtgttctgtgagtacgcattgaagctctgccgggcgatggcggagcattacaaggacaatccctatgtggtcgcttggcacgttggtaacgagtacggatgccacaaccgcttcgactattccgaggacgccgaacgcgcgttccaagactggtgcgaggaacggtacggcacgatcgaagcggtgaacgacgcatggggtactgcgttctgggcccagcatctgaacgatttcagcgaaatcgttccgcctcgattcatcggcgacggcaatttcatgaaccccggcaagctgctcgacttcaaacgcttcagctccgacgcgctgaagtcattctatgtggccgaacgtgacgcattggccgaaatcacaccagaaaagccgttgaccacgaatttcatggtctccgccggcggttccgtactggattacgacgattggggcggcgaggtcgatttcgtgtcaaacgaccattacttcattccgggcgaggcgcatctggacgagctcgcgttctcggcttcgttggtggacggcatctcccgcaaggatccgtggttcctgatggagcattccacctcggccgtgaactggagaccgatcaactatcgcaaggaacccggccagctggtgcgcgattccttggcgcacgtggccatgggagccgatgccgtgtgctacttccagtggcgccaatccaggtccggcgcggagaagttccattccgcgatgctgccgcatgcgggggaggattcccagacgttccgggacgtgtgcgaactgggccgtgatctgggcacgcttgcggatgagggactgctcggcaccaagctggcgaaatccagcgtggccatcgtgttcgattacgagtccgaatgggcgagcgagcacaccgcgaccccgacgcagaacgtccatcatatcgacgagccgctcgcatggttccgcgctctggcggacgtcggcgtgaccgcggacgtcgttccaatccgttcgaactgggacgagtacgatgtcgcgatactgccgagcgtgtacatcctctccgaggagaacacccgtagggtgagggactacgtcgcgaacggcggcaagctcatcgccacgtactatacaggcatcagcgacgaacgggaccatgtgtggctcggcggttacccaggttccatccgggacgtcgtcggtgtgaggatcgaggagttcgcccctatgggatccgattggcccggagttccggaccacctcgatctcgacaacggagccgtcgcacacgacatcgtcgacgtgatcggctcaatcgggaaggacgcgaaggtgctcgcctcgttcaaggatgacccatggaccggcatggacggacgcccggccatcgtgtccaatccatatggcgaagggcgtagcgtctacgtcggagcccggctgggacgtgatggcatcgccagaagcctgccgatgatcctcgagacccttggtgtggaagtcaaagactcctcggatccggacttgcttcgcatcgagcgcgtcgatgagtcgacgggggctcggttcacgtttctgttcaaccggaccaaagaacctgtcagcatgctggtggagggacgcccggtcgtcatgtcactggccgactgtgctggcgcgacggttaccatcaatcccaatggcgtactcgtcgtcaaacaataatggctcattaatgaggcgatatgccatgtgaacgttcacatggcatatcgcctttcttacgacagatggcatcgtcgtttttgatgatatgttcacaatatgttgtgttatatcgtatgacaacacttaagttaagtcaggcatgtcttttgccctaccagcttctctgcgtgtggcattctcctcacctctacagacgtggagaatgccacaaaaggataatatccagtagaccgctaacgataaatatggccgagctgttcttcgttgtcgaataacggttgtgattgttgcttaatgttcggctgtgggattggcggttcgtgctctatggcttttttcttgcgtggctttggttgtttgtcatcatcataacgatcatcactccccagcacgttcgcttctcgtcaatgtatttgtatgcgattgcatggaatttagatgggattccatcgatagtgatagtgcgagaccttttttttggcggttgcctttgccttgatttggccaatgttgccgactgggacgatccaccacgtattatgcatttcggatttcgatttgatgaggcgtgtcattctttcaagattttttaggcgaggattccccgcctaaaaaatcttgaaatcgcaggagatctgcatgtaggtgccaggaaaacgctcatcctcgcgcagatgctatgcgaacagctgattcccacgttcataggactcgtcatggcatattcggcactgttcattctcatcggcacgatgaatccaaccccgtccgactcacttgccattttcctcctggagctgcatgacggtctgccgttgccgtgcgccacggccatgggaacggcgatcgcagtcatactgattcgtgaaaaagacctgttccgcttgttcaagaccagatgaatcggacatataccggtggaacgaatcgccattggaggatcaagttcgtgtgatgtcgtagaccataagtcatcagttaagcgttgtgtgacaattccatacaacgctttcttcatcgccgtacaccctttatggcgaagtcgaaggatagccacgggaagacgaggacacgtgaaccggtccgcataagcaaagcccagaggcaaagcatccgcccatctgtcccatcgaaaccggctagtttgattctgtcgtgtccgccgacgaatcatcggcgcaatgcgcatcgaaacatatcccgtcaggaccttctgctgtgagggacacgaaggtctgacgggatatgccggatccgttaaggttggatccgacggagcaatcgctggcgttcattccggtcgcttcatccgggatacgcctggcgtcctccatcttgcgatgcaccattcgatgcgttttggctccaatcaggaacgaatcgagatctgccctacagacaatttccgtggattgactccacctaatgtgacgacgcacgcgttcgacttcgaaccgatgggaaacgtgcgatgcggacatcgcgcactttcccgatctcgtccggaacccgaaggcgcacagccttcttaagtgaaaatcgctcctgaaatggagccaaaggagttcccctttaaactgccttgaccattatctctcttgattgtttgtaaaactcgtattgtggaagtggcgaaggccatgcttccttgcccgtctccattgcgggagaagatataagatcccgataaggtccttttatagacaaaaaccggttctttcgtcaatcccgaagcgcatccattggaatgccgttgtaggccaagtcaaaacgccggggttgaaaagaaaaaggtgccgcaccattattcccacggaatctggtgcggcaccttttcttttgaaaggaaacaaagaagtctttgcgccttacttgttgatgaccttcttgaacaggtcggaggatgccttggcgagggcgaactggccgaagcccggatccatggaggcgaggttggagttgaggatctggttgaaagtgtcgttctgcatgttcattccttttccgcggcgctttgtcttccgttcgccgctattcttttttctcttgtttcgttatgccttgattgtaggcatgtcatccccgtcgccgcatgtcattccgattgattcttttgtatattcatcggtttgccagaagatttttgaaataacttaccgcaccattaccatcacataaaccaagaaggccccgacatggtcggggccttcttggtgaaaaagggaaggagtggcaagtattagtctttattcggtcagggttttggcctcctcatcgatggcttcgacggtctcggcggtctgagcttcgtcatcgacgatttcgccggaggcaagcttggcttcgagctctttgacaatcttagcatgcatcttctcgtcgatcttgaccttgaacatgaacaccagcaggctgagcacgatcagaataagcggcacatagaaggcgcagatttcgaaggtgtggatgttggagggggtcatatcggccgcggtggcgttgccggtcatgccagcagcgacggcgatgaagccggtgatgccgttggacagcgcgccgccaatcttatcaagcatcggacgtacggacagggtgacggcctcgttgcgcttgccgttcttcagctggccgtattcgatggagtcggtcagggagaggatggcggtcatctggatgagggtgcccgggatgtagaagagcacgagggcgatgaacaccacggtcatgttggtggagaagagacccagcaggatgtaggccacgatcatggaggtcatgccgacgatgtacaggactcggcgtgggatgcgcttgttcaggatcgggtacagcggagccatgatgaggcctgacaccaaggcgatgacgccggtcatggagtaggcggcctggttgtcgagcacgaacttgaacaggaagaggagtacgccggtggtggccacgttggcgatggcgtacagcaggtaggacagggcgacccacaggagctggtcgttctggaacagggccttgaatgcctcgagcgggttgccgttcttctgggccttggcgcgcagtgcgttggtgctttccttggtgccgaacgcgacggtccatgcggtcaggatgccgaggagtccgacgatgatgccgaaggaggtccagccggcctgtccttcgcccttggcaccggtgagcgtccaagtgaagtagctgacgatcgggatgaccacgacggtgatgccgttgtagccgatggagccggtgaaggagccgagggcggtgtaggtggagcgctcgtgggagtcggaggacagcgccgggatcatgccccagtaggagatgtcacgcagggagtagaacacgtcgagcacgacgaaggtgatgacgaacagcacgatgaacagcgtggtgttgacgttcaccaggccgaacatgccgctgaagatcacggcgagcaggacggcggagatcaggccgccgaagaactgccatgggcggaagcgtccccacttggtgttggtgttgtcgatgaggttgcccagcagcgggtcgatgaagatctcggcgatacggatgatcaccacgaggctggtgatgacaccgataagcttggccgcaagcgccttgtcaacgcccgagaacaggcagccggtgacatagacgatgaaatatgtgctcatcgcgttgtagaaggcggcctgaccgaggttgccgcaggcgtaggcgatacgctggccgagcttgcccttcttgcggacgccaccgtccgcggttgtcgtttcgttgctcattttttcttctccttaagattccggagttgaagatcacccattgatcttgcatgtcgagtatacgctctttacaagaaaaagtaaaaaccattagcaaaatatagggtttggcggcgtgttgaattaggtaaaccgtgtaccagcactgtcatatcggtatcaatcagatgcctgatacgttacaacatataccgctgatacgaaggaattaagacgtcaagtaaaaccgatttgctttttttgtaaacaacatttattatctggtaaaggaagttcatcttctctccatcattcacaaagatgtaatgaacgaaagcaggaaaacatggcaaacgaaacccgcatcgaacacgcatccgagacctggctcgccgattcgaccgtattcgaggtcaaccgcgtcccggcgcattccgaccacaaatgctacgcgcacgatccgcagaccaacgaatggtccgatctgaggcagagcctcgacggcgaatggagggtcgaggtcgttcaggcatccgacatcgaattcaacgaggagcccttcgtaagggagaacttcgacgattccgccttcgaacgcatccaggttcccggacacctgcagatggcgggattgatgaacaacaagtacgtgaacattcaatacccgtgggatggccacgagaatccggcggaaccgaatattccggagaacaaccatgtcgccctctaccgtaagaccttcacgatggcgaaccgtctggccgacaccaagaacgccggcggaaccgtctccatcgtgttccacggcatggccaccgcaatctacgtgtgggtcaacggcatgttcgtcggctatggcgaggacggcttcacccccaacgaattcgacatcaccgagatgctgcacgacggcgagaacgtcgttgccgtcgcatgctacgaatactccagcgcctcatggctcgaggaccaggacttctggcgtctgcacggactgttccgctcggtcgagctggccgcgcagccgcatgtgcatatcgagaacatgcagatcgaatccgattgggatccggagtccggcagcgcctctttggacgcggcgctcaccgtgcgcaacgcagccgacgcggccacgatctcggcgacgttgaaggattccgatggtaacgtcgtctgggagaccgcgaactgcgctgaccccgatacctccatctccaccggattgttgaacggcatccgcccgtggagcgcggaggatccggtcctctacgagttcgaggtcacggtcatcgaccatgccggcaacatcgccgaggtcgccgtccagaaggtcggattccgccgcttccgcatcgaggacggcatcatgacgattaatggcaagcgcatcgtattcaagggcgccgaccgccacgagttcgatcccaagcgcggacgcgcgatcaccgagcaggacatgatcgacgatgtggtcttctgcaagaggcacaacctcaacgccatcaggacctcccactatccgaaccaggagcgctggtacgagctgtgcgacgagtacggcatctacctgatcgacgagaccaacctcgaaacccatggcagctggtgcctgcccggtgacgtcctcaccgaggagaccgccgtcccgggaagcaaggcgcattgggagggcgcgtgcgtcgaccgtgtcaacagcatggtgcgccgcgactacaaccatccgagcgtcctgatctggtctctcggcaacgaatcctacacgggcgacgtgttccgcgccatgtacaagcgcgtgcacgacatcgacccgaaccgtcccgtgcactatgagggcgtgacccacaaccgcgactacaacgacgtgaccgacatcgagacccgcatgtatgcgcacgccgacgccatcgaggaatacctgaagaatgatccgcagaagccttacatctcctgcgagtacatgcacgccatgggcaattcgtgcggcaacatggacgaatacaccgcgctcgaacgctatccgaagtaccagggcggcttcatctgggacttcatcgaccaggcgatctacgccacccagcccgatggaaccacgagccttcgctatggcggcgacttcggcgacaggccgagcgactacgagttctccggcaacggcctggtgtttgcggaccgtaagcccacgccgaaggcccaggaggtcaagcagctgtattccaacgtgcatatcgatgtcgccgaggattccgtgaccatcaagaacgataatctgttcacctccactggcgaatacacgttcgtgttgcgtgtccttgcggatggcgaaccggtatggcagtccgaacgccgtttcgacgtgccggccggttcgacggagaagctcgatgtcgactggccgttggatctgtaccgcgacggcgcgtccgaactggtgctggaggtatcccagcgtctcgccaaggcgaccaattgggcggtagccggctatgagctggcattcggccagaccgtcgtcgccggctccaagaaggcctctgctccggtgaagccggtcgacggcatcgtcaccgttggccgttggaacgtcggcgtgcagggatccggccgcgaggtactgctttcccgcacccaaggcggactggtctcctacacgttcaacaatcgagaattcgtgctgcgccgtccggcggtcaccacgttccgcgcgctgaccgacaacgatcgcggcgcaggccacggcttcgaacgcgcccagtggctgggagcaggccgttacgcccgctgcatcggcaacgagatcgaacagatcgacgagaacaccgtcaaggcctcctacacgtacgagctcgccaccccgcagcgcaccaaggtgaccgtcagctacaccgccgacaccaccggacgagtgaatctgcacgtcgaatacccgggcgagccgggcgacctgcccaccatccccgcgttcggcatcgaatggacccttccggtccagtactcgaacctgcgtttcttcggcgctggtccggaggagacctaccaggatcgcaagcatgccaagctcggtgtgtggagcaccgacgcgttcaaggaccacgccccgtatctcatgccgcaggaaaccggcaaccatgaggacgtgcgttgggccgagatcacggacgagaagggccatggccttcgcataagccgcgccgaaggcgccgaaccgttcgcgatgagcctgcagccgtactccagcttcatgcttgaggaagcccagcatcaggacgagctccccgccccgaagcacatgttcctgcgtgtgcttgccgagcagatgggtgtcggaggagatgactcctggatgtccccggtccacccccagtaccatatcccggcggaccagccgatcagcctcgacgtcgatctcgacctgatctgaccggcgcgccccggcggaaaccgggacttggctttcctttcgccatacgcggaaacgtatggcgaaaggacggtgccgtcgtcaagggtggaccttgacatcaaaccggagacggcgccttgaaagggtacggcacgtcttccatgttttccccgtgccgtgccctcgtttccatatcgggaacagggcttgacagactttccttcgaaaacacctcacagatgtaaaagggttcggtcctcgttggcacgtattaagcgtgtcaacgaggaccgaaccctttcttcttaaaccctacctagctttcggggtgaaactgtcccgggcgaccagcttggttgaaatcctcatatgctggttgacggagcgccccatggaaatggcctccgacagcatgaataccgcggccttggccaattcgtccttgttgatgtcatacgacgaaagcgtcggcgaagtgtaattcgcgatctcctggttgttgatgctcaccagtcgcatgtcgcgtggaaccagaatgccggacgccgcgaacgcctgcaagacgcctacggcgatggggtccgccgccacaatcagagcatccgggagcctgtcgccacattcggccacgaacctctctcccaaggcacggccgttctccacggtgaaaggcccctcatcgaacaccaggccgtcgacgtcaagaccgagacggacggtccagttgcggaacgcgaacgcacgcggatcctcgggatactcatggtcgcccatgatgttgccgaaccctccgatgaacccgattcgcttgttgccggcgtccatcaattcgtccaaggcgtccagaatggtctgctccagatccggctgcaccgaatcgaacaggctcggcgcgggattgatgtcgatgaacactccatgcggaaggaccgcgtgcagacgcttcaacatgttccttttgaacggcgccggacctattgagatgaatccggcgtatttggacgcgtccttcatcagggatttgacatcgttgtattccgtcactctcatgcgctcgtccttggcatggcgacgtaatgaaacttcaagctcgtcaaaataggcgtcctgaagccccttgtcgtggatggagttgttcagcaacgcgatgtcttgcggaatggtgacacgttggtagcgggggacgttctcgtaccccatctcaatgctggtgctcagaatcttctgacgggtggcctccttcaccgagaacgaggggtcgtcattgagtattctcgatacggtcgcctgggagaagcccgccttttccgcgatctccctgatcgtggccatggaaacctacctccttggaaattcagcaactaaacgtgtttagtaacgagtttatcatgtttgaaagcgtaattgccatcaatgtcggaaatttcgttttcaatgaaaatggattggctacaatgtattggacagtccgatgaggccattcgtggattcaagctcaatatgctgctgtacgaattgctatcgctgctgtattcgaggttcgtttccggggtacggcggccggaattggtcagatccggaagaaacatcaccatgcagatcatcggatacatgacatcgcaccgcaaacagcatctcgaagcgaccgacgtcgcacgggaatttggatacggcagggaacatttctgccgcctattccgcaaggcgaccggcaaaacgttcaaagaatttctgaccgacctgcgattggacgacgcctgcagaaaactgtcaggttcctctgcgtcgatagccagcatcgcaagggaatgcggtttccccgatacgcgcgcgctgcagacggccgtgcaacgcaaatacggcatacgcgcgcaggaatatcgcgaacgatacgaaaatcgaaactaacgttcaacgagagaaggaggaaatatgactgggcctgcaccaaccatccgtcgtatgaaaattgaggattatccgctggtatacgggttgtggacgcgatgcaccggtttcaccatgagggacatcgacgattccgaggatgcgataaaaacgttcctcaaacgcaatcccgacacctgtttcgtagccgaagacgatggcggaaggattattggagcgattcttgccggtcacgatagcagacggtcgcgcatctaccacacggcggtcgatcccgacgcgcgcggtatgggcattggctcgcttttggtgggccgagtggttgaaacgcttcgtgcgatcggcctgccaaaagtcgccgtcggtgtgcccgcagacaacgatgccggcaacgatttctgggagcatcaggggtttgctgtccgtgacgatttggtctatcgggaactacctctctaatacgacccgtccgacaacgaaccgtccaatacgctcgcactttgtctctataagcccggttccgcacttgcagtccgcaacaaatatgttctgtatatcaaacgtgttcaaagaccatgcagtggaatatcagacggaggaagacccgttcggaacgcttaagagagacgagctgctgtgacgaatggcgatacggcgatgtggtcatcgctgaccttgtcatcgttttctctgaaacatccggcatcctcatctcacacttttatgagcgagtttttgcccttccgtaacatttcatgagggagagccgcccttccatggccacctgtgcaccctatgcaccccttaaaaacggcgccattccgccatgaaatcacccccttcatccgagcatggcattgcgcaccccgtcaaaacatggccgtcatccctggtttcccgatttccacactttttgaaaacccgttttacccgatttccgcacttttccggataccgagcggcactgttccgaccgcgcgactgcatcaaacgccgattccgacgattctacagattaacggtaaaacgtcgcgcggcgacccggccggcttgcggaatggaggtcaggctcgttccgcggcatccttgccggcgagcaggtccttgacccatttctcttcggagagtccgcgctcgaactccttaagacgtccgagcatgtcgtcgagctgtttgttcaaccattcctcgtcaaaatctgcaggcacgagctggaagctcttgcccgcatccggccagatccaatggatatgccaccaattcttaccattcgaccatgtctcaaggcatgggatgcttcggcttattctgtcgtagatttccatccgtttcccgtcaaggccacaggagtcgaagcacagttggcaacgtatttcaggcccgtcatccccgtcttggactttgatctcataaaaatagttgcagcaggttttccaactgctgttcggcccgtcaccatcgggcagaatcagcgacatgagtttggtcctgaatctcgttatgcgcttgccacaatccccctcgtcgaacacaatctcatcgtccttggccttccgcctggcccattctttgcaatgttcgtttatcctggggatcaggtcgtttttgcagttaataatcagatccagcgccctcttgtgtttcttgtagattttcatgcagatacgttcgagttcctcgtctcccaaaatgtccctcctcacggcgtccatgtattccgaaatgaactgagcctgcgccggagccggcccatgagcctcgaccgcctggccgatgatgccgagcacgtccccataccccatggcgagccaatcctcggcatcggaggctttcgacgcgttcctcgcatccggggtgaggaatatgaaccgacgccggtaagccggataagccttctcaacctctccgcagtatctggcaagttggtcgtcatgctcgccggagaagatcttgttctcaatgcaaaggacatagcccgcgtcatagttcaccgcaagaatgtcaatacagtgccattcacgacggatcgagaagccgtcgcagtccataagcagatcgtcgaagaccccgtcgcctcccatccctcgcgcagcgtaatccacgaagccgcggatcacgccgtcgtctaacccatggttctcggcggggtccatgagccaggcgaggacgttgctgtgccggatctcggcgcgtgcaatcccgaggacgtcgaacgcgttgaacccgcgcgtccatttggacagccgatccaggcatccggagtcggcaaggaattcttctagcgccttcctgtcctccttggtggaatcatcttccaaagccatcgccaccctttccggaaaacaatcacagcctgcattccttcatcgggcaggaccgcccaccccgcatccatcttatattcgttcggatggccacccattcatgcgtttcagcgtccagcgttcgaggattttttcgtaccacggcccgtacccgtcgcccgcaacccgtccaaggaaccctatgtgcatgatgtcacgacgtctgacgactccccctgatctccgcgacgcataccacgacgttgtcgggattgaagacgatggcagtgtcgcagcggaccgcgcgccacagacggatgctggcagccggctggcccgcatcgaacgaattcgcacaatcggagacgaacccatttcatacgagcagacctacatcaatcaacggggctatccgtcattcctggagctggattcgaccggcttcatctaccagttgctgcgaacggcctgcagcgccgacatccataccgtcgaggaaaccatcgaagtagtgccgggccatgggccgttgcatccgtcatctaagactgcagaccggagcgccgctgctacgcgtgttctcccgagcgctcgactcggacggtcactcagtggtgctgtcgcagaatacctatccggccaacaaggtgcgtctcacaacatcaaagacgatttgaggaacaacctcatccagcggtctcaatcagctccgtcagccgccagtccagccatgaacagccatttcccaagacggaatgcatcttctggcatgaattcggcaaggaaacgtaagcgtcagacagacgttggcggacgacctataaaagcatggtcatccgccaacgttattcaagaaggaaggtcaggcttgattcacgagaaatcagcccttcgccgccttacgagcagccttcctggccacacgcgcttccttacgggccgcaacgcgcttaatcgtgcccggcatccaacgccacacggagaagaaggcaagcatcgccagaatcacgctacataccgtgttgaacacaatctgtatggtcttcattccattgctgaacttgaagccagcaccaggcaatgcgccgttcatgcagttcgtattcgcgaccgtgtacagcaagtggtgcatggcctgacgtgcgtagtggtaggtcgccgcatcattgaaatcgagtttctctccggtcggatcatcgctcacgttcagcagtttgatgtcggctcccgcctccagcatctggtatgggctcatgaatttgccggtgttggcgttgtcggtgatgatcagaccattgaatccccattcgtcgcgtagcagttgctggatcagtgcatggctgccgccggtccaagtggcgccgatacggttgaacgatgtcatcacacctttggcgatcggagtcttgacgaccttgttctcataggttccatcggacttcttcaccacagtcttcatgtccatatcaccaaggtgcatgcacatgtcgaatggcttcagataaatctcgcggatggcctgttcgttggaccaggttgccacggagaagttgccaggcctgtcaccacggtggttctcctggtcgttaagggcgaagtgcttgatgtagctgtacacgcccttggtggccgcgcctttgacctcgagggaagccatggacccggacatgtagccatcctcggaatagtattcgccgttacgtccggagaatggggtcctgtggatgttcatagctggagcgtaccagccattcgcgccgcccagcagagcctcgttgcccatcatctcgccgaggtcctccgccagttgggcgttccaggtctgggtgagcatcatgatgcttgggaaggtcttgccggtgcctccgtacatccaaccggtggccgaatcagcatcggtttggaacggcttgtccacggatttgatgtagtccacgccgtagccggagaagtagatgagctggttgtaatcgtcctcggtgagctcgtcaaggatcttgtcccattgcgcgtcgtcataagccaatccgcgcatgtcggagaccttcaacccgttcttcttgccgaatgtcggcgtatccatgatggagtccttgtcgacggtggtgccggagtcgtttccttcaagatgtttgatgagtttggtggaagcggtcttcttccacgtgcaggacgcgttattaccgtcggagtccttgcaattaatctcattgccccaggtattgatctcaccggaggattcgccgtaatgcttcgggaaggtaccagtccaatcggaacgggacagataggccacttccggatcggaagccgcatcgaacaggttggagatggccttgccggtggtggagtcggaggcgaatgtagtggtgtccgcatcagtgttctccggtgtccagctggccaccatggtcttgtcaccttccgaagtcatgccgtcggccacggtcttgcctttgtcggcaaggatattgttgaccgcttggttggcgtcggtggccgcggtgaagcgatactgtccagcgtcaaggatgtaggtcttcgcgcccttgtagtcgtatgccttgagctgatccttgccgaaggtgattcgcacggtttcgctggtccccggcttgagttcggaggtcttgccatatccgaccaagttcacggatgccttctcgacggcgttccgcttgtcgtaatcggtgtatggcgactgcgcgtacagttccacaacgtccttgcctgctgtatcgccggtattcgtcacggtcacggtagcgacgaaatcattgccatgccgcgcaacggagaaatctgaccatttgaaatcggtgtagcttaatccgtacccgaacgggtacacgacttccttggcgtaatcgtaatcgcccgcgttgccctgaccgaggaccttgtcctcgtaacgggtctcgtaatacttgtagccgacgtagataccttccgcgtaatccacataattgtatttggtggctttgccgttctcgtcgtaatactggtagctgccgaagttctgcgcggccggtgaggccagcgcatccgcggcgaatgtgtcgacggtcctgccggagggattcacttccccggagaacaccttggcaagggcgttggtgacgttctgcgaatacacgacggccttgatgttcgggtactgcttgagccagtcgagttccatggcagcactggatttgacgagaagaatcacgtccttgtagttgtcattaaggtatttgatgatttcggtttcggtggagtcaagctcgatgtagctcttctccttgtcttcctgcttgtcggcgtggttgtacatggaacgcggcattgtcagtcaatccgatatgaataaactgcaagtttaacggaataaattgtttttaaaacggaatcagaaaaccagatgcgagacttttggatcaacgaagcccagaccatatagccgggagggccgattaagacaaaaacctagagggataaagagttttaaataaaggggcctcctgggggccggaaggcccggccgggagacaggtcccggaggagaggataaaaaaggggcctcccgggagccaaaggctcgaccgggaggcccaacatgtgaagcggcggcgtgctactctcccacaccctctcgagtgcagtaccatcgccgcgcctggccttagctaccgggttcggaatgggaccgggcgtctcaccagggctatgaccaccgcaaaaccgcaatcacggaacgacaaccaaaacatggcggccattccggccattatgttatgaaccgtggcggtctgggaaccggctagcggacgcgaggcaaagcctaccgttgtatcgttcagtgaccatcccaacgcatattgccgtccaggacgatccagcacaggaaagacgcggaaccaatcccgcaaaaggatcggaatgttatgtcgccgtcgcccgttagtaccggtcggctccacccctcacggggcttccacctccggcctatcaaacacgtgttcaacatgcgggctacaacagttcaagaccgtacggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccacgaatgctggcgcacccgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccggacgcaaggtccttcaccccagtgggtctcccttataccgaaggcacgggagtgatttgccgagttccttgaccaggattcgctcgatcgccttggtattctctacctgaccaccagtgtcggtttggggtacgggcggccatagccctcacgccgaggcttttctcgacggcctggacaaccggatatcgaaccataacggctcccatcatcacacctcgccatgcatgccatgcggatttgcctacatgactggctgcgtgcttgaccacggaaaaccacctccgcggccggctcccattccgtgtcacccctgcgctgacctactgcggctacgctcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggccggtttccaccgccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccaggacaagcgactgaaaacgccctattcggactcgctttcgctacgcatacgccacacggcttatgctcgccacccgccactgactcgcagactcatttttcgataggcacgccgtcaccccaccagggaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtaccccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaagaccattgtcccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgatccgaccagccacccaggaccggccaccacgcatgggcatcgaaccgcgccacagaaaacccgtggggtggcggtccgggagcccaaaagcatacccataccactcccggacatcccgacgggacgtccaagcccatgatctcttccacaccagcatccacaacaacgacgccgactgccggcgtccatgtggctcacactgtccaaaaacatggactgtattctccgtagaaaggaggtgatccagccgcaccttccggtacggctaccttgttacgacttagtcccaatcacgagtctcaccttagacggctcccccaaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctccccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatagaatctttcccagaaggacatgcatccaactggagcatccggcattaccacccgtttccaggagctattccggtgtatggggcaggtcggtcacgcattactcacccgttcgccactctcacggccggagcaagctccagccgatcccgttcgacttgcatgtgttaagcacgccgccagcgttcatcctgagccagaatcgaaccctccacaaaaaaacttatgcggaaagccaacacgtgactctcatctaagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccgcaccagcagaccgccccaaactcaaggagccaggccgccgtgctgagcagcaagagataaacttacacgagaacccgcaaacgcgcaacccgacgggcatgacgaagcgtgaaaccgttggaaatccaacgttccatcggcgtgtcgaaaacgagccaaacgcgacctgaaaccgttgatgacaccatcataggacgctaaaaccacggccaggtgaacgcgaaaacaacaacccacggcgtgtcggaatcgcaaagccaaatgcggatgaagcgaagacgcgaacaatgcagccatctgcgctatgaacgcgatatgggatccatagcctgacaaccgcaccaatgcaatatcaggaaatacagcgccaagaaaaagcagcacacggatccgaacgaaggcaatgagatgcaaaagccgggaggctccatgttccacggagactcccggcttggtattcaattattggttttcagttatcagccaatcactcggcctgagcgggctctgcagccggctcaatcgtggcgacggccttcttgcggctcaggtagcgcttgatggtcaggaactccagaccgatcacgagcaccgcaaccacgccccaagccacgtacatggcggtcttccagatcggggtggcgaccttcggctcgccattcgcgtactgccagctgttggcggccgtgtacaggatgttgtgcgcggcctgacgcatggccttcacggaagtggcggacttatcggtgatgtggttggtgatcttggtggtggcaagcatcgaatcgttgcccgcacgcacttcctgatcggcgttctggtagccgtagccgccgaagtagtcggtcaggacgaagcctttgaagccccactcgccgcgcagcacggtctgcagcagcgcgctgtcggcgccggcataggtgttgccgatgtagttgaaggagctcatcacggcctgggcgccgccttccttcacgctcatctcgaacggcttcagatagatctcacgcatggcctgctcgttcgtccacgtgcacagcatttccgtacgcttggtctcctggtcattcagagcgaagtgcttcatgaaggagtacacgcccttggacttggcaccggagatctcgctggatgccatcacgccggagagcagcgaatcctcggagaagtactcgaaggtacggccggagaacgcgttgcggtggatgttcatggccggtgcgtaccagccagccacgtgcatgtcgtgggccatgtcgccgatcatctcaccgaactgcttggcgagatccttgttccaagtgcaggcgaatgccgtggaagccgggaagccgatggagccaacgccggtgaagttgttattcagcgatgccgggccgtccgcatcggtcagctggatcttgccgacggacttcagagcctgggtgccatagccaccattggcgatgaggttgtccatatcgtcgaaggtgagctggtcgagcagcttgtcccaatcggcgtcgtcatagtccttgccgtacatatcggacagcttcagaccgttcttggcaccggtggtcggcatcttgtcggaatccttgtcgaacttcttcggatcgtagttcgagttgttgtagaaggtttccttggccttgtcggacatcttgaagttggtcggggcggcggtggcctccttgtagttcgcgaagtggtcggcgcgggacaggtacgtcacatcgcccgccacatcatcgaactggttcgtggccacggtcttgtcgccattgtgggtgttcgaatcggaatcgtaggtgacggtgtccttcacggtgatcgccttgtgatcgatcacgtggtgcgaatcggactggatggagatgtcataatcgcccttctccagcacgtacgccttcgcgcccttgtagtcgtaggacgccatgtcgtcgtcatcgaacttgacggtgaccttctgggactcgcccggctgcagttccttggtcttctcgaagccggccaggttcttggacgccttctcgatgccgccgtcggtgtacggcgggttgtagtaggcctcgaccacgtccttgccggccttatcgccggtgttggtcacggtggcggtgacggtcaccttgccacccttgtacttcacgctgtcgagcttctgatcgaacgaggtgtaggacaggccatagccgaacgggaacgcgacggtgtcatcataattaatcaggccttcgtccgaagcggtctcatagaacttgtagcccacatagatgccttcggagtagttgacaaagcccggaatggcagtgacgtcgtcacccgtgaagcccttgtacttggctgccttgtctgccatattggtgtattcgaacttgccgaagttgttataggacaccgacttggtcagatccttgaggaaggtgtcggaggtcttgccggacgggttggtctcaccggcaagcacctcaccaagggcggagaaaccggtctggccagccggcgggcaccacacgacggactggatctgcggatagtcgttgaggaaatcgaactggaacgtgttcgcgccgttgtagacgagcgtcaccttcttgaagttgctggtgaccaggtcgatcatgtcacgctcggtcttcgacaactgaaggaagctctcacccttctggaagtcgtcataatccttggagttgttcttgtaggtgatacccttcgccttcatgtccgtcggcaggtccgcgccctcgccgccgacacgggtcagcacgaccacggcctcgtccgagaaatccttcgcgtcggagaccagcttgtcggagtactgcttggccggcacctcgggcagggtccaatcctgagcgaacatgccgacctcaggacgatccttgcggtagtccgtgtacagcttgctcagctccgtattggtcttcaggccagcctgcttcatgccgtcaagcagggagacggtcttgtactgcttcgacatggagccggagccggtgccgccgtagacggggttggtggagccccagccgaacacgttgaccttcttgccggacagcggcaggttggaatcgtcattcttcagcagggtgacggcctccgactgcacatccttggccagctcgttggccttggaaaccgtggcgtcggacagcgtgtacttggtgatggtcgcattgttgagcagcgtggaaagcgggccggtcagcatcatggacacggccacgacgatgcctaccagcgccaccagccaggattcggaatggacgatcttacgggtcgccacgtccttgaccgtcttcttgttgacggcgaaggtgatgatcagcgcgagcacgaatagcacgccgatcgcaatcagatatggtgtcaatgaaccgatgacgttcatgacatcagccatgttgatttgcagcatggtctgcctcctccttgattctcataaccaaacgacacattggctccaatgcctttatcggaaccacgaaaccattcaacactgccccgcatctcatggtttcggtgaagtggctgcagatgcgtgcggcaagtgaagacacttcttcatgtcgatgattcgatttcatcagacttcaacgtgcggcacatggcgtttccccagcctgtcaattcgcgtgcataatctgcacgccaagtacgatggaagtatgagcgacttaagcgcattgaatctggaagcaggcagcctggttggcggctacacgttgatttcccggcttggttcgggtgccatgggctcggtatggcgtgtgcgggacgatggcggccatcaatatgcgatgaagattttgcgtgattccctctccgacgacgattccccgcagcggcagcgcgaccaactgaccgcacgcgagcgcctgcgcagggaggcgatggcgttgcagaaggtgcggcatccgggcgtgtgcggcattgtggatatggaacttgacgacgcgttggcttttattgtgaccgagttgatcgaaggcaagaatctgcgtgaggatgtgcgcgtcaatggccgatatgtgggcgacgatttggaacggctggcacgcaagctgattgaggcggtgcgtgccgtgcatgcgtccggcatcgtgcaccgcgatatcaagccgacgaatgtgatggtgtcgagcaccggcccggtattggtggatttcggcatcgctatgggcgaaggcgaaagccatgtgacgcgtaccggtctggtgatgggcacgccggggttcatcgcgccggaaatcattgatggcgcggaatcggatgaaatgaccgattggtggtcggtggcgagcgtattggcgttcgccgctacgggtgagccggtgttcggcacgaagccgatgatgaccgtgttggaacgtgcggcggcaggcagcgccaatcttgcgggacttcctgcgggcacgatggccgcgttccgttcggcgcttaatccggatcggacgaagcggtgcacgccggacgatttgctgcaggcgatcgccgtggatgcgttgaatccgcaggcgtgggttgcggccgacaatggtggcgcagcggatggcgatacggaggcgatgcccccttttgttgaatcgcccgacaatccgcgcacgttgtggcgattgcaggacgatataaccggcgaaaacgccatcggcacgcgcacgatgccaaggctcagcgaagcaacgcaggcgatcgggcagcccgatgtgagcgcaactcaagtaatcgggaaacaagtgaccagccaatccgacgcgagcgcaacgcaggtgatcgcacctgttgacgatgccgagaccagagtgctttccgacgcacttcccaacgtggacagcacgcgcacgatgccgcaatcgcaaggcacgcgggcgatgccgacaggcacacaggtaatgccgcaatccatgccgtcaacacaaatgctgccggcccagaacgcatggaatccagcggaagcgccgacgcaagtcgacccgaccatcaaacccgcgttgcaacgcatcgccatgcggcagccaccgtccgtcataccgcaggccacggtggccgcggcgcagcaatcgcccgcaatgtcattcccgccggtacccggtatggatgggccgaacgttgcggaagcacccaatcccgccgatgtgaagcgtggcgcgatgttgggccggggcatgctcccctgcgcgctgatggcgattcccgtggccgtctgcggactgttctcactgtggacggcgatggcagccgcgttgctgttcgcctgtgcgctggccaccatcggattcaacacggaggcgcagctcgagcgcgaaggcaaacgtggcggcgagaagaaaagttccgactggctgctgcgattggcgggactgccctggcacatcgtgaagggcttcggcgtcgccatcgtgcggacgctgatcatgttggccgtggccgcgctgggtttgtcgctcaccacggtcgtgctgcagcttccgtatgccgtgatggatatgtggatatttggattgacgattccgatgccgacgctgcttggcggtccgctttccgaaagcgggctggcgcaggctgcgttctgcgcgatcggctggcttgtggccgtggccgctccgggcgcgatcgtactgcgattgggcggcggcgcactgcgtaaacagccgtatctgcgccacttgagcgagctgccgacgcaatcgcaaggcaatacggaattcccggcgaatcgatagcaaggcatcgctagtatggtgcccagcataacaacgtgaggtcgaaaggaatatcgatggcccagaacagcaaggatgcgcagaagcgtaccagccgcgccgagcgtagggccgccgaggccgcggcgatgaaggcgcgcgccgagcagatggaaaaggaacgcaagcagcagacgatcatcggcggcatcgtggtggcggtgctggtgattctggtggcgatcggcgcgttcaccgtgtaccacaacatgcataagaaggccgaaacgaaggcttccaccgaaaccgtgcaggaagcgtacacggcgttgcagaaagtgaagaacactccgaagctcgtcgataagaacggcggcctgctgatttccaagaacggctacggcaaggctgtggagggcgcgccgaccgtcgagctctacatggatttcctgtgcccgggctgcggcaacctgcaccgccagttggacgccgacctgcagaagatggtcgatgcggggcagatcaatctggacctgcatttcatggcgttcatggaccgttggtccaccgacgagtattccagtcgcgcggcgaacgcggccatctacctggccgagcatgacagcgacccgaaccatctgatctccttcctggagaaggtctacgccgaggatttccagccggaggaaggctccgcatacaagtcggtgagcgacgccaagatcaaggagcagatgatcgccgcgggtgtttccaaggatgttgcggacaaggcgtttggccgcgattatcaggaatggcttgatgcgatcgacacttacacgccgaagcgttccgaactgtggcatcagtccggcagctacaagggcagcatgaccacgccgaccgtgatcatcaacggcaagtattgggatatggaccagctgaccaccgcccagacgacggttaaggacggtctgttggaatcgatcggcctgaaggacagcgaagtcggcgttgccggcaagatgccgtccatcggagccaagaaggggccgatttccgtcaccacgggcgaataaccccttacgggcagccggcgcgtctcaacccgcaatactaagttgacggcggtggaagcgctggttatgctattcatcgttcctctgttgttttcatagcaaaagaggacatgcctccttagctcagatggccagagcggccgccttgtaagcggcaggtcgtcggttcgatcccgacaggaggctcgaacccgtatgacgggcttggacctcttaccatgggtaagtgctccagaagtcttcccccaacttgagacttctggcaaagcggacgagacgtcccccaacctatctcgtccgaccgggggcaggacatccccttctctcctgccccctttttatttttcgcttttcgcacctgctttcaaaaatgtggcggtatggataaaaccatcggaaagcacggcaaccgttccagctgagccgttacaataacggcgttgtaggcagcgctgaaaagaggataaatgacgagaaggtggacccctcggagattcgtgacgcttcgtcgtgtccgcgtcatggcatgcgtggcctcattgactttgacttcggcgttggcgtttggtgtgggcgcgcgcaaatccgtggcattgaccgtcaatggggagaccaccacggtgaccacatatgcgatgagcgtggaccgtctgctgcaggagcagggcgtgaaagtcaaaacgcacgacctggtggagtcgaccagcccgaccagcatgctgaagaaccatgatgtggtgaacgtgcagagcgcataccagaccaccatcaccatcgacggccaggaagtgccgttctggacggtcgcgtccagcgccgagcagttgctggacttcttcaaccaaaacgaaaccgaagcggcgaaaatcaccgtcaatatcagcaacgtctacaacaagctcaccggcggtctcatcatcaaccagaaggggcccgtcaccgtcatcgcggacggcaaaagctcggtggcgccgaacggcaagctgcccgccgcctccattcttgacgccaaaggcatcacgttgggcaaggaggatcgcgtcagcgtcgaaaaggacggcaaaaagaccattctgcgcgtccgccgcgtgacccacggcgaggaaacacgtacgaaggaagtgccgttcggcacgcagaccatcatcgacccgaacctgcagccgggcgaagtcacgatacggcaggaaggcgaaaacggcgaaatccagcagacgtacgccgtcacctacgtggatggcgtgaaggaaagcgagacgctgaccgaagagaagaccacgaaaatcgccatcgacaaagtcattgcggtcggaccggaaaaaactacggacgataccgacaaatccgacaacagcggcaacggcaatggcgataacggcgattccggcaagacggacgacggcaagaacgattcgggtaagaacgactcgaataaaaacgacaataagtccgattcgaacaagtccgattccgacaaaaccgattcgaacaagtcggattcctcggataagaacaattcgaacaacaactcgaataacaattccaacaacaccaagaaggacgatccggcaccgacccccacaccaacccctgcaccgcagccgactcccgcaccccagcccaaaccgcagcccacgccgcagccgagcaatccttccgcaggctgccgcttgtaccatccttccgcggcacaggcacaggcctacgcttccggcgcggcggcgcagcgcggctggaccggccagaactggacggatctggtcaaactctggaatcgcgaatccggatggagctggagcgcggaaaacgtgtattcgggcgcatacggtattccacaagcgttgccgggcagccaaatggccacgttcggcgcgaattggaaggacgatgccgccgtgcagatcgactggggtctgagctatatcgcacagcggtacggcagcccgtccgcggcgtggcagcactccgaacagaccggatggtactgatccggctaatcgccaacgattttcgtaccggcatgaacggataatgagggaatgacagaaaacgtgaacgagcatacgcagggccatttgctgggggcggccgacatccgacgcatcgccgccgacgcgggtatcagcccgacgaagaaattcgggcagaatttcgtgattgatccgggaaccgtgcgtcgcatcgtgcgcgaggccggcgtgaccgccgacgaccatgtgctggaagtcggtcccggactgggttcgctgacgctggcgattctggaaaccggcgccacgatgacggctgtggaaatcgacccgccggtcgccgaacgcctgccgaaaaccatcgccgaattcatgccggacgccgtggaccgcttccgtgtggtcaaccgcgacgcacttaccgtcaatccggagaatctgcccgatttcaaggatgacgattccttcacgctggtggccaatctgccgtacaacgtggccacgccgattctgctcaccctgttggaacgtttcgacaatctgggcaccttcctggtgatggtgcagaaggaagtggcggaccgtttgagcgagaagcccggttcgaagatctacggcacgccgagcgtgaagctcgcatggtacggcaccgcggaacgcgtgggcgtcatcggccgcaacgtgttctggccggccccgaacgtcgattccgcgctggtgctgttcaagcgctacccgggcggtcacacccccgccgcggacaatgcggacggttccgtggtggatcgcgaaaccgtgttccgtttgatcgacgcggctttcgggcagcgccgcaagaccctgcacgccgcattgaagaaaatcgtgccgtccgaagcgttcgagaaggccggcatcgacccgacccgtcgtggcgagacgctcaccatcgacgaattcgtggcgttggcacgcgcgttggatgaggtgttcgcgtcatgagcaccattgattcgcccgccatcggaacggccaccatcaacgccgtgagcgtggactgcccggcgaaaacgaatctgaccctgcatgtgggcccgtcgcatgccgaatggggcggccgtcatgaactcgacaccatctattgcgcggtcggcgtatacgacaccgtcaccgccacgcgcaaagcgccgggaagcggcttctcgctgaatctcgagggcgcgtatctgggcgacctggcctcttccggcagcgatatgcgccgcaaccacgccgtgctggcattgttcgccatggccgaagcgagcagccatgagccggacgtggcgttgaacatcgacaagcgcatccccgtcggcgcgggcatggccggcggttccgccgatgcggcggcgacgattctggcattgaacacgttgtgggatctcgattggccgatcgaacgcctgcaggaagtcgcggccacgctgggcgcggacatgccgttctgtctgaccggcggttacgcgcgcggcaccggtttcggcgaacgcatcgaacagcttgatgacgatggcgatatcgtacgcgatcttacggaacgtgggtttaccggccatctgctggtcggcgcataccgtgcggaactgcgcacgccggaagtgtatgccacattcgatcagatcggtgccggcgatggcgatgagaaccacctgcagaaggcggcggtctccctgcatccgcgtagcggacaggcgatcgaggaagccttgcgtgcgggagccagccaggcgttcgtctccggttccggcccgtccgtcatcgcgttcgtgccgacggaggatgcggcggacgccgtgcagcgggcatggcaggacagccgttgcgtcgatcgcatcatcgccacgaacgccccagcccgaccgattgtgcatatcaccgcatgacacatatcaccgcatgacagtaaagttgatggcaattggtttgttcaaaaggaattcgtaaatgacccaggctaacgacgagcgcgccgcgcgcaaagagtacattcgccgccgtcagaagacggtgttcagcatcgtcggagccgtcatggtggtcgccatggtggtgtccctgctgttctttttccatgtcggaggcctgggcaacgtcaagtcggccgccgtacagccgaactacggccagcaggcaccgtgccccatcaaggaagccgacggcaacaaggccaagtatgtggagaatcgcaacatcacgctgcgtgtgctcaacggcacgaagttctccggcttcgccaaggcggtgagcgacgcgttgcagaaccgcgagttcaacccccagacgccgggcaactacaccaagaaggtggatcgcacgatgatcgtcttcggcaagaacggcgtgaatcaggcgtacaccgtggcaagcaatttcaccgatgccatgctggttatggacgaccgtcaggaccagctgatcgacgtcatcgtgggcgccacgttcgacaatctgcaggatacgaagaaggttcccgccgcaggcaaggcgatcaccggcatccagggctgcgtcgcggtggacaagatgaccgacctgcccaaggcgcccgagcatgatgcggtgaatccgcaaagctgaccgccaatcgaaatcgatataggcaatatgaaaaacccgcgctcccccaatcgggaacgcgggttttcgtattcgagctgttccatgcatgcggcgaaaccaccgcatgtcaatcgctattcgccctgctccttgtaccagcgttccagctcggcaacggccacgtcacgctccaccggaccgttatcgaggcggtattccagcatgtgcttgtacgccttgccgaccatcgggcctggttcgatgcttagcagctgcatgatctcgtcgccgttgaggtcaggacggatcgcgtcgaagtcttccttttctttcaggtcgcgtacacgctgttccatctcgtccatggccgccgagaacatcatggccttgcgcttgttctgtgtggtcgtgtcggcgcgcgtaaggcggttcagacgctcgtacagcgggccagcgtccttgacgtagcggcggaccgcggaatccgtccacggctcctccacgtagccgtggaagcgcagatgcaggttgaccagctcgctgacgtcctcgaccatgtggtggtcgaaatgcagtgccttcaaacgcttgcgcgtcatcttcgcgccgacggcgtcatgacggtggaagctcaccttgccgcccgcttcgaaacgacgggtcttcggcttgccgatgtcgtgcagcagagccgccagacgcagcgtcaggtccggggccggcaccggaccgtcggaaccggtttcgagggcgacggcgcgttcgatgacgatcatggtgtgttcgaacacgtccttatggcgatggtgctcgtcgatttccagctgcagcgcgggaatttccggcagcacgatgtcggcaagaccggaatcgaccaacgcttcgatgccggcgcgcgggcgatcggacagcagcagcttgaccagttcgtcgcgcacacgttcggcggagacgatttcgatgcgatcgaccatgtcggacagcgcttcggcggtttccggctcgatgcggaagccgagctgcgccacgaaacgcacggcgcgcatcatgcgcaacggatcgtcgtcgaacgactgccgcggatcgacgggggtacgcagcacgcctttggccaaatcgttcgcaccgccgaacggatcgacgaattcgagttccggaacacgcaacgccatcgcgttgacggtgaaatcgcggcgggaaagatcgccttccagcgtgtcgccgtaattgacttccggcttgcgcgagtcggggtcgtacgtgtcggaacggtaggtggtcacctccactttcacctcggtgccgtcctcacgcctgcgcatcgcgccgagcgtgccgaatttgcggcccatatcccagaagccatcatgcccaaaacggcgcagaatatgctcaaactgctcgggacgcgccgatgtgcagaaatccaaatcatgcgatttgcgatgcagcagcaggtcgcggacaggacccccgaccagtgccagttcgtagccttccgcagcaaacatacgtcctaattcaatggcctctggccacacttcgaagttcacgccatacctttcagcaccacaagttttccgtttaccagcataccgttaccccacctgcacacagaattgagtatggttggaatcatgattacgcccgcagaccttgcacgcatgcttgcccatgctgcggacgaccatgcccaaaatccgctggaaccggacgaactgctgtacacatcgcagtcggtttcgctgcagcagctgcaacaactacagcaattgcagcagcgcacgatcatcacgccgagcgcgcctacgccggcgatgatgccgcgccggcgcaccgcggatggtccgaccacgttcgcatcgcttgacgcgcaggagctgccggtggtgcgcgagtattcggcgggcgggctggtgttcgacgacaagggtcgcgtggcgatcatcgcacgtcattcacgcagcgggcatttggaatggtgcctgccgaagggacatatcgaaaaaggcgaaacgccgcagcagacggccgtgcgcgaagtgcatgaggaaaccggcattctgggcgaggtggtcgattccatcgccaccatcgactattggttcaccggtaccagccaacgcgtgcacaagctggtgcaccacttcgcgttgcggcagatcggcggcgagctgaccgtcgaaggcgatcccgaccatgaggccgaagacgccatttgggtggattttgctgatttggacgatgtgctgagctatccgaacgaacggaagatagcatggttgtacgcaaggaaactcaacagacaggcgtaatagtgaatcaatccgcacaacggcacgtttcgcgtggccttcgcgcgttatcatccatcctcgccatggtattgaccatggcgttgatgttgttatacgcacccacgccatcggcaagggccatggaatcgaccacatcggcggagtcgacggacggtatgttgtccatcaactcttccacggccgtattgacggacacctccggataccatctgaacgccacggtgaccaacacgaccggacaggagattcccgcgggaacgctgacgctggccatgaacgccttctacacgttcgtttcgcgcaacgacatccaggattggtctgaaggcaacgggcgaatccccaccccgcaatccgtgggacaggccgatgtgcccgcgttgcagccgggagccagcgccaacgtgagcatcgacgcggacgcccatcaggaatcgctcgcggccatcaactcttgggggccgaagccggtgctgctgagctattccgccaacggaaccccccttgctcaatcgcatacgttcgtgacgcgcaccggcgcgggactccacacgcccagcacgccggcgctgcacatcaccgtcgcccagccgctggccgccaacgggtggaccaccgacagcaagctgcttggacagctggtcgatgaagggggtatttcctcctcgaaactggcgaaaatcgccatgcccagcaaggatgacgacgcacggctcaaatcgttgcagcagaccttcgccaagcacgacatgctgcaggtcgtaggagatccgacctacctgcaggcgatggcgatgccaacgcgggtcgacggcatcacccagcccgcattgttcgacatgaccgcctacagcgccatgaacaacgctccggcctacagcgcagccggtatcaacgaccgtcaatggtccgcagccaaagcccggaaaacctatcaatcggcattgggtgacagcaacgcggacatcaccgcatacgcgtggcagggcaacggcaattggaccctacaagcgttgacgaaggcccgccagcaggggtacggcaccgtcatcgccacgcatgacttcgaagaggacgatgcggataccgtacgtaccggcaagacggtggtctccaccgatgtcggggacatcaccgtgctttccgcgcagaatgtgctttccggcctggcccaaggcaaggcgaccagtgacgatgccaacgccgacagcgagggaaccacggccggcagattggcgcgattcgtcgcgcaaagcgcgttctaccagatggaacagccttatgcggaacgcaacctgctggtctgtctgaacgaggattccgaccccagtgttgtggacgcgctgatgagcgacatcgagcagtcgccgtggctgaacctcaccgatctcgccacgttgaaggatgccgacatctccgaagatgcggccagcatgtcaaccgaccttccccaaacggacggccttaccgatagcatgcgcagcgacgtccagcagactctgagcgcgctggcgaactcatcgagcaacatcaaacgtttcaatacgtcgatcctcgtcaagccgaacggaaaagacgaatccgacgtcaacacctggagcaggcagctgacgaacgcccacaccatcatggccctgcacgcgttgggcggcgaaagcccttccagaagcacgatggcggaaggcgcgaaccagctcgcggccctgctgatcaacggtgtggcgatcacgccgacggaaagcgtgaatgtggtcagcgaaaccgcgaaaatgccggtgaccatcagcaacagccacccgtacccggtgaaggtgaaggtctcgtcgctgaccgattccatgcagatcgtcacgtcccgattcgacaccgtgcaggtgccgccccacggcgaggcacaggtggcgttcaccatccgtgtgtccacgtccggcaccgccaacgccaccatcagcctgttcgacaggaatggtgcagcgtttggagccacgcaggtcacccacatcaccagcgcgctgcagatcagcgacaagagcggtttcgtcatcatcggcttcgccgtgctcttgggcgctgtgggactgtggcgtcaattcaaccgtaagaaggatcccgacgaatgagttcttccgttggccgtaactcactgatcatggcctccggtaccgccgcttcgcgcgtgaccggccaaatccgcaccatcctgcttgcctgggccttgggcaccaccggctatgccgccaacgcctaccaggccggttcgatgattccgcaggtcatctacacgctggtttccggcggcatcttcaacgcggtgcttgtgccgcagatcgtgcgcacgctgaaatcgaaggacgccgaaaccaagctcaacaagctcatcacccttgccatcaccctgttgttgggtgtgacgctgctcatggccgttgccacgccgttgttgaccaaactgtatgtcaacggcagcgccgaaaccatggccctcgccacctccttcaccttgtggtgcatgccccagatcttcttctacggcctgtatacggtgatcgggcagattctcgcggcgaaggaccatttcgtcacgtatgcgtggagctcggtcggcgcgaacatcatcagctgcatcggtttcggcgcgttcatcgcgatgttcggcagggccacggaacgtccgctggacttctggacgccgacgaaaatcgcgctgaccgccggcacttggacgcttggcgtggcgttccaggcgctggtgctgttcattcctttgacgagaatcggcctgaaataccgtccgaaattcggcgttcacggcatcggactgcgttcgatgggaccggtcgccgcgtggagcctcggcatcgtcggcgtcgatcagatcgtcaacatcatcgtcacccgcgtggccaccagcgcgccgttcaaggcttcggaacagctgcatatgagccagttggacgtggccggcaacgcctcgtatcagaatgcgtacaccatctacatgctgccgtattcgctgatcgccgtgtccatcgccactgcgatcttcccgaaaatatcgaaagccatcgcggaccgcaatatcgacgaggcgcgcaaggatctgagctcggccctgcgtaatctcaatctcatcatgtgcttcttcgcagcggcgttcatcgtgcttccgttgccgatcatcctcgcactgctgccgtccatcagcgtgcgtgaggcgctgctcatcagcacgccgctcgccgctttgggcatcggcctgccgctttccagctcgtatctggtcatccaacgcacgttctacgcgttcgaagacggcaagcatccgtttattttcatggcgatcaccatgaccatccagggtggcgtcatcatcgcgtcgacgttcattctgccgcccacgcagtggatcaccgtcatcggattggcgatttcggtgagcttcatcctgccgtatccgctgcttacgcacatgctccgctcccgtttcgacggcgatgtggacgacaagcgcatcatcaccgcctatgcgaaggcgctggtggccacgatagccgcctgcgtgattggcctgctgtgccgcaacggcgtctaccggctggtcggagcgcatatcggccccgacgacggcactatgaactggggtcaggcggttctgtccgcgatactgctcaccatcgtcatcgccatcgtctatctggcgtgcctgtgggcgctgcgtgccgaggagctcacttcggtcgtgggcatgctcgccgcccgcataccagggcttggcaacaagcctaagtctggcggaacggccagccccaacggtaaacttgagcaaagtaccgccgaaaacggcgaccaagaataacagcgtaggtagaacaatcgttacagagttgaaggaaaccatgaaacctcaactgggagataccatcagcaaccgctatgtgctggtttcgccattgcgcgaggaaaccggcttgcaggtttggaaggcaagcgatcacgtgcttgcccgggattgccagctttttatcgtcaacaaccgcaaggctttgcaggacgtcaatgcgacggcctccatgctggcgatttcccacgacgcccatttcacgcaggtgctgcagcttcagcacgtgggcgaggtggcgttggtgatcacgcagctcgatgccggcatgtcgttgagcgagtatctcacgcagtccagcaagccgctgagcttcaccgcgatccgttccattcttggtgaggtcgtcgaagccctgcacgtgttgcagaaagacaatctcacgcatttctcgatcagcacggacaccgtgcgattgacccgcaacggcattgaaatcgccgacgcgccggtaagcatcatgctggccgatacttcgcgcgtgcaatccgtggaaaaccaggagcagcttgcgattcgccaggtcgcttccctgctgtattccctgctgacgcgcacgccgtcgacgctgtccacgaactaccatcttgacgcgatttcaccgaacgtgccgatggagttccgcgtgatttgcaagcgtggtctggatctcaaggagaaggacggtttcccgaccgttccgatggccaccatcgccgaattggaggcgttgctgggcgactacgagccgctggtgaagcttaacggccccgatattgcgttaccgtccgcggattcggaatgctcgattgtgaacgtgcccctgctgcagattctcgagcaggatgccatcgccttgcccgatacgctggctgaaaccggaagcattccggaaatgacgttcgaagcgcctgaaccacacactgatttctccgacagcaaggaagccttggccaagggtatggccgcgaccggcggtgccgtgaaatcgctgtggaacaacagccgcgaactactcagcgaagaggacctcgacggatcctccgaagatgtggattcgccgttctccttccccatccgtgtttccacgccgtcgccgcagggcgattatcatacggacgattcgcaattggagaagaccggtcgcattccggtgatcggacctgacggacgggtcatcgagccgggcgaggaatccgcacgcgcgttgaaggcggagcaggaagcgatcgacgcggcatatcagaacgaaaacggagcccccgttgcggtgccgccgagctttgcccctaaagcctcttcctccagtccggccgaggtcgccaatgccaaattgttcggcaagctcaccaccaaggtcgtggccattgtggtcgcgttcattgtggtggccgtcgcattgggattcgccattcatggtttgaccaagaagcccgatgacggcatcaccaatacgaattccaacaatccgtggccggaaatgaaccttgacgacgtgcctttcggcaataatggcgattccggcaatggcagcagctccgccagcgatgcaaacaacgattccaacgatgccaacagctccgacaacggcagctccgattccagcaagccgaagaaaaccacgaagaagagccattccgccaagaaggacgtcgacaaggtggtgacttcggataagaaggtgcggaaggttccggaaccgaagatgccagagaacacgactccgtatgagatcgacaaccgccagttcctgtccaatccggacggacaacagggttacggttattacctccacctcagccagccccagaaagcgtatcgcatggtcatcaagatccgttcttccggtggccagggctacattcgcgtgaacgccaagtccagcccgaaccagggtgaacaggtcgcccagttcgagttcgacgccagcggcaccaccgaaatcaagttcaacaaggccgtggagacccaggacatcctcttgtgggtgccgttcgacagccttcccggcaaccagctgtacatcgattcggtgcagattttctgacgcatcggcagacaaggagggtgtgcggattgttccgcacaccctctttttgtttcacgtgaaacaacgtgacggatagctgacttttttgaacgcctttttgaacgcttttttgaacgccatctgcaaaaccgcccgcaaccgtcgtggaaactgcattacagtagcaaccatgagtgatatgcgtgatgtggtgattatcggttccggcccggctggctatactgccgcgatctatcttggccgcgccggcttcgagccgctggtcgtcgccggcgcgctgacgcccggcggccagttggtcaacaccaccgaagtggagaatttcccaggctttcccgatggcatcatgggtccggatctgatggacaatatgcgcaagcaggcggaacggttcggcacgcatatcgtttgggacgatgttgtttcggttgcttcgaatgccgattccggcatcaaaaccgtcacccttgacgacggcgacgtgtacgacgcacgcgcgctggtcatcgcaacaggctcaaactatcgtaagctgggcgtgccaggcgagacggaatacgcaggcaaaggtgtatcctactgcgccacctgcgatggtttcttcttccgcaacaagccgattgtggtggtcggcggcggcgacagcgctttcgaagaagctgatttcctgtcccgtttcggctcgtccgtcacccttattcataggcgttccacgttccgtgcttcccgcatcatggtggagcgtgcgcaacgcaatccgaaaatcgatttcatgcttgacgctgtggtgcaggagattcgcggcgacgagaacggcgtgcagaaggtggaggtgcgcaacaccgccaccgaaaagacctctgtaatccccgctaacggcgttttcatggcgattgggcacactcctgccactgcttttcttaacgggcttgtagacgtcgattcagccggttatatcacggtcgatggcgccagcacgcgtaccagcgaacccggcgttttcgccgcgggagactgcatggatagcgtctatcggcaggccatcagcgcggcgggcatggggtgccgcgccgcgctggatgcgcaggcttatctcgattcgctcaagtaaggctcaaatcgttcaaatcattatcgctcgccgagctcgattggctcggttcgttcagctctgctgctgcataagcaggtcgacgatgcgttccatatcgtcttccgatttgaacacgatttcgattcgcccgtgcttcttcgatcccttgatggagaccttggtgccgaaacgctgctccagaccaacctgaacgggggtaccagcccacggattgagcttgctggccttcggcttcttgggctggtcgctttcggcggccttcatcgacacgatttcctcggtgctgcgtacggacaacccctcggcgatgatgcgcgtggccagctgttccatatccgcttccgtcggcagtcccagcagcgcacgcgcgtggcccgcggacagcagtccggatgcgaccttcttctgcacggcggccggcaggttgagcaatcgcaaggtgttggcgatttgcggacgggatttcgacaccgacttggacagttgggcctgcgtcaggccgaaatcgtcgatcatttgctggtaggcagccgcctcttccagtggattcagcgcgacgcgatgcaggttttccagcagtgcgtcacgtagcatatcgtcatcggcggtggttttgacgatggccggaatcgttttcaggccggcgatctgcgatgcgcgccaacgacgttcgcccatgatgagctcgtacatgctatccatgcgcccgtcgaacatgttgtgcggttcggccggtttggctgtggcttccctgcgggcggcttcgatttgcgattgcggacgcttgcgtacgacgattggctgcagtacgccgacttccttgatggattcggctagctcgcgcaggtcgtcttcatcgaaaatggtacgtggctgatgcagattgggaccgacgtcgctcaaacgcagttcaaccagatatccaccctgcacgggaagcagttccggttcatccttcttatgttcggtcggcgtggtttcacgtgaaacactcccctgctgctcgccctgttcggaagctggctgagcggtggagccgaagaacatgtccgcgggatgcgcgctttcgttcaacgaaatcgacggcatgctggcacgacgatgctggtttttcttggttgtttcacgtgaaacagcatgcttcatcccctgcacggcgttcaccgatgcctgtgcggtagcggacgcgctcttggattccacatgctcatcagtcttggaagccttgacttctttggcggcagcggcaggcgccgcatgctcctgatgctgcggctcccccggaagagaaggaaacagtgcgccaagacctttacccaaacgcgacttagttgccatgatcagttctcattccttcttgcatcgattgcctgcagcaccgtatcggaacgacgcgaaagttccagcgcggcttcgcagtacgcgatcgcacccatgcccttggggtcgtatgcgatcacgctttggttgaagcttggcgcttcggaaatcttcaccgtgcgcggaatggtggtgtcgagcacgattgtcggatagtgcttcttcacttccccatgcacttcgcggctcagcagcgtgcgcttgtcgtacatggtgatgagcatcgtggagaccagcagcgacggattgtaatgttcctgcaccagtccgatggtgttgatgagctggcccaaaccttccaaggcgtaatactcggcctgaatcggaatcagcatttcgtgcacggcgcacatggcgttgatcaccagcagacccaggctcggcgggcagtcgatgatcacgtaatcgtaatgctcttcgctggtggcgaggaactcgtccaccgcgttcttcagcagcgagttgcgatccgccatgtcggcgacctcaagttcggcgccactcaaatcgatggatgcggggaccacgtcgaggttgtcgaaatcagggcacgtgcacttgacttccgcgatgcgcttgcgtccttcgatgacgtcatacaccgaaggctgaccggaggcgtgcggggcacccaatgccgtggaggcgttgccctgcggatccatatcaataagcaggaccttgcatccgaaacgggccaaggccgcggacaggttcaccgcggatgtggttttgccgacgccacctttctggttggcgactgcgatcaggcgcgtttgggccggcttcgggcagaccgcatgctccaatgccttgtatcgcgtcgattcatcagcgatttgcgcgcctacgggggatgtcgagccttcgaagattcgcttgatggtttccgtggcggattccatcgacgtcaaattgtctggttcttcaggtccagtcatgaactagccttcctatacatattcaacaatcaagtttcatcatttgggtggacagattttcacctgttcacggccatgtgcaccattgtgaacaacggtggatagttggtggataactcatccgaccacccaaaagttatccacagaacaatcgttgcaattccaagcttcttcaagatgcttcgtaacacatttccgcgattgtggatactgtggataactcacgcgattttgtggataacttatcgctcgtccaccatcagcacatgcgtcggttccagacccggaccgacctcggcctccaccacgcggggatggataccgccgtttttggagatctctttggtggccttgacgatttcctcctgcgcggatcgtcctttcagggcaaccagccgtccgcctttgtccagcaacggcagcgtccatccggatagtttggtcatcggcgcgaccgcacggcaggtcaccacggcaaacggatgcctgaccgggatgggatttccgtcgagatcgacggcatcctctcccctgcccttccggccaccgttcgaaccgcggacggcttcgattacggcgttggctcgggagcgcactatcgagacattgtccaatcccatttcgtcaacgcactcatgaagccattcgatacggcgttccatcggttccaccaaagtgaactggtggtccggcaggcaggcggccgccacgataccggggaatcctccaccactgccgatatccgccaccgtcttgaattgcctcttggccgttgcttcacggatgaacggtacgatggccgcggagttcagaatatgccgttcccaaataataccgacatcgcgtggccctatcagcccgcgcggctctccttccgcagcaagtttcacgtgaaacaccttcaacttgcccaatgcatcgccaagcacttcctcaagaatcggcgacccatccaattcgtcattcacatcactcatgcacaccatcctaatctacaggcatcaaaaagcgccgcgagaaactcgcgacgcttcatgtttcacgtgaaactatttcaggcttcgtcgatctcgtcggcgtcatcggctgcggaagccttgacgtacaccgtgacgtaacgatgcggttcttcgccatgggaccgagacttcatgccttcctcgcgcaccacatcatggatgatcttgcgttcgaaggagttcatcggcttcaggtccaccggctcgccagtctcgcgcgcctcgtcgatggcatccagcgcaaggtcgtgcaggcgctggcgcttgcgcttcagatagccgtccacgtccacgatgaggtgggaccgctcgccggtcttctgttgtacggcgagtcgggtgagctgctgcagggcgtccacgacttcgccgttgcgtccgatcagatgtttgatgtcggtgtcgtcgtcggcaacgatctgcacggtcggacggttgttgcgcacgcccatttcgatatcgccctcgtagtcgacgatgtcaagcaatccttcaaggtaatcggcagcgatgtcagcttcgtcattgagctgatcgatggttttctcagcatcctgcgccatggtgttttactcctttgagcggggttcgtattatttcaagtctactgaaagtctactgaaagtctactgattgggttgtatcatatgggcgattcgcccgatacaaaagcggtgtgtcctgcgtttcacgtgaaacacaggacacacacttgatgttatttcttcttcttctttttgcggcttggctgctgacgctggaagccgttcttttccttcgcctccgcggccttcttggctttctgcagctcctcctcttcgagggacggcagaccggccttggcgcggcgggcgttctcgtgggcgtggtcgcgcttttccttcgcttcggcggccggggatcccggagtcgggaagacgtggatctgccagacggaacgcagcaggttgcagatgttgttggtcaaccagtacaccagcactgcgaacggcatggcgacgccggagaagatgtacatgatcgggaacatccacagcatcatcttctgcatcatttcagtctgcttgttcgcagcgctctgggccatgttgcgcttcatgctgttgtactgcatgagccacaggcagaagcacatcaacgccacgaagatgccgatgatgatcttgccgtggatgtcggcggtggtgaagttctcggccacgttcacgccgaacacgttggtggaggtgaactgcttggcggtggcgatgtcgaaggcgccgaggccggaaccgttcctgaacttgccacgggcgatgtatggaatggccgacagggtgtagaacatgcacatgaacacaggaccctgcacgaacataggcagcatcgacgtgcagccgcccatcgggttcgcgtcgttgtcctggtagagcttcatcatctcgcgttgcaaagcctctttgctggcgggatcgttcttgcctttgtacttgttttggatgcgctgcatcttgggctgcaaaacggccatctgggcctgcatcttgcgcatgcccttcatggacttgtagaacagcgggaacacgcacgcctggaccacaatcaccaggaacacgatggacatgacccacgagaaaccgatctcgttcatgcccagcatcaccatgaatcggtggaatccggccataatctgcgtcatgagccactcgacggggtacaggagcttgtacagccagccccagaaaccactatcgaggaggaattgatcttgattcattacaggccattctccttatcgcctataggttcatctacatccagaggcgtgagacgaggctcctcatgtgccttcgaccacgaacatctgtaaaacaaggaatagagctgtggaacgtcgtcgattcctccacggttccactggttgcaacgaagaaggcgtaataacgcaagaaggccacctttaaggcagccaaatcgttcaatcgcctgaatcgcataactggagcagctgggataataccggcaccgaggtgcggtatgggcggaaatatgtttctgataccagcggatgagccgcaccatccaattgcgatgatgccccttgctcattgtcgggaagcggttttacgtttcaccgcttcgaaacacgatgccatctgctgctcaagcgacaggaaatcggcacgtgcggcacttggcttggcacgcaacacgatatcgcaggattcaggtaatagtgattcgtactttcgtgcaagcacacggaaacgccttttcacggcgttgcgcgtgaccgcgttgccaacagctttggaaacggccaagccgacacggcggccttgcaccgtcgctgtatcgcccgttacgacatcgtcgtgcatcagataatgcacgacgatgtcttctcgcgataccctacgacggcgtttgagcaccgcaacaaaatcgcgatggcttttcagccgttccaccgctctatgccactaaaaaatcaggcagcgagggacttgcggcccttggcgcggcgacggttgatcagagcgcggcctgcgcgggtgcgcatgcgctgacggaaaccgtgcttcatgtggcgacggcggttgttcggctggaatgtcctcttcataattaatgctcccggtgtttttagccatgccaaggcacggctcctcatgagtcaagctctactaaattactctgacccctgaacagattgtcgcgtcgtccatttttcttcacattttcatggggattccccgcataaaacaatccacataatcgttgcgattccgccgaattcccccacaaaagttatccacaaactacaacaatgttattcacatttcaatcttttcaacacgcacgccggtggataactcggggaaaagagagtacaaatatacagttgcacatcagtggtacgtctgtcgagaaaggattatccgtggctgataacacgacaacagatcctctcgagcaggctcgtggggtgtggtccgacgctttggccctgctgcaccagaatccgtcgctgtccgtacgtgacaaaagctggctggagaacgtctatcccgaaggcatgtggggtccgaccatcatgctgtgcgtgcccagtgaggcggctcagcaggctttgcagaccgaattgaacaagccgttgatggaggcgttgcgcgaatccgccgaacaggacatcttccccgccttcaaaatcgttgaaatgaagccgaaaacggaggaacagccggaggaaacctatccgcgcttctcccccgcgaaatcgccggcgaagtcccctgcgaacgagacgatgcagggccagttgccgattcccgcgacgatgccgccggaacaggaccatttccagagcggccagaacaggccgctgctcgaccccgaaacgcatttgaacaagaacgccaccttcgacaccttcgtgcccggcgattccaaccgtttcgcacgtaccgtggcgctggccgtggcggagggttccggccatgatttcaatccgttgtgtatctacggaggctccggcctgggcaaaacccatttgctgaacgccatcggcaactacgcgctggtcaaggaccccaatctgaaggtccgctacgtcaccagtgaggaattcaccaacgaattcatcgaggctctggccgatacgaaccaaagttccggccagatcaaggaattcaaccgccgctaccgcgaggtcgacgtgctgctcatcgacgatatccagttcctgagcggcaaggacgcgacccttgagcagttcttccacacgttcaacaccctgcatcaggccaacaagcgcatcgtgatcgcctccgatgtgccgccgaaggacctgcagggcttcaacgaacgtctgatctcccgcttcgaatcgggcctgaccgtggacgtcaaaccgccggatctggagacgcgaatcgccattctgcgcatgatcgccaccatgaacggctccaatattcccaacgacgtgttcaacctgatcgcggaacggttcaccgagaacatccgcgagctggaaggcgcgctgaaccgtgtgaccgccatggcgtcgctgagcaaccagccggtcaccaaagcccttgcggagcagactttgcaggacttcttcaccaccgacgtggagatcaagcccgcggacatcatcacgcaggtggccaagtacttctatttgacgttcgacgacatcgtcggccgttcgcgtaccaagaagatcgcgctggcacgccagatcgccatgtatctggtacgcgagctgaccagcatgagcctcaacgacatcggcctggtcttcggcggcaaggaccacaccaccgtgatgcacgcgtatacgcgcatcaacgacgagatgcaggagaagcaggagatctacaactacgtgaccgagttgactctgcagctcaagcagcgttccaacgacaagtaacggaagcaaccacaacaaacggcgtatttccaacggttttccttaggctggtaaattatttaccagcctttttactatccgcgtgacacgcccggacataatttcttgtacatcgagttttccacatacatatccacatttcggggaaaggtctgtggaaaagccgttggaaacacggaaaacggcagtggatgactcgtggattattcacagtgaattgtggataagttttgcgcggccatgagcctgtggataacccatgctcttatccacattcgactcagaagttatccacaggtgacgtctcgtactgaagcgttgctgcacttgggctacgcgagcttatccacactatccacagggcttattattacgaaagtacgtttttcttactttcatcgtcattctcgtaatgcggggaattccccacgctttcgtcgtcgttgctcttatcgctagaatggcatgtggatcgaacgaaacgaggaataccccatgaaagtcgaagtcaattcccaagctcttgccgatgccgtggcatggaccacacgtgtcatcgacgcacgtcccgcaaccccgattctggcgggcatccgtctggaagccattgacggcacactccagctttccgccttcaactacgccatttccgcacgccaccacatcgaagccggcgtggacgaggccggtagcgttctggtgctgggcaaactgcttgccgacatcaccaagtcgctgcccgctgcgaaaacctatctttccaccgatggttccacgatgaccatcacgtcgggcaagtcgaccttcaccatgcagctcatgccggaaagcgaatatccggatctgcccgtggtgccgacgaaactgggtcaggtggactcccccaccttcgctcaggccgtcaaccaggcgtccgtcgcggtctcccgtgaggagaaccgtccggtgctcaccggcatccgcgtccagttccagggcgacaaggtcatcatgagctccaccgaccgtttccgtctggcccgttccagcttcacctggacgccggaggatgcgaccatcagcaccaccgctttggtccgtggctcgctgctgcgcgacatggcacgttcgctggacgagcatcagaacgtcaccatcgatttcgatgcggacaacccgtccctgctgggcttcgagaacgccggccgcgtgtccacctcccagctcatcgacggcgaattcccggccgttgaccgcctgtatgccgatgaatacccgattcatgccgtcatcaacaagcaggccctcatcgacgccatcaagcgcgtttcgctggtcgccgaacgcaacgccccgatccgcatggtcttctccggccaggagctgacgctgtcggccggcaccgccgacgaagcacaggcgaaggagattctcgacatcgacatggacggcgaggacatcaccgtggcgttcaacccctcctatctggtcgacggcctgagcgccatcagcgagccgttcgtgcgcatgaagatgaccaccgcggtcaagcccgtggaattcaacggccagcaggaagcggattccgacgaatccatggactaccgttacctgctcgttccgatgcgcttcaacaactgatttcgttccacctgtggcccggacggcaagttcccgtccgggccaccatgccatcaccttcaaggaatcccggttttcatgcatatctcccgtctcgcgctcgaccattaccggtcatgggaccattgcgtgcttgatttcgaaccgggaatcaacattctccaaggctcgaacggcctagggaaaaccaatatcgtggaagccgtggaagtgctgtccaccggctccagccaccgcacctcgtcatcgctgccgctggtcgaaaaaggccacccttccgccactgtccgggccaacgtcgaagatgcgggcgaacagcgcacatatgagatcaccatcgccgcgcgaggcgccaacagggcgcgcgtggacggcggaaaatcgcaatatatgagggatatcgtgggttgggtcccctccgtgtcctttaccccgaagaccagcggttggtgtctggcgatccggccacccgacggaacttcctcaaccaggcggcttcgctgctgttgccccgttatgcgcagtcgttgcaacagttcacgcacgttgccaaacagcgtgccgcattgctcaaacagctgtccgacggctccggcatcgatcccgaatacgggcgtcaggccgtgctgagcggtctggaagtgtggaccggccaattcatcgccctcggcgtgcaattgaccaaggaccggaacgatgtgatcggactgctgcgcgagccgttcacccgcatctatgcttcgttggcgggcgaagaggaacaggccgacctggtgtatgagccgtccttcgacgaggtgcttctgttcgacgagccggccgcggaaatcagccgtcatttccaacgcatctaccccggcgaagtggcccgtgggcagaatctgatcggaccgcagcgcgatgatctgacattgcggctcaacgacatgccagcccgcgaattcgcttcgaacggcgagatgtggacaatggcgttggccctgaaaatggcgctgtacgaagtggtttcggcgcagcgcgacgtcaagccgatcgtgatactcgacgatgtgttcgcccagctcgacgagtcccgtcgcgggcagatcctcgacttcgcgcgacggcaggaccaggtgctgatcaccgtcgccgcggcaagcgatattccgcaaggcgaggcgcatgtcatcgacgttgccgcgctgcgtgcgcaatcgcaggagacggacggcgatatcgcggcgatggcggccatgcttgccgccggacgtggcgcgcaatcgcaaggaatcgaggccgaatcctaatgccgaaaccaccaatctgcgaactgctgaacctcgaccaacgcaaactgccggccgaagtgttcgaccgcatcagcgaccgtgccgggcggctcaaggaacgcgaggaacgcgcgcgcaaggcgtgggaaagcttcggcaaacccggacgcgatccggaaaccgtcggcagcctgttcaatctgctggcatcgaacggcgcatggataccccacctcaaaatggcgcagatgcgcgaccattgggaccaggtggtgggcgtggagaacgcgaagcactcctaccccgccagcctgcgagacggcgtgctgacgatacgttgcgacagcccggcctggaccaccaccctgtcgtatatgacgccgttgctgacggacaccatccgcaggaaactcgaaggtctgaccatcaatgaggtgagggtcaccggcccgcagagccaagggttcagccgtgggcgtatctcaaggaagattcgctactgagggctattgcgaagtcgacttacaatcgacctctctgacaggagagatcgattgtggcgcgcgtgaaacaggccgttgcgacggggtttacggaggttttccggctcgtcggacgcgttcggaaccatgccgaagccgttgaaaaccgttgaattccaaggacaaatgtctatagcgcgctgtccccctccatgagtagaatatccagcagtgtatgtaaacgcctagaaggggcctttatttgcgttctaggtggtatcacctgcggaaatgacccttgatggcgggaaaaatgcaggaaggaatctctgtggcagaccttgatgcggattcgctgaacgaatcagctgaaaacacgcaggaagatcagattcaggatcagatccagaacgaccagctcgaagatgcgcaacttgacgattcgctgtctccggaacactacgacgcgtccgatctgagggtgctggaaggccttgaggcggtgcgtatccgcccgggcatgtatatcggctccaccggccctcgcggcctgcaccatctggtgtatgagatcgtcgacaactccgtcgacgaggcgcttgccggctacgcgtcgcacatcgaagtgacgattctgccggacggcggcgtgcgtgtggtggacgacggccgaggcatcccggtcgacgaagtgccgggtgaaggcatctccggtgtcgaaaccgtgatgaccaagctgcacgctggcggcaagttcggtggcggcggctacgcggtttccggcggcctgcacggcgtgggcatctccgtggtgaacgcgctgtccacccgcgtggacatcgaagtgcgccgtcagggcttccactggacccagacctacatcgaccagaagccgaccgcgcgtctgctcaagggcaagccgatggaggaaggcgagtccaccggcacttccgtgaccttctgggccgatggcaagatcttcgaaaccaccacctacgatttcgagatcctgcgcaaccgcttccagcagatggcgttcctgaacaagggcctgaagatctccctgaccgacctgcgcgagcccgaccaggccggcgacgaggtttccggcgaggaatccgaaaccgaagacaagttccagaccgtcacctaccagtacaacgacggcatcaaggactacgtcgactacctggtgaagtcccgcaaggccaccccggtcgaaccggacgtcatcgacttcgaggccgaggacctgaagatcggcatctccgcggaaatcgccatgcagtggaccaccgcgtattccgaagccgtgcacaccttcgccaacaccatctccaccaccgaaggcggcacccatgaggaaggcttccgcgccgcgctgacctcgctggtcaaccgttacgcccgcgagaagaacatcctcaaggacaaggacgagaacctgtccggcgacgacgtgcgcgaaggcctgaccgccgtcgtgtccgtcaagctcaccaacccgcagttcgaaggccagaccaagaccaagctcggcaactccgaagcgaagaccttcgtgcagcgcgtcatgaccgacaagctcggcgactggttcgacgcccacccgaacgaggccaagaacatcatccagaaggccatcgaggcctcccgtgcgcgtctggccgccaagaaggcacgtgagaacacccgccgcaagtcgatcttcgaatcggccggcatgccggacaagctcaaggactgccagtccaacaaccccgaagaatgcgagctgttcatcgtggagggtgattccgcaggcggctccgccatccagggacgcaacccgatcacgcaggccatcctgcctctgcgaggcaagatcctcaacaccgagcgcgcaagcctggaccgcatgatgaagtcggacaccatcgaatcgctgatcaccgccgtcggcggcggctacggcgaggacttcgacctcaacaaggtgcgctaccacaaggtcatcatcatggccgatgcagatgtggacggcgcgcatatcgcaaccctgaacctgacgctgttcttccgctacatgcgtccgatgatcaccgccggctacgtgtacgtggccatgccgccgctgtaccgcctcaagtggaccaagggcccgcacgacttcgtgtacaccgacgccgaacgcgaccgcgtgctcgccgaaggcaaggccgcgggccgccagctgccgaagggcgaaggcatccagcgctacaagggtctgggcgagatgagctaccaggaactgtgggagaccaccatggatcctgaccatcgcattctgaagcaggtgcagatcgaagacgcggccgcggccgacgagaccttctccatgctcatgggcgacgaagtcgaaccacgtcgtctgttcatccagcgcaacgcacgcaacgtcagctggatcgacgcgtaaacgcgtagggtttcgcaggacttcaaagcaaggattagaaattggcagacgaaaacaacagcaacgaagacggccagttcgtgcctgacggctccatggaaccgttgagcccgcaggaggccgacaacaccgattatggcctgatggtcggcgaacgcgtccagaagaaggatctgcagcaggaaatgcgcgaatcctatctggcgtacgccatgtccgtcatcgtcgatcgtgcccttccggacgtgcgagacggcatgaagccggtgcaccgccgcgtgatctacgcgatgtacgacggcggctaccgccctgaccgcggctactccaagtgcgcacgcgtcgtcggcgaagtcatgggcaagtaccatccgcacggcgattccgccatctacgacacgttggtgcgtatggcgcagtcgtggtcgatgcgatacacgctcgtcgacggccagggcaacttcggctcccccggcgacgacccggcagccgcaatgcgttacacggaatgccgtatggcgccgctcgccatggaaatggtgcgtgacatcgacaaggacaccgtcgatttcctgccgaactacgatggcaagacgcaggagccgaccgtgctgccggcccgcttcccgaacctgctgtgcaacggctcgtccggcatcgccgtcggcatggcgaccaacattcctccgcacaacatgcgcgaggtggcagaaggcgtgcattgggcgctcgaccatccggacgcgagccgtgaggaactgctcgacaacctgatccgcatcatcaagggaccggacttccctaccggcgccacgattctcggccataagggcatcgaacaggcgtaccgtaccggccgtggcctcatcaccatgcgagccgtggtgaacaccgaggagatcaagggccgcatgtgcctcgtgatcaccgaactgccgtaccaggtcaacccggatcgtctggtcgtgtccatccgcgaagcggtgcgcgacggcaagatccaaggcatcgccgacatgcgcgacgaaacctccggccgtactggccagcgcctcgtgctcgtgctcaagcgcgacgccgtgccgaaggtcgtgctcaacaacctgtacaagcattcccagctgcagcagaccttcggcgcgaacatgctggcactggtcgacggtgtgccgcgcacgctgtccctggatgcgttcatccgtcattgggtaaaccaccagctcgaagtcatcgcacgccgtaccgcctacctcaagcgcgaggccgaggaacgcgaccacatcctgcagggctatctgaaggcccttgacatgatcgatgaggtcatcgccctcatccgtgcctccgagtccgcggagaccgcccgcacgggccttatggacctgcttgacgtggacgaggtgcaggccgacgccatcctcgccatgcagctgcgccgactggccgccctggaacgtcagaagatcctcgacgagcacaacgagctcatgcgcaagatcgccgactacaacgacatcctcgccaagccggaacgccagcgcaagatcgtcggcgacgagctggacgaaatcgtcgccaagtatggcgacgaacgccgtaccaagattctgccgtactccggcgagatgaacgtcgaagacctgatcgccgaagaaaacgtggtcgtcaccgtgacccactccggtttcatcaagcgcaccaaggccgacgaataccgcgcgcagcaccgcggcggcaagggcatcaagggcgccaagctgcgcgaggacgacgtggtggaccacttcttcctgaccagcacgcacaactggctgctgttcttcaccaacaagggccgcgtgtaccgtctgaaagcatacgagctgccggaaggctcccgcgattccaagggacagcacgtggcgaacctgctgcagttcggcccggacgagacgatccagaccgtgctgtcgattccgaactacgacgtggccaagtacttggtgctcgccacccgttccggcaaggtcaagaagaccgcgctcgccgaatacgactccccgcgtcagggtggtctgatcgcggtacgactcatgaccgacgagaacggcgagaacgccgacgagctgatcggtgccgcgctgtgcaacgccgacgacgacatcatcctcgtctccaagcagggcatgagcctgaagttcgaagccaacgacgagcagctgcgcccgatgggccgccagaccgccggtgtgcagggcatgaagttccgcgacggcgacgagcttttggccatggatgtggtgcagggcgattccgacagggatctgctcgtggtcaccaacgagggcttcgccaagcgcaccgccatcagcgaataccgtctgcagggccgtaacggctacggcgtcaaggccgtgcagctcgccgaaggccgtggctccctggtgggtgccgtgatcgtggaggaatccgaccagatcatggccatcatgaagtccggcaaggtcatccgctccaacgtcgccgaagtcaagcgcaccggacgtaccacccagggtgtgacgctcgccaagcctgacaagaacgacgaaatcatctccatagcacgtaacgaggagaccgacgaggatgatgccgagcaggccgccgcggaaaacggagcagtccagaacgacgcagccgcgcaatcgcaagccgaaaccactactgaaaactccgctgaaaccggtacggaagccacttccgatgccggcgatggcgagaatgtagaggcctgagacacaggcggggaatcgtctgcgaaaactggtagcctcggctagaagtaggcaagattctgcaaggagcaacgatgagcgagaacaatgaaagccatcaggcgcaggcaggggcgcaggccccacgcgtggcccgttccgcatccagccagccgttgagcggtacggaacagtctcaggcgcatgagaacatggccgccgcgtccggcggtgtgaaggttcgtgaaaaagcgcgtcgtggcgcgcctcgcgcccgccgcatgagcctgtccctgacccgcatcgacgcatggtccgcggccaaggtggcgttcatgctttccatcgcgggaggcatcatccagatcgtcgcggtgacgctgctgtggctgctgctgaacgtggtcggcgtgttcgatcaggtgacgcagatcgtgtcctccaccggtcttgacgccggcggattcgaccttgccaacgtgctttcgctgagcaccgtgctgagcgcggtcaccatcttctccatcatcgaagtggtgctgttcaccgtgctggtggtgattctcacgctgctgtacaacgtggtgagcacgctggtcggcggcatccacgtgacgctcggcgacgactgatcgattcgtcatacggcgttcgtacggcgcttgcgcaacgtaagccgttcgtgcaacataagaagacggcgcttccctacttcgggaggcgccgtcttttcttatgtaatcgcgattatgcggtcgcttttatgcaatcgtcatactgcgttgcgcgttatgccgtaacgcatatgaaaacggtccgtgcgaacgaatcgcacggaccgttgaaacggattgtgaaagacgatcagagcacgccctgggcgaccatggcgttggcgaccttgacgaagccggcggcgttggcgccgagcatcagatcgccctcatggccgtactccttggcggcggccagggaattggcgacgatgttctccatgatggacttgagcttgttgtccacctcttcgaacgtccaggaaaggcggtaggagttctggctcatctcaaggccggacacagccacgccacccgcgttggcggccttagccgggccgtacagcaggccgttgtcctgatagacggcgattgcctccggggtggacggcatgttggcgccttcgcacacgaccttgcagccgttggcgacgagggccttggcggactcctcatcgatttcgttctgggtggcgcacggcagcgcgatgtcgcacggcacggtccacacgcccttgcagccctcgtggtattcggcacccggaacacgctccgcgtactccttgatgcggccgcggtggccgagcttgatgtccttgacgatgtcgagcttgatgccgtccggatcgtagacgtagccgttggaatcggaggcggtgacgaccttcgcgccgagggcctgggccttctcggtggcgaagatggccacgttgccggagccggagatgacgacggtcttgccttcgaaggaatcgttcttcaggacgcgcagggcttcctgggtgtagtagcacaggccgtagccggtagcctcggtgcgagccagggagccgccgaattcgaggcccttgccggtgatcacgccggagtattcgtcgcggatacgcttgtactggccgaacaggtagccgatctcacgggcgccgacgttgatgtcgccggccggaacgtcggtgaactggccgatgtgacggcacagctcggtcatgaacgcctggcagaaacgcatgacttcggcatcggacttgcccttcgggtcgaagtcggagccgcccttgccgccgcccatcggcaggctggtcagggagttcttgagaatctgctcgaagccaaggaacttgatgacgccctcgttcacgctcgggtggaaacgcagaccgcccttgtacgggccgatcgcggagttgaactggatgcggtaaccgcggttgacctgcaccttgccctcatcgtccgtccaggcgacgcggaacttcaccacgcgctccggctcgacgaggcgctcgagcacgcccgccttctcatattccgggtgcttctcaacaaccggctcgaggctttcgaagacctcgcgaacggcctgcaggaactccggctggtcgccatcgcgcttctcgacctgcgcgtacacgcgcttgacgtactcatcagtgagcatatttttccccttcgggatagttgggttatcaatacggcggtttcattctatgtgcttgactgtgagacgcacaagatattgctcaagatttggctggaggcgtttggaacgccataggatagtgtgtggaaggcgaggagagagcgtcgtccgcaacatcaactccctcatttcccacaggagaaaaaccatgcttgaaggattcaagaagttcattgcacgcggcaacatgatcgacatggctgtcggtgttgttatgggcggtgccgtcaccaccgtggtcaattcgatcgtgaacagcgtgatcaacccgttcatcgccatgattttcggcaagccgaatatggacggcctgctggcgatcacgttcaacggcgcgaccgtctcgttcggcgctgtgctgggcgcgattctgaatttcctgattatcgcggccgccgtttatttctgcattctggtgccgattaacaagttccgcgacatgaccgaagcgctgcttgccaagaccaagcttgccgagcagaaggaagccgaggaaaaggccgctgaagagccgtctgccgaagagcagaccgtccagctgctgcagcagattcgtgacgagctggccaagcagaacacggcccgcaactagttgcgattcgtggtgccgctcccctattgatttgatgattccggccgcttgtgggtatgcgggcggccgttttatttggtttgcgggcgatcgcgtccgttggatggtcgacaagaggctgaatacgaaaaaggcttccgattactcggaagccttcaattctgtggagctaaggggattcgaacccctgaccctctccatgccatggagatgcgctaccagctgcgccatagccccgtggagctagccgggttcgaaccggcgaccctctgcttgcaaagcagatgcgctaccagctgcgctatagccccataggtgaaaaaagcggctatgccgcttccttaccatctacgtgggcccgggaggacttgaacctccgacctcatccttatcagggatgcgctctaaccacctgagctacgggcccaacttgctgtgtcttgaacacaacgaattgaaatgatacttgaatcacagggaaagtcaagtgccgccgtgtcatcggcgtgtcgtggcataatgcaggcatgacatacgggcagcgcaacggcggtaacggccgttacggcaggggagtggggcatcgcaaccgcaatcgcgtgatttccgaaacgacggcgagcatcgccggcatgcgggtggccatcgtgcgcaaacccatcaaaaacatgtacctgcgcatcaaaccaccgaacgcggatatcgtcatctccgcgccgcaacgaatgtcgcaaagcgctatcgaacggtttgtaacggaacgcaagccgtggatcgaacgggcgcaacgcagcatgcggcaggccagagacgcgcaactcaacgcgcagcgtgcgcaaaacggcaatattggcgatactggcgcttccgccaacccgcccgctttcgtatggacggacgaggccaaggcgcgggcgcaacgcaacatcgaatcgcaattgcctgtgttgcttgccaaatggggcccgatcgttggccgtacgccgacgcatatcacgttgcgtctgatgagttcgcgttggggatcgtgcacgccgaagaccggacgtatccgacttaacctgcagcttggtttaatggcccctagattcctcgaatacgtgctggtgcatgagatgacccacctgtgggagaacggccacggagagggctttcaaaggcgtatgagcgcctatctgccgcaatggaggcagttgcgccgcgacatcaaccggcaggtggtgctgtaagaggccgctcgggttacttggcgtccgccgcggaatcgccagccgcggaaccgtcctcatcggcggtgtgccgacgcacttccagcgtttcgatacgacggccgtccacttcggtgacgaccatgtcataaccgtcatcggatgacagcacgtcgccgacctcgcccattttgccggtgtgcgccaggaaatagccggcaaccgtctcgtacgggccgtcttccagctcgatgccggtcaaatccgcgaaatcctcgatcgtcatgccaccttcgatggtggccacgccattgacgaaagcggcgcgttctgtgcgttcgccgcccttttcctccggcaggtcgtattcgtcgcggatgtcgccgaccaattcctcggtcatgtcttccaacgtgacgatgccgtcggtgccgccgtattcgtcgattaccacggccaggtgaatgcctcgtttgcgcagcagctcaaggcttggcagcagcttcgacgtgcccggcagggaaatgccctcacgcgtcacgtcggcaacggttctcgccttcggatcgcggatgtcgagcaggtcgcgcacgtgcacgaagccgagcacatcatcgaaatccttgccggtgacggggtaacgcgaatacggcatttcacgcacgtacgcggcggcttccgcaatcggcatggagccgtccaggaacgcgacgtcggcacgcggacgcatgacctccgccacaatggtttcggatgcgtcgaacacgtcgtcgaggatggtgcgctcgtccttgctgaggttggtgttggtgttgacgagcacgcgcagttcgtcgtcggacacctcgctgtcggtttcgttcggatcgaagccgagcagccgcacgatgccgttcgtgttcttgccgatcagccagatgatcggcttgcacactttggcgaacacatggatggccggcaccacggcacgcgcgatctgctcgttgcgttgcatggcgatacgcttcggcaccagttcggaaatgacgatagagcaatacgagatgatcagcgtcaacgcgatggtggtcaggggagcggcgacgttatgcggcacaccccagtcttcgatgaccggcacgatatacggggcgattgaggattcgccgaacgacgcggacaggaagccgcacagcgtcacgccgatctgcacggtggacaggaacgtgttcgggtcgcgtgcgatctgcgccacacgcttgccgcgcgcatcctcctgttccatctggtcgatctgcgatccgcgcaggctgaccagcgccagttcggtgccggcgaacacggaaccgagcagcaggaaaatgaaaatcagaaggatgttcaaaccaagcgacatgattccaatctaaagcaacggcatgtcaaaacagcgcgacgcaacggatccggaagccgtctttttccggaaaacgtcagaagctcaatacttcgacttttccggtgtcgagctggtagcgtgctccggtgatcatcagccggtcctccgccagcgcgtgctgaatcacctcggactgttccaccagttgctcgatggtgcgtgcgatgtgcacgcgctcgaaatcctccgtcgattccagctccgactcgtgcgcctgccagatcgaaaaaccgacggtgcgcagcatcagcgatttcgcgttcagaatacgttcgtcaaggtcggcaacgctgtcagcggccatcagcgaatcctctgcgtcggcggtcaactcgtgcaacaacgcctcgtattccttgcatgcctgcttgatcgcgccgcaattctgatggccgagcaccaccaaaaggcgcacgccgagcacgtccaccgcgtattccaaagaggcgatcacagcatcgtctatgacctgccctgccgtgcgcacggtgaacagatcgccgatgcctgcgtcgaaaataatatcggggctgacacgcgcgtcggagcagctcagtatggccgcttccggctcatgcgtgtcgatagtcgcctcgcgcgcttccacgctgcggttcggatgctccagcttgccttccgcgaatctacggttaccggccagcatacggctccacacgccgcttgcggtgccttccacgtcgttctggttcacaaatggttcgtccgtcattgattccacctctttgtcatttcatcacaggctatggttcatcataaacggtgtttctgaagttgtttcgattgaatcgccatctaaggcaggggctgcggacgttttcttggagataatcacgcagctattccttggctctgacggtatcgtgccggactcatccaaccgagcgactgccccgggtgctaaatagacgtgcaacgccttgtctaggtttggaagtgttcagtttctaatttaagaaggcgttgcgcttacaagttgaatccgggaacgcgagcggggaggcccgcgccgtttatcggcacggaacctccccgctcgtatcatccaggcggtcagccgaaaatcagcccgtgttctgcaggcctgctgcgacacccggcgcctgatttgggcgttgccatatggattcagcgatgatcattgcacttcatgtaactgcaatatttgctgttattcattgaaattcttgatacaacgatgttttattggtatgaaaaaatgctttgaaagttgcggcgaaagagacgggacctcctttgacaaccgcatgaaaagttcctttgctaagaacattcagatttccttcaaaccaggaataatttggagaccattggaaaacacagaccccggtctggtatgagcttccaagcaaggattttgaggtaactttgtaattcgttactgtagctcgaaaatcttgctttacccaacaagctcctcctgctgggactccagaaaagacgcttgaggtatatgttgccgtaccgcgtgtgcttgcgtttttggtttctctggtattagaggctgtatcttcttcgtatgctttcgcaatagattcagcgtatagattggcgtcaccgtggtattcatcaatcgtactttgaggagcatcgattttaaattcgccgaattcgacgtctaagttattcgtggaagcaatgttagagagtttttcttgcagagcgacttctgcagaagaattgaaggcgcttcggtcatgtccagaagtgctagccattgctgatggggtaccagagaacgccagtattgccaccagtactgtggtgaacgcgatttttttatgaaggttcattcgtagtctcctttggcttcgaaagtattttttatccagtgatgcgtctttgcgtcactttagttctatctattctatactgattatcgttgttctcataattttgtcggcgaaggtttgtcctttggtgtcccataaaggccaaagaaacccaatgaaacatggcacgaaatcaacgcagtgagctatctcgcgtaaacccatccttactcccgatatgggcaggttggaatattgatcgactacctgcagtcctagaaaatgatgcgaccaagcttgtccgttgcgcgtagaacaggcagaaatcacgcaaactatgattatggagacgcagttaatccagattcccatggttccatctatggaagatctcccatataaaacgctgtttattaattgtgatagcaatgaagttggcaatattatgcgaagaatatatgacgctgctctgcgacaccatattttccccattgacggcctccttgacgaacccggccagattggaaacagtataagaaaaggttcagtgtaatgctgtagttccccttctaagttatttcaatcttatgttggattccataagaataggacaaaacgccggataacgcgagcggggaggcccgcgctgtcaacggcgtaggcctccccgttcatcgagcggtcggtcagccgaagatcagccggtgttctgcaggcctgctgcgacacccgacacggtgcacaggatcaggtaggtgttactgcagtctgcagaagatgaaaagaataagagctaaaacaagaaaggcggcaccgcttattctcattaaggatgtgtatagattgctcggatctcctttttgagtccagaggaaattgcttattttccagagttgccttggaaaaataagcatacataatcctagcagggcaagtgctgtgagatatatgtactgcactgttctccttctggtttgtccctactgttttattgataacccttttgcctgaggttgtggacaaggctagaactatattggctccaaaatcgacggggttagctctatgcgcgtgcatttcgaaactggtcacacggctggagacttgagggcgcatatagaattcgcccccattggtgccattgttgaaaacaatggaaggtgaaaccatataggtggaatattgatcatttgaactttgcccatcgagattgactacccggtcgatgacgttattggcgacaatccatccaacctgctaccaatttacagcaaaggctggagtggtcataactgtgcataggcaaactgagataattgtggagaataaaaaaactcttctggatttcataatttcctccatgtgaaaatttaatctcaatcgacaatgattaagatattaagagtattctaatggaaaatgagtaggggtgcactctagggtgtgattttctagtgaaaatagcaaaggttctctctcgtggaagttgcaaacgagggcttcgctatgtgtctgtgtttcaggagtcatgcagttgttactgaatcatgagtggattgaggataagtatgctagtgctgcatgttaggcgctgaacaaaaaccttcgagtgcggcgtcttccgtcaacaacacaactcgttcagaaatacacccaatatggtcaaacagtaagacagcgctatgatgcgaacaatcttcttccaagacagtttgtcatgaaggaaagccgtaaccaaaagggttgtcattggggttataagcaggacgaggaagaaatagagaaatgtggactaggctcaatctgccgagaatataagtctgaccgaaccagttgtataagcccacgatggctgtcggtgtcgcggcgtgggtaaacgcggacaggcgccgggttacgtcggatgattgggagtctgtcgctcggcctgcgtgcctgttttgtgcgctgtcgccggccaggctagggccgcgcgacgcgagcggggaggcccgcgccatttatcggcacggaacctccccgctcgcatcattcaggcggtcagccgaagatcagcccgtgttctgcaggcctgctgcgacaccggacacggtgcacaggattaggtaggtgtagttctccttctgtccgtgcgtgagctcttccttgtccaccttcttgcgcagcgacctgagggcgagcacctgggtgacggacagcgcgtccacgtacggggagcggatgcggatggcctggccgagcacgtggcggtgctgcagcggccacttgtcgcccacgatgcgctcaagttagtccggtcaatggctttggaaaatcatggggagtgcggctgcgcgggttcgctcctcgacaaggtgacttgatttgggaccgccgttaactttcgtcagacacatcgtaaatcccgtccaagtatccgtatcgtccgttgtgcttgtccttcgagaattcgacgatattgatgttatcgtcaagaggaatgccagccatgtgattcgtgttttcgataatgatgatttgttgtgaaaccgcttgtttcgctagataggaaaacaggcccactttcatggatgagtcttccaggggtcgtattccttcgtcaaacccatgcagaggcgtatcaataagcagccaacccggagtatgctttgactgttcattgagataatcatgaaatgcgagcataacaacgctgttaagaaatgcgcagtatcccttgccttgttcatcagccttggaataccctgctatttcgacatcaaaagaagatctgctgaaatctgcagtatcagcaccttgaaaatgacattgttgcagaatgctgcgtatggtgttattcatggaataccagaaatcactctggaaacattcgcgtggcttgtatttttcatcattctgtgttgcttgaccagcgtcatcgagtgccttgttgaaacgagcatgcagcgctatgagttccgcatattccgcatgcaattgttctgcatgggcaatttgctcaatatcttgttgcatgtgctgcgctgttggttgaatgtcggatttgagcgaatgcatattttgccgatgctgctgtttctccagatgcagctcctgttgcacctcatcggctttgtcgacgaggatggctagatcggtttcaacgtctgcttggattctgtggatatgctcaatttctgttgagacgattagaatgtcctgttcagtcggcacagacatgtggatggggctgtggcaaaactgacatgtggcgggataggcatgtgtgcgggcatgtttcattgcctgtagttgcaaatcaagacgtgcagcgtctgattcgtattgactgataagtaccttacgttggcgaataagtacctcaaggtgctcatattgttgattaagctgagagatatgtgagatggtatgggcatctcgattgaggagagtttgtctttgctgttctacgtgtaatgcttttttgtgaaggtcttaaataggtgtgaatggtcttcccctcatttgttgcgatatggcgcatctcctcaaggtgtctgatgcgaggctctatatcatccaactgctgatggatgaactgttccacggcttttctgcgggcgtgacgttcgctggcactctctgtctgtatggagttgtcgattttttcatcttgaactagcacgagcaacgaggacagactttgtgtgagagttgctagagaggtacttttggggaaaagaatggaggggcgtgcacgtcctatttggtcctcggggacaatcatgagatgtctgatggcattccatgtgaaagcaactgtatggtaggtttcgtttgtcgctattctacgggttgattcaacgcctagtaaggcaagaagaaccgtattgattgatttaccggcacgtgatgaaacggagtaggaaccggggacgatcattgggttgctggattttacatggatagtgttctgaacgtgaatcgaacgactaagcgaaacctcaccgccgttggtcacgaacgtgacctgtgcaatttcataggcagttttatcggtaaaggggagctctttccctccgcaggcaaattccacggtttttgcgattctggttttcccggtgttcgaagcgccgataatgcagttcagcccgcatgtgagattaatggcggattccactccgtcctttctgattgccgaaattcgacgtatccatgtgtttctcataactggttgttctctttcgttattcggttcatgatggtttcataatcgttttttatcaagagctgaacagcctgtcgataggaggcagcgtaatcgccgtgcaatgcttccgaatattggaaacattccggagtggcgcggtacaacaggcaagtggaatccacggttgctgctccaacgattacgagttgggctaatcctgcttgtattcgtttgcgacgagcatcatattcggctaaagcatgtggaccatcgccgtgaagattgcgctgtccgaatccgaatgttttcatataggtggcgataaggtcaatggctgtgatttcgtcaattgtggaaggtctagaaagaaggggaaggcataatgtcaatcgtgttgctgtttcctgtgttgtgttaaataatgaattattcattttcgtgtacccactccagcatatggtcgttgaccagcatatgacacagccctttcttttccgctgccttaatcattgatgggaattgggctataactgaaccggatagggggaaaccggctgcctgagatagcgttgctcgcatgcgtaacagtccatcggcgtaatcagatgcgcaggtatcgcatattccgtcataaagatcaaccttcagtgcatcaaattcttgctctccgttttctataacatcccgtagattcctgcgcattccttccgcatcgtaaaaatattcacgttgcttggcgtattcaggacgacatgtctgaggaagatcgtcggaacagttgattggcttgtgcaagtgatcggcataggcggcttgcatctgcgtgaggtatgtctttttcaagatgatcatctggtttatccggtggaattggataagccttccaggggaccgaagagcgcccaaggtgcaatttgccgttgttgatgcgaccagacgccagaggtaagttttcgaaaatatcgaatttcggctgaaagcttatgccgtcgatgagaatgtcacgtccaccggcattcgcctggagtattgacagaagccattttcctgtggcagaaggaagctcactgatatccgtaactctaatatttgccttgataagctccttttgaaaatcggcaagggcatcaatgctgatatcgcagcaaagacgttctactttcgagatatctaggcgctgataaaactcggcggctttccaggcaggaatcttcttgcgaccgttataaaaacgagtcagatcagtatcgttgattccagaccagaccccggtggtaatagtggtctttccgggtttgcggtttcgatgatgttggggaagtggatttcttagaccgtcatcctctaacacagcatcgaagaaatccttcataaatccctttttgtggtggtctacgccagatatataagggtttacgagctgacagaagactcccagagcataggtagcagtagtttcggccaagtgagtctccttctcgtctccatttgtcttcatccgtcgccttcccatgaggtcactgttcctacgatggaagccagattcagacgaataagccggtaaaacactggaatatcgccagtatacgccgcttacagctggatcagagaagcgcaactttcgtctattgaaaggatttgagaccagacacatcgtaatttcttcttcaactcgatgtcatgcgataaccggttatagaagtagggcattgggctgttcatccgttgtgccgcagtgaagctgactggggcttttaactaatcacatgcatgagatctgcctgcttattcatggtgacgcgtcggttttctcctgaactgacgcgtcatgcttatccagcaggttggatgctcatgtggtggcctatgcaagcaggtctcgaagacccaataactgggtgggatcgagactggaatgagaatttcattgaaacatgaggcaatgcgcgccggtaatgtgtccgtaactgatatatacaactgttcggaagtggaattacggacgatggttgaacgcgatagatgtttgcgcgcaatccgtatgggttgttcgccacgtgatattgcactacgtacccctcaaacgatacttcaggaattgtggaatgcggaggaacgttccgctcacgcttattatcgatcggaccgtgtcagcggagttatttgctcctatgaggatttggttggtgcagggcgggaaccccaggggtgttctgcttcttctgaggatattctcttatgcgcggaggatgcgagagaaagagctaactgtttgcaagctatctttgcggagatcgaaaaactgccagcaggtcagcgcaatatcgtcaggggtgtactggtaaagggggcatctcaatcagatatggcacgagagctgggcgtgtcccgagctgcggtgtccaaacagctttcaacggctgtgcgcaaaattcgtgccgctattcgcgacgaaagcaaagaaacgaagaacacgacaacatcagcagtttgtgaaagaaaggagcattaatggttcatttcagtgttatcagagtgaaaggaagcccgtcatatgacttcgatgcatgcggagacattttggctatggccaaagctgtaggtgtcatgacggaaaacatgcgcactgatcgctgcgacaatacacagtgtgatggaagtcgttgtaagggaaacactatgtttcggttggagttagacaccgaaaatcgcagagttcatcgcagacgccatgccagatgaaacgcccgaggttaacacctcgtggcgaaacggcagtgcaggtgagggcagatattgggtctgccttcagcaacaggtcccgaaggaggacatcatgactgatcagatggtgctgcagacgcagcagtggctgaacaagacatacgggaatgatccccgattcaagaaaatcaacccggacggcagaactggttggccgacaatctatgcgcttactcgcgcattgcagattgaattgggcatccagtccactgccgataacttcggtccttccacccagcggttattcaagcagcggtatccgaatggggtgcggcagcaggcagttgcggacaagagcacttccaacgtgtattccatcattcagggggcgctgtggtgcaagggctactccactggtggcaacatctcacagcatttctacgacggaacaggttccgcgatcaggaagcttaaggctgatatgggcatagagggagattccagcgtagacgttgagatcatgggggcgttgctctcgatgaagcagttcgtgctgctggcctcttatggcggtatcgactccgtccgtagggcacagcagttcatcaacaaagcatatcgtccatacacgggcatcattccgactgatggactgtacggcagggagatgaacacggctcttatccaggtgcttcagtcgcttgaaggtttttcacccagtgaggcaacggggaatttcggcaacggaactagatctcgtttgaaaacgataacagcaaataacgcatcctctaatgagtcgtgggtctggctcgccagcacggctttggcgtgtaatgggatcgggggcgggccgaccttcgtatggacgagcacgttcgccaatatcgtgaaagcgttccaggagcgttatgccattgctgtgacgggctctattgattcgaccacgtggatgagcctgttgacatctaaaggtgatcctgaccgtccgtgtgtggcctgtgacactaggttcgaaattaccgacgccaggttggcgacgttgaaggcagacgggtatgaaatcgtgggacgttatctgacggagcctggccagtcgtcgttggcgcccaaggattactttaaggccatccgtccgggtgagctcgagcgcatcactcggggcggcatgcggttcttcccgatcttccaggagtactccacgaagctggagcatttcaccccggcaaacggcgctgctcatgccaagaccgctcgtgaggcggcgcagcgtcttggcatccctcccacccatatctacttcgctgtagacttcgatgcgaccgatgaccaggtgaccagcaatatcctgccatacttccgtgcggtttgttcgtctcttggtggtggatacggagtagggatttacgcgtcccgcaatatttgttcccgcgtcatcggtgcgggatgcgcgagtaacgcgtttgtgtccgacatgtcgacgggattctcgggcaatctcggcttccccatcccggacggttgggtctatgaccagttcaccgagattgacgattacaagggccagggctgggatctggaccgtgttgcctattccgggaaggtatcagcatgcgcttcactgttgcctgccgtgccagtgcctgcgcctgatcccgatcccgtctcgccagaaacggatccgctgctaagatgggtcgccgtcacggagcaggagtgtcgcaaagcccttgccgctctgggtacccaggtagcggtttacgaggacagcatcggtcaattcatcctggaatggctccgcaaacctgaatactggtcggaaggcggtagcgggacacaagcaatgtggcacgcatatactcctgaagtttcgactccgcccgacttggacgcggcgcgtgtggtatgtgccaatgtatgcgaagcacagccttcaattaaagagaaactgccatcgactcgagatgttgcacacatggctgcaactgctctcggatacctgacatggggtatcgaaaacaatccagccaaatatggtctaggcgatttaggtggctggcctctcgacttgttgcagatctggggtgcctatcgccgtgacggcaagcatgccgacttggcagcatggctctataagcaccttgggaaagatgaaggattcgggtacgatgacgttcttgcggatgcagatgcatggctaattgcttctagtatgaggaaacgatccggttcgacggttctttctgctgctatgcgtgaaacgtttaagcagagtgagacccatcgtatcgttcgattctacgacgaacgttttgcatcaagcgcagataatgtggtgagtgcatattcaacaatggcggacggtcttgatgcacttggtttgacaaatattggaatgagcgaaagcatcctaaaaaaggctgccggtacagacaagcttcctgataagcaggaagctgaagtgagtgctcgggcgttcgctgcattcattgatcagccaagacggtagctcgcataatgcattatgtgtgggcagatgtgtcgtctgcccacacattcgctgttgtgctttcgatttggaattcctctgccagatacggggaaacttctaaaaggccgctatgccgaggaagagtcctgtaataccggtggccatcaatacgatgatggtgatgattccggcgaagatgcgtacaggaagggtttcttttccatggtttgatgggctgtccgcaactaatctcattactccagctgtaacccagcaaactgcgcccaggactagtgccaggaattctcgacaccattccgtttcaagtgcgggaatgccgacgattgatgacgggtcgcttgccagtcttggcggaatagcgcataggatacgctccaatatcaggtaaggggtatcaaaatggatcagagtcaaagcgaatgggagctgtagcgccagtcctatccaccacagcgtgcgtcggatggtcgcgagtctgtcgcccggcctagtgtccggcttgccgccttcgccctccgtcccggcaccgtccgcgggcgtgtggtccccctcgtgcgcgtccgtcgtcccgtccgtgtccctttccgcgtccatatgtccccctccgatcatccgagtctgtcgctcggcccgcgcgcccgttccgtgcgcgccgtcgccggccagtctagggccgtgcgacgcgaacggggaggcccgcgccgtcaatcggcacggaacctccccgttcatcaagcggtcggacagccgcggatcagcccgtgttccgcaggccggcggcgacacccgagcaggagtgtcacaaagcccctgccgctctgggtacccaggtggcggtttatgaggacagcatcggtcaactcatcctgcaatggctccgcaaacctacgtactggtcggaaggtagttccggcacgcaggcactatggcatgcatacacaccggagccggttactcccagcgaattggccttgtcgcgtcaggcatgcggtgtcgcatgtgatgcacagcctgtcatcaaaggcacgctgcccaatcgggacatcgcccatatggctgccacatccttgggatacttgacatggggcgttacgaacgatccaatggactatggtctcggtgatctgggcggatgggctctggatttgctgcagatttggggaagctacctggcgaataccccgaaagaggacctggcgtcatggctgcacgctcatctcggcgagcaagacgctcgtatgggattcagttacagcgatgttctcgcggactgtgatgcatggttgctggcgcggtccatgcagagcaattcttccgaaaggtctttgtccaccgctatgcgggacatgttcgcgcaaagcgagacgaatcgaattaaacggttctatcagtcccggttcaagggaagtgcggacaacctggtcatcgcatttcgaaagcttgttgatggaatcgatcttggaatattcgataacgtatccggaagtaaaaaagcactgctcattgcgtcacatgcagaccgactcccgagtcaagcggaggctggtatattggcattatcctatgctgaatctcttgaaaatccgaaccgttaatcaatcatgattgtgatcgcattgcgtggaatgattcagccattccacgcaatgcgcctctggtaaaacgtcatagagtcattagagcggaaagtagcgttatcacaagaacgggaaagaccatgaccagcacgagaaacgatatgattcccacaaggacatgcgaggcggaagaggaatgatcacgaagttccggatatacagatcgcatatatgaacgcacgccaaagatgacaagcgccgcaatccagcagactacccccataatcaatactaaggtaagtctacgtacatactcagttgccgtagttaaattcatgcacgaagaggaagagaacgttaagactctgcagattatagtatcatcatcgccattggcgccccattccgcccacaaaataagtgctggtgaaagcagcagtaatcccagccaccatagcacgcgtctggccttgcccaaagccacatagcatctactcgccttaaggaatttggtagctgctttcggtgccaaagcatatttcttgccggaaaaattttctgacgtatcttccaggccatgttttttcccaatgtcatcgatcatagccggattcgctttgcaaatgtggcgttcgtttccggcatcgccctccgccttgatgccgtccgttggcccggtgctcccgcgctcattcgatggcttgtccatgtcccctccgatcatccgagtctgtcactcggccagcgcgcccgttctatgcgcgccgtcgccggccagtctagggccgtgcgacgcgaacggggaggcccgcgccgtttatcggcacggaacctccccgctcgcttttgtcaggcggtcagccgaagatcagcccgtgttctgcaggcctgctgcgacaccggacacggtgcacaggatcaggtaggtgtagttctccttctggccgtgcgtgagctcttccttgtccacgcgcttgcgtagcgagccgagggcgagcacctgggtgacggacagcgcgtccacgtacggcgagcggatgcggatggcctggccgagcacgtggcggtgctgcagcggccattcgtcgccgacgatcttgagcacccacttgcgggtgagctccatctcgtcgaggaccttcttgttgaggtcctcacggtcgccgagggcgaggtacatcttggcgatgcgctcgtcggtcttggccagcgacatttcgatgttgtcgatgaacgtggagaacagcggccactcctcgtacgcctgacgcaaggtgttcaggtcgccgaactgctcgcacgcggtgccgaggccgtaccatgcggccaggttgatgcgggcctgggcccaggagaagatccacggaatggtgcgcaggtcgtcgagggacttggcgcccagaccacgctttgccggacgggagccgatcggcagcaggccgatttcggtcagcggcgtgacggtggagaaccacggtgcgaagccgtcggtgttcagcaggtcgaggaagcggttgtgcgcggcctcgtcgagcttgctggccatgtcggcgtacttcttggtcatatccgtgttgcgcttctccacgctcggagcggactgcagcagcgttgcggctgcgacggactccacatggcggattgcaagcaccgggttgccgtagcgggcgaagatgacctcgccctgctcggtgagcttgaaacggcacttcacggagccgaccggctgtgcgagcacggcgcggttggccgggccgccgccacgaccgacggcgccgccgcggccatggaacagggtcaggtcgatgtcgtgcgattcggcccacttggcgatgcgctcctgcgcggagtgcagggcaagggtggcggaggtcgggccggcgtccttcgaggagtcggagtagccgagcatgacttccatcttgccgccggtggccttcagacgagcctggacctccgggatcttgatcatttcctcaagcacgtccaccgagttctgcagatcctcaagctgctcgaacagcggaatcacatcgatggtcggaacatcctcggggtgggagaacgccagacggttcagttcgtacacgtccttgatgttctgggcgctcttggtgaaggagatgatgtaacggcgggcggccttgatgccattgcgcttctggatggaaccgagcgcgcggaaggtgtcgagcacctcgtgggtcatcggctgcagctcgccacgctcaccgtgcaggccatgctcgcggatgtcctccagagcgcgggaatgcacgacggaatgctgacggaactccatctcgaccatgtggaagccgaaggtctcggcctgccagatgaggtcctgcagcgggccgtaggcggaacgcttggcgttggcttcggcgagggagcgctgcacggtcttcagatcggcgatgtagtcctcgcaggagtggtacatgaggtcggcgtcgcggtcgatggtggccttcagacggtctgccatgaccagcatgacggcgcggtgcagctccttggtggagatcagcgcggccttgtcggtcagacgctcgctcatttccttctggtggttccacagggacttgagttcggcgctcggcggggtggtctcggcctccatcgtcaggttcttgccgacgcggcgggtctcgatctccagcgcgcccagcacgtggtcgctgaacttgcgggccacctgacggctcaccttggcggtgacgttcgggttgccgtcacggtcggaaccgatccagcttcccggatggaagaacgccgggcacaccggcggcacgaggccggccttgtctccgaggacccagtcgtcgaaacgacggtagacctgcggaatggtgtagaacagcgtgttgtcgaagatatcaagaatggtgtcggcttcctcaaccggagtcggcttcttcagcgcgatcggggaggtacggaacagcgcgtcgatctcgttgaagagtcgacgggagttctccttcttgtccgagccgccgagcagcttatgcgcttcgagcagctgggagatgcggcggatcttgccttccacggccttacggcgggcttcggtcggatgcgcggtgaacaccggatggaactcgagctggtcgagcagctccttggctctggccggacccatctcgttgatgagctggtggtaggcgcaggtcatttcgttcaccggatcgacggcctgggtgtcgtcaacggcgttctcacggctgtgcagcacggagacacggtagttctcctcgcacagattggccagatggaagtaagtggtgaaggcacgagccaacagctgggcctcatgcacgtccgtcttgtcgatgatgtcgacaaccttctgcaggtcgtcctgatcgggattcgtgtcggtcagaatgccggagaaacgttcgtcgctggccttcagcgcatgttcgcgcacttcatcgaacttggccagcaggttttcatcgaactcaccgagcacctcgcgaagaatctgcagacacagatccatttcctctttgagggatgcgggaagatcacgctcctcagggcccttggtgccggtgccggacgagacgatagccgcgtccgcaggcgtgatctgttcgttttcagttgtcatcagacctccttctccaaaccatcgggttgctcggtctgtcggtccttcgcggcacctccgcgattgttttggccgtctgttgcgagcccacagccctaagcttggtgggtaaatgctcgaccattgtaggcgcggcaaatcgacagtttggttacggaaacgccggaatggttcgcatcgtggacattgaatgtccggaaaatgggcatgtgggaatgttcggaaaatatccgaccagcccacacgttagacctgaatagtgtgagcgcactacatgaacatgatgagaacaccgaacgcgttgacagcagcgcgaaggcggtcagcaaattccacacccactccattccgctcgatatggaagacatcgaacgcgattgggacaagccggtaaccgaagccggcatcgcggcgaaagccagcgtgatcgtccgcgtcggcatgcttgacctcggcgccggaacaggcagcttccgcgtccgcgaaatgatgcaccgcatcgcctatccattgggcgtgcacgtgcgcgccgacgtgaacctcaccgacatcgaagcctcctgcacggacggcaaggaccgcatcaccgaagtcgtcgacctgccgaccaccggcgtcaacaccgaacgcatctggctgctcgagcacttcgccgactggttcaacgtcaacctcggcaaaggctctatgtaccacagccaatccgacgtttccgaagggctgatgcagcatctcgacaagcgcgacgcctcgcaggtgtcggccgaactgtccaagcagctcaaggaacggcagaaggccgagcagaaccaggaaggttccgacgatcccgtgctcgacgcgctggaaatggtcacggaacgcgcgcaggaaggcgattccaccgcacgtccgctgcacatgcgcgatatcgaggcggcggccgcggccggacgtagcaatggcgattcggtcgcggaaaagccgcgtaagaaccgcaactgcaaaccgccgaaggaatatgccgagcatttcgaccatatcgggaaagccgcgggcgaatcgcaaggcgtcaccgtacggcaggcgcacgagcgactcgacatgatcgaacgtcgcaaaccgctgtattcgccggccttcgcgggactcgcgtccgcctgcgcctgcgcatccttcgtgttcctgctcggcggcggcccgtacgacatgatcggcgcgttcgtcggcgccggcctcggccactggctgcgtcgccgcctgttcgcccaccatctcaaccaattcttcgtgacgttcgtctgcgtggccgtcgccgcgctggcatgcaccggcatgctgcgactgatcggcctgttcgatccgatcgccttgcagcacgacaccgcgtatatcggcgcgatgctgttcgtcatccccggattcccgctgataaccggcgggcttgacatggcgaaaatcgacttcccatcaggcgtgcaacgactcacctacgtgctgtgcatcattctgatggccacgttggcaggatggatggtcgcctcaatcgtgcacctgaatccgcaaggattcgagccgcttggactgaaccccgtcatcaactgcctgctgcgcatgctgttcgcgttcatcggtgtgtggggcttctccgtgatgttcaattcgccgcagcgcatgtgcctcgtcgcagccaccatcggcgccatcaccgataccttgcgattggagatcgtcgacttgggcgtgcccgcggaagccggcgcgttcatcggcgcgttccttgccggcctgctcgcctccgcatggcgttcggcggtgcgccacggcctacttgctccgcatttgggatatccgcgcatctgcctgacggttccgtctattgtgatcatggtgcccggtttgtatatgtaccaggccatgttccacctcggccagttcgatacgctgaacgcgctcgattgggcgttccgtgcgttcatggtgatcatctgcctgccgatcggcctggcgatggcacgagtagtgaccgataaatcctggcgctacgacatttaataacctgcagaagggtaaaaacacttggtaaccaaagatttctgggtgctgctggccatggtcttgtacttcgcggccatgctgaccatcggcttcgtctactccaagaggtccaattcctccaccaaacagtatttcgcgggtgggcgtggcgtcggaccgtggctgacggcattgagcgcggaagcctccgacatgagcggctggctgcttatgggcctgccgggcgtcgcctacttcaccggcgcggtcgacccaatgtggacggccatcggtctggcgcttggtacttacctcaactggaaactcgtcgcacgccgtctgcgccgctactccgtggtggccggcgacgcgatcaccattcccgacttcttctccaagcgcttccatgacgatcgcaatatcgtatccaccatcgctgcgctcatcatcctcgtattcttctgcgtgtacgtcggcagctgcttcgtgaccgtcggcaaactcttctccacgctgttcggctgggactaccacctgaccatggtgatcggcgccgccatcgtgttcgcgtacaccatcatcggcggctatctgtccgtggtcgtgaccgacttcatccagggcctgctcatgttcttcgcgctggccgtggtgttcatcggctccgtggcgtccgccggcggcatcgacaacaccgtcgccttcctcaagggcattccgggattcctcgacggcacgcatgtggccacgccgatcctcaacgacgccggcgagcagatcgtcaaggccggacaggccatgttcggcgcgcccgccgactacggcatcatcaccatcatctccatgctcgcgtggggcctgggctacttcggcatgccgcaggtgctcgtgcggttcctgtccatccgcagttccgaggaaatcaagaaatcccgcatcatcgcaaccacgtggtgcgtgatctcgctggcgtgcggcgtgtgcatcggcctggtcggccgtgccatgatgccgacgcagttcgccacgcaggcggccgcggagaacatcttcatcgtggtgtcgcaggcgctgctgccgagcttcatgtgcggcatcgtcgtgtccggcatcttcgccgcgtccatgagctcctcgtcctcgtacatgatcatcggcgcctcggccgtcggcgagaacatcttccgcggactgctgcaccgcaaggccaccgaccgccaggtgatgatggtggcgcgcatcacgctgctcgtcatgttcatcttcggcatcgtggtggcgttcgaccagaactcctcgatcttccaagtggtctcgtacgcgtgggccggcctcggcgcatccttcggaccgctgatgctcacctcgctgtactggaggcgcaccaacaagtacggcgcgattgcgggcatgctgtccggcacggccaccgtgctcatctggcacaacctcgtcaagccgctcggtggcatcttcgccatctacgagctgctgccggcgttcatcgtctcgctgctgttcatcgtggtggtctcgctgcttacgcccgcgccaagcgcggaagtgctgcacgaattcgaccactatctcgacgatccggacgaccgccacgtggacgacgacctcgtggccgccgaaatcgccgcaggggagaagcgctcgcagatctaagcgggatggcatccggcggaaggcgtaatccgccatttgtaagcgaaatgggtcgggaaccgatgtggttcccgacccatttctcgttgtgaacgtgcgaacacgtaagcgtgcgacggccgcacggctcaaacgcgctcagtagcgcatgcccatggcgtcgcgcacctgctccagcgtctcgttggcgatggcattggccttcttgttgccctcggcgagcacgtcacgcacgtaatccatatctttggccagctcggcgcggcgttcgcgcatcggggcaaggaagttgttcacggattcaaccacgtacatcttcagtgcgcccgcgccggaatcaccgatctcctcggcgatttccttcgggtcgcggccggtggtcagcgctgcggtggtcagcagtgcggagacctccggacggttgatcggatcgaaggtgatcttgcgttcggaatcggtgcggctcttcttgatgagcttggcggtctccgctgcggtggcactcagcatgatggagttgccacgggatttgctcatcttctggccgtcgaggcccggaatctccggcgcatcggacaggatggcgtcaggctccgggaacaccgggttcttcttggcgtaacgctcgttgaagcggcgggcgatggtgcgggtcaattcgatgtgcggcagctgatccttgcccaccggcacgatattgcccttgcagaacaggatgtcgcaggcctgatggaccgggtaggtcagcagcaggccggtcagtgcgtggccggaagcctccatctcggctttgacggtcggattgcggtgcagttcggactcggtgacgagcgacaggaacggcagcatgagttggttttcggccggcacggaggagtgcgtgtagatcatggtcttttccggatcgatgccggcggccatgtagtcgaggatcaggttgagcacgttgtcctggatgtgctcggtggtgtcacggtcggtgatcacctgatagtcggcgatgatgatgttggtgtgcacgcccttgttctgcatctccacgcggctgcgcagcgtgccgaagtaatggcccatgtgcagacggcccgtcggacggtcgccggtgagcatggtgaacttgcccggattcttttcgattgcggcgagggtttcatcggaacgcttctttgcggcgaggaagctcgcgctcatttcattgccgacagcagtgatctgctgctcctgggtttcgtccgtcatacgtgtccttttcttaagaaaatcaacgattttatcgtaaaagtctgagccgacaacgaaataatgcgcaataagtggtactctcttgtttgatgaattgatagcacagtaatttcagggggtcagatgggccgcggacgtcagaaagccaaacagcagaaaatagcccgaaagctcaagtacctgaccaccgacgccgattacgatgagcttgccaaggagctcggtgcgcaggagcccggttctggttccttcgacccatttgccgatatcgaagccaagtattctcacgatgtggacgccgaagatgagaccgttggggacggccaaacgtcttccgattccgccgatgaccttgacgaatacgccaagtgggccgcggaagccgcggcgaaggccacgagtggcgagtttccggcggcaaaggccgcgccgaagccgcacaagcccatcccgatgccggtgcccagcgcgctgaagccgaagaagcaggactgactgcacagattttttcaacgaatggcccgtggtttcgaccgcgggccattttttattatttcgatttcgattgtcgggcgattgtcgagctcgtcccgccaaccatcaccggtcgcaccacgccgcgacctattcctatgccagcggcagcagcccgctcagatcgtcgcgttcgccgacggcggtgatgcgtccggcgtccttttcctcgccccagctggtgatgccggtggcgagcctcatccacacgtcggggtccagttcgatgacgtccggcggcgtgagattgtgcggatcggacgccggcccgtcgaggatcttgatggcgccccacggtgccacgcgcacctccacgccttcgcccggagccttcttttccagcaggtatagcgagtagcgcaccgccatcgcccacagctggcgcggcagacgcggcgagaagttgagccggaaatcgaaagcggcgtcgtcatcggccggcagctgctcgctgaaaatgttgtgcgccgcgtcctgccactgttcgaaggcggcgcgtcctttgcccaagtcttgttctcgtatgacagccataccggtattgtgcagcccgcaaacgactatgatgggactttgcaaacgatgtagtcgtaactaaataggggtttgaggggcgattttcctgcgattgtggtgccctcgcttaatgggcgccatacgttgcgttgcagtttttgcaatgttttttgcaaacgaatgccggcttacgattgctgggaatttcgtctttttatgattacgtagtatgctgtacatgagaacgtatgcatgatgttacttagtgttcatgcggccgcaaatgcaaggacgctgaagtaaggcataatgttcctggagagtatccgtcaaagggagtcaatcaatgactgaaattaccgcaccgaagtccgcggtcaccgcggaacagttcgctgacgagattcgtgagcagctgaagtacacccagggcgtcaccgtcgagcaggccaagccggccgacgtgtacgttgccgcgtccgccgcagtgcgtcgccatctcgtggattcctggatgaagacccaggccgacatggtcaacggcaacaccaaggccgtgggctacctgtccgctgagttcctcatgggcaagcagctcgagaacgcgctgctcaacgccggactgaccgaccagttcgacaaggccgtggaagctctcggcttcgatgcgcaggaagtcatcgacgccgaatacgagccgggactcggcaatggtggcctgggccgtctggccgcctgcttcatcgactccctcgcctccctcggcgtgccggcgttcggttacggcatccagtacaagtacggcatcttcaagcaggaattcgacgagaacggcaagcagatcgagaccccggattactggctggccaacgaagagccgtggggccacatcgactacaaccgcgaccagaaggtctccttcggcggcgaagtcgtcgaagagaacggcaagaaggtttggaagccggcttggtccgtgcgcgccgtcccggtcgactacatggttccgggctacgcctccggccgcgtgaacaccctgcgcctgtggaccgccaagagctacgacgagttcgatctgctcaccttcaacaagtccgagtacctcgacgccgtcaagccgcaggtcgaggccgagaacatctccaagatcctgtatccggaagactccaccccgcagggcaaggctctgcgcctcgagcagcagtacttcttcgtgtccgcctccatccacgacgccatccgcgtcttctacccgggccaggacaagccggatctgaccaccttcccggacaagatcaacttccagctcaacgacacccacccggtcatcggcattccggagctcatgcgcgtgctcatggacgagtatggctacgattgggacaccgcctggacgattaccaacaagaccttcaactacacctgccacaccctgcttccggaagctctggaagtgtggccgtccaagctcatcggcgaactgctgccgcgtcatctcgagatcatcgagaagatcaacgaccagttcgaggccgagctcaaggccaagggcgttgccgaggagaccatcaaggacatggccatctacaccggcgactccgtgcgcatggcctacctggccacctatggcggctcccacgtcaacggcgtggccgagctgcactcccagctgctcaaggacgtcaccctgaagaacttctccgacgtgtatccggacaagttcaccaacgtgaccaacggcgtgacccctcgccgcttcatcaagctggccaacccgcgcctgtccgacctcatcaccgaaggcctcggcaccgacaagtggctgagcgacctcgaactgctcaagggcctcatcccgctggccgacgatgacgagttcgtcaagaagttcgccgccgtcaagcaggccaacaaggtcgacttctccaacttcgccaagcgcaagtacggcttcgacatcgacccgaacaccatgatcaacaccatggtcaagcgtctgcacgagtacaagcgccaggccctgaagatcctgtccgtcatcgccgactacgccgacatcaagtccggcaaggtctccgccgacgacatcatgccgcgcaccatcgtgttcggcgctaaggccgctccgggctactacctggccaagcagaccatccagctgatcaacaacgtcgtccgcgtcatcaacaacgacccggacgtcaagggcaagctgaacgtctacttcccgtggaactacaacatcgagctggccatgaacctcattccggccaccgacctcgacgagcagatctcccaggccggcaaggaagcctccggcaccggcaacatgaagttcgccctcaacggcgctctgaccgtcggcaccctcgatggcgccaacgtcgagatccgtgagcgtgtgggcgccgagaacttcttcctgttcggcatgaccgagccggaagtctctgcgctgtacgccaagggctacgacaccaagggtctgtcccgcgagtactacgagaaggacccgcagctcaaggccgccatcgatatggttgccgacggcaccttctccgacggcgacaaggacacctacaaggacctcgtcaacgattggctgaacaaggattacttcatgacgctcgccgacttccgcgcgtacatggacatccaggcccagatcgaggaaacctaccgcgatccgatgaagtggagccgcatggccgtgctcaacgtggccaactccggctacttcagctccgaccgctccatcgaggattacctcgagcgcatctggcacaccggtccgctcaagtgattatggagcggtcatgaaacgtcgctggcatcgccgacgcacgcatgatcgctttcgctccgtccgtttcgcaatgggcggataagtgatgacgacgaaggcccttgggattttccaagggccttttcgtatgtttttcgcatgtccgattgcgtatgccggtagtgcccgaacgtacgtgccgaacgtacgtggcaatacagcgacagtacgacggaaggccgcaagccaatcgcaatcgcaaaagcaaaagaaaaaccctgtatcgcaagatacagggcgaagcaacaaacccaacgcggcataggtgtgccggggaaaggcgaaatcaagcggcttccggctcagcggcaggagcggcggcagtggcgtcggcctccggctcggcgtccttggtcaggcccaggtcgaccggcgaggagctgttctcccacggttcctcccacgggtcatagtcgggattctgctgcttgtagatgtacagaccgacgacgccagcaagcaaagctccgaagagcagtgcgaagaacttccaaccgttagaagacttgttctccatgacggctcctttcaaggtttccaaacactggctgacctgctcgttcaagccagctctgttccctatcttaattcgtggaatgtgtcgattgggtggatttacgcgccggaaaataccgcatgtgccggtagtgttgagctatggcataccaacgattcagtctgtttcccgattccccatcgttcaaggatctgttctccgcccgatcgctgcgataccggtggcgcaacggcgacccggtcatcaccaccgccatcatggcgatctgcatcgtggtgtggaccatcgaagcggtcctcttcctcgtctggcccgaaggcggcaacgcgttcgtgaacgccggcatgctgctgcccgccacggccgtccggcacccgtggaccttcatcacctcgatgttcctgcaccagccgacctcgctgtggcacatcctgttcaacatgcttactttgtggtgcgtggggcccgtgctggaacgcatgatggggcattggccgtatcttgcgctgtacctgctgtccggattgggcggcggcgccggactgatggtgtgggccgtgtgctcgccgtcgggatggatgaccgccgcatatggcgcgtccggcgcgctgttcggcctgttcgccgcgattctggtggtgtacaggagaataggcatcgatattcgttcgatgctgatttggatgctgatcaacttcctgatgccggtgatcacgccgggcattgcatggcaggcgcatgtcggcggattcatcgtcggcggcgtgcttgcgtggctgctggtcaccggcctgcatgcgttccgcggcaaaagcctgacgtggcgcaccacggtgtacggcatcacggtgttcgtggtggtcgtggcgatcatcgtgggatgcaacgccggcaatccgctgatgcatatgtcacttctgtaccagtaatgcgggaactacacacatgtagttttccacatccgtggataactttgtggataagtgatgtcaaacctgtgggtaagtcggggataacgtggtggattatccacaaggatattcacaaaatggcggaacataaggaatttcctatgtgaaaattgtggataaccgatatccacaccccacaaaaatggggaaaatcgccgccggtatttcgtggtgcgacgttgactcaggcacaaaatatgggcgttatccacattcatccacatttgtccacttgttatccacaggaaagataagatgacgaaggcaatcgacaaggacgcaataccgatgcgccacggacgcaggatacgcgtgcgacgatatacgtgcgacatggcagatacttgcgaagaaggggagaggaaccatgagtgacggaccactgctcaacgacgtgacgcgcgccttcgccgaggcgcatcgcaatgaagatgtgcgtgacctagcgctcaaaaccaaacggacggcggacctcgacttgccggccgcgctcgaccagatcgcgggctggcaaatcgcccgcaacaaactgccgcaatgggccgcctgcgcggatatcgtctatcccgcgcatatttccatggaacagtgctcatcgcagttcacaacgcaatacaaggccgaaatcgcccggcgtctgttgcgatctctgccgcaatcggcgggacagacggccaacgacgcgaccatgacggacctgacaggcggattcggcgtcgatttctcatatctcgcccgaggattcggtcacgccacgtacgtggaacgccaatcgcatctatgcgaactggccgcgcacaatatggcggcgctgggcctcacgcaagcacaggtggtgtgcggcgacggcgtcgaatacctacgtgcgatggagccggcgcagctgatctacatcgacccggcccgccgcgacgagcacggcgcccgcacctacgcgatcgaggactgcacgcccgacgtgctggcgctgcgcgatctgctgctggctaaggcacgatatgtgatgatcaaactgtcgccgatgctcgactggcgcaaggcggtcgacgatttcgcgggcactgtggccgaagtgcacatcgtctccaccggcaacgaatgcaaggaactgcttctggtgctggacggcaaggctgccggggcaacgtccgatgccgcagcggcagacacgcgtgcgccgcacgtgtactgcgtgaacgacgatcagcgactcgactacgatgcggccgcctatacgcgcggcctgcgcatcggggacgcgccgctgccgcacgagctgcgctacctgtacgagccgaacgcgtcgatcatgaaggccggctgcttcgacgtggtggaagcgcgattcggggcggtgcagatcggcccgagcagccacctgttcgtatcggacgagccggtcgatggttttccggggcgcggttttgcgattgaaacgatcggcggtatgggtaagaaggagctgaagcgattgctgtccggcttggaccgtgccaacatcgccgtgcgtaatttcccactcaccgcgccgcaattgcgcaagaaactcaagctcgccgacggcggcgacgcctacctgttcggcaccaccatgcaaggcggcgaccacgtgctgattcggacggcaaaaatcagcagataatcggcgggtaagcggcggctttccactcgacaggaaaccgcttttcctaaagctgaagcggggcgatgcagacgcggtaagtaaagtggatgaagtggatgaagcggatgaaaaaagacgccggatcgcaaagaacccggcgtcttttgaataagcctcgatggaataggcgaaacggagaaaaccgactcagcgccaccacatggtcataatgaaaccgaccatgatgattgcgaacgcgatggccaggttccaagcgccgatgtgcggaatcggataatcggtggtcaggtagtagaccacggcccacaccagaccgatgatcatcagcgcgcagaacagcggcacgaaccagcgcgggttggacttggtgcccttgatgctttcctccacacggcgggtgttctccgcctgacggttcatcatgcgttgcatctgcggtgacagcgaatccttatcaacggtggcgttcagcaccgcttcgacacggtccataggaatatcgagatcgtcatcgtcggactggtcctcgtcaacagaagtcttgtcgacgacatcttcggtggtttcctcgacggcagcggtgtcgtcggcggactgcagatccttctggtcatccgcggtggtttcgtgcagctcttcgtcagccatcagcatagtctcctttaataggctaaaagtcataatagtgggtagactcgaaagcggcgaactcacggcgtaaaactgttcaaaatcaggacaattgttcagtgaaacccggcggattcaggcaggtttggaaaggcgcgtatggcgaagcataccggaaagcacagcgcgaaacggtcgaaggcggccggcgtcgcggcgttcctcgtgctgctgttctccggattcctgctgtccaccaacctgcgcgtcaaccgttccgtggtggtcagcaacgataccgccgaactcgtggaacagcgcgtgaaaaaagtgaactcgctacggtccgaaatcgatgcgctgagcaccagagtcaacgatctgagcaaaacactcgacagccagaacgccgacggatcgcaagacagcgaaagcgccggcaacggcaccatgctccccgccgtggaaggcccgggactggtggtgacgctcgacgattcgccgctatgggagaacatggtcgacgccaacggatccagcgccaacatcaacgattacgtggtgcaccagcaggacatcgaagccgtggtcaacgcgctgtgggcgggaggcgccgaatccatgcagatcatggaccagcgcgtattgttcaactccgccgtacgctgctccggcaacgtgctgctgctgcaaggcaagaagtattcgccgccgttcaaaatctcggcgatcggaccagtggagggcatgagaaaagcgctcgacgattccgaggaagtgtccatctacaagcagtacgtgagcgcgttcggcctgggatggcaggtcgacgagaaaacgaaactgcatttcgacgcgaccgacgcgttgcagcagccgttgcagtatgcgaaagcgctcgaaaacgacaagaacggcgactcgcaagaggggaaataacaatcgatgaaacatgtggcaagccgtggcggacgcaccaaaagcgcgctgtggacgatactcggcatcctcgccgaactcatgctgaccgccgccgccatctgcgcgctgtacatcgcatggcagatgtggtggacgggcgtgcagtcggagcataaccagatcgaaacccgccaatccgtatcctggtccgatccaggaaagtccggcaacgtcaccgtggcgaaggcacagcagggtgacccgcctgtacagccgcaaagcgccacggaaggcgaactcatcgcccaaatctacataccgcgattcggcagccaatggcagcgcaacctggtggaaggcacggacctgacacagctcaacaagcacggcctcggccactacacggattcgcagatgcccggccaggtcggcaacttcgcattcgccggccaccgcaacggctacgggcagccgctcggcgacgtcgacaaactgcaggaaggcgacccgatcatcgtccgcacgcaggattactggtacgtgtaccactacaccagctacaaaatcgtgctgccgacacagaccgaagtggtggcggccaaccccgaaaaccccggcgcaacaccgaccaaacgcatgctgaccatgaccacctgcgaaccgaaatactccacgccgacgcaccgctggatcagctacgccgaattctcctactgggcgaaggtctccgacggcatcccacaggaactggcctcccaaaacgccaacggcacagtcaaattcgtcaacaacgaacagtcgtcgttcctgtcgtcgatcgatacgctgaaaccgtggatcttcggcgcgctcgccgcatacgtgatcatatttatttccgccgccgtcgcctggcgatggccgtatctcgccgacgtgcgcgcaggaagacgaaagaaggccgatttcagcctgtacggcagcctggtgcgactgcagccgggcgtgctgccgatccgtctgctgctggtgctgctgctggttttcgcagcggccgcatcgtgcttcgaatggctgttcccgtgggccgcgtcgactattccgatgttgcaggagatgtcgaactacacggccatctaaaggctgccgctgcgtgagacgcggacgttgctgcggcacggaacgcacgtacactgctgttcaaacgttgattggagcatgatgaccgattccgcacgcattctggtggtagataattacgattcgttcgtctatacgatcgtcggctatctcaagacgctcggcgccacggtgaccgtggtgcgcaacgacgcgatcgacccgtcccagccgggcgtgatcgacgaatacgacggcgtgctgatttctcctggccccggcgctccggccgaatccggcgccagcgaggacatgatccgcctgtgcgcgaagctcgacaagccgatgttcggcgtatgcctcggcatgcaggcgctcgccgaagtgttcggtgccatcgtgagccacgcgccgaccatcatgcatggcaaaaccagccaggttgagcatatcgacgatgagatcttcgacggcgtggccaatccgatgaccgccacgcgctaccattccctggcagtggaaccggagtccgtgccggacgatctggtggtgaccgcgtggacgcagggcgaccacatcgtgcagggcatcaagcatcgcagcaagccgatgtacgcggtgcagttccatccggagtccgtgatgacccaggacggctaccgtctgctggccaactggctgaaggtgtgcgggcaggattccgcggttgagaagtcggctggattgcagcctaaggttgttgagtaggaggctgtagctcgaaggtagtctgcaatccgcattccgcagagaaccggcaaggtttttacggtacgggatatgaaaaaggagcggcgttgagccgctcctttttcatcatcactgattagtgctgtggttgctgctgattgttgtcagtggtgttgccgttgctattgtcaccggtgtcggtggcgggctgggccttggtggtcagcgtgatggtggagccgttatcggccttgctgccaccattcgggctcatggaagcaaccgtgccgtcctgcgggccggaaacgttgacctggaagccgtagccttccagcagagccttggcatccgcgtagttcataccggccacgttcggcacgctggtctgctgcttgccggtggacacccaaatggtcaccgcggtgcccatttcgacggtgctgccggaacccggatcgatgcgggtgactgcaccggactgcaccgaatcggaatactcgctttcgatggtgatctgcgtcagaccagcctgcttgagctgcgcgatgaccgaatccttggcctggcctaccagaccatccggaatcttggtcatgccggacgaaatgtacagcgtgatgatggtgcccttggtctgcttcgaattcgcggccggatcggtgttcaccacctgatccttcgcaatggtggcgttatccacggtcttgacgttgcctaccttgaatccggcagcctcgaggatgctcttcgcctcctcctgggtcttgccggacacatccggaacagggaccgcttgtgggccagtggagaaccacacggagaccgtggagcccttcgccactttcctgccgccttgcggattctgcttggtgatggtgccctttggctggctggatgtggcatcgtcacgggcgtcaagcttcagaccaagggccttaagctgttcttccacacgcgcctgggaaatgttcgacgtgtcggtgaagtccggcacggacaccagatccgcagtgttcttatgcccgttcaacgcgaagaaaataccgatgacggccagcaaaacaacgatgctgccgaccacggaagcgatgatgatctgcttcttcttacgctcctgcacggccttggcacgctgttccgcacgggtcttcgtttcgactccgccattcggattcggcacggcctcgaactggccggtgaccggattgaacgcctgcgtcggcgcatccgtcgccggcgccatgggcacggtggctgcatccatttcggcctgcttgcgggccttcatgttggtcaggtcggtcaacgggttgaacgcggcagccatcggcacaccgccgttcatgaacgtcagcagatcgttcttgaactcggaagcggtggcgtaacggttctgccgatccttggccatcgccttcgcgcagatcgaatcccacatcttcggcaggcccggcacgatcgtgcttgggggagtggcgacttccgacacatgctggtaggcgatcgccaccgccgaatcgccggtgaacggcggccggccggtgagcatttcgtacagcacgcagccggcggaatacaggtcggaacgcatgtcgacgctttcgccgcgcgcctgctccggagacaggtattgcgcggtgccgacgacgccctgcgactgcgtcatcgtggccgcggaatcgtcgatcgcgcgggcgatgccgaagtccatgaccttgaccacgccctgctcggaaatcatgatgttgccgggcttgatgtcgcggtggatgatgcccatgcggtgcgagtattcgagcgcgttgagcacgcccatcatcacctgctcggcgtcgcgctggctcagcgcgccattcaccttgaggatgtcacgcagggtctgacccttgacgtactccatcaccagatacggcagatgctcgatctcgccggtttccgtggtgacggtttcctcgcccgaatcgtagatgttcacgatgttcgggttgttcatctgcgcgacggaatgggcttcacggcggaaacgctcaaggaagatgctgtcagtggcgaaatcggcgcgcatgatcttgacggcgacggtacgccccagacgcgtgtcggtcgccacatgcacttcggccatgccgccacggccgacgagttggccgagctgataacggcccccggccagagaggtaggcatgttgatgttcatccctgttccttccaatcattgctcacggagatatggggtttgctgaccacacgtcggggaagccttcctcccgaagagacgaccatcgtgtcggccagctgcgtctgctggtcgagcagacggcgttcgatgcgggacagggtgcgtgacaccaccagcgcgtccttcggacggtccagcgggtccttggccaacatcgacatgacgaattcacgcaactgcacatcgacggtgtcgggcagcggcggaaccggattattgacatgtgctgcggcgatgtcgaccggtgtggcgcccgtgaacggacggtgtccgcacaggccctcataggcgacgacgccaagcgaatagatatcggattgcggcgtggcatgcttgccctgcgcctgctccggggaaatgtactgcgcggtgcccacgaccatgccgtcctgcgtgatctgctcctggttggtggagtaggagacgccgaagtcggtgatcttcacctcgccggaatcggacaccatgatgttcgccggcttcacgtcacggtggatcacgccatgggaatgcgcgacgaacaggccgcgtgcggtctgaatgagaatcggcagcagcttgatcgggtccatcgggccgttctgctcgtggtacaggtctgcaagcgacttgctcggcacgtattccatgatgaggaatccgatgccgtcatgctcgtaatattcgaacagcgcagcgatgttcggatgcgcaagattggcggaattatgggcttccgcgcgcagacgaagcagtttggcctcctgggtgacgcccaaatcgccacgtagcgccttgatggccaccggacgtccaagttggatgtcatagcctttccacacttcacccataccaccttgggccaggcgggaatctaacctgtagcgtcggtggatgagctgtccttcaaccagtttcattctgccagcgcctcctgcatcattgctttcataatcggtcctgccgcgaacgagccgtacaggtccacgttatgcaccacgaccgccaccgcgatcttcggatcgtccgccggtgcgaatccgatcacccagccgtcgatggacgtattgccgtttccaatctgcgcggtacccgtcttgacggccacctgcacgccgttgatggccagattcgtgttctccttggtgaccacggcctccatcatctgggtgagcttgttggccgtatccgcactgaacgcatgggacatgaccgtgggcttggtctgcgaaatgaccgacaagtcggcggaacgcacgcggtcgaccagcgtgggctgcataagcttgccatcattggctatggcggcggccaccatagcattctgcaacggtgtcaccacggtgtctccctggccgatagacgccaatgcgagcttgtcgtcgttgatgtcggtggggaacttcgacgtgaccgacacccacggggttccggtgtaatcggaaccgtccacggtgatcgggctgtcaaaaccaagtttcttggccatggacgagacggcgttgtcgcccaacgacacgcccaactgggcgaacgcggtgttcgacgaatacgccagcgcgtcctccatggagatcttgccgtcagcgccgtcggcctgcggtacggcgttggtcagttgcgtgacggtgccgggaagcgtgtagcttgctcctgccggaatctgcgtatccggctggtattggccggtttccaaagccgcggcggccaccaccgttttgaacgtggaccccggaggatacagctgcgaagtggctcggttgagcatcggattggtggcgtcctgggacagcacgccgtagttgctgttcgcctggctcatgtcatggctggccagctggttcgggtcgtagctgggcgtgctgaccatggcgaggatacggccggttttcggctcgatggccactgcggcgccatccgtgctgccgaggctgttgtatgcggcctgctgaatcttcggatcgatggacgtttcgatattggcgcccttgttctcctgcccggtgaacagcgacttgaaccgctgccagagcagctgctccgactggcccgacagcagcgagctgcgggacgcttcgacgccgctccagccacgctggctgatggagaagaatccggtgaccggcgcatacagttcgccggcggaataggaacgctggtacgagaacgaatcgttggaaggatcggattttgcgatgaccgatccgtccgcggcgagaatggacccgcgcggtgcgccgtattcgtggtacagcgcgcggacgttacgtgcgtcgttggtgagctggttggctcggatggccatgatgatggtggtggacatgcccagaatgacgaacaaggccaccacgatggtgaacagctggcggagcgacttattcatgcgatgctccttgctggtcgatcgtcggcaggactccggttatcggaatcgtcggattggattgatcggtctggccggcttggctggtttgattggcgggcacggcatgacctgcttgtccggctgcgcccgcatggtttgcccgcacggccgggatggccgaagccttcgccgcacccgaacgcgtattgccggcgatttcggtacgacggttccgctcgcgttcgcgcaacaccctgacggcttcctgctggaatgtgtcgctgtcaatctcggattccggcctgttcgcggaattggagatgacgatcagcagcgcggccagcatgtagtttgcgatcagcgacgaaccgccggccgccatgtagggaagcgtcagaccggtcagcggaatgaccagcgtgataccgccgaccacggtgaacacctggaaggccatggtgaacaccaagccggacgcaagcagcttgccgaagccgtccttgattttcatcgcggtgatcatgccggctgcgatgatcagcagatacagcatgagaatggccatcaggccggtcaatcccagctcctcgcccaatgccgcgtaaatgtagtcggaatttgcgatcggggtgatcgacgggtggccctgaccgaggccggtgcccatcagaccgccggaagccaagccgaaaatgccggtgacgagctggtatgagccgccgtattccttgttgtattgagccgcggagaacgggtgaagccaggcgtccacacgcgagccgacgtggctgaagatgcttgccgccgccaccgcgccggcggcgaaggcgatgaatccgatgacgatccagcttttacgcccggtggccacgtacagcatggacacgaacatggcgaagaacatcagtgacgtgcccagatcatgctgcaggaccagaacgcccatggagacgatccacaccacgatgatcggtcccatatccttgatgcgtggcagttggatgccgagaatcttctttccgccgacggcaagctggtcgcgatggtcgaacagatacgaagcgaagaagaacgccaggaacagtttggcgaattcgctcggctggaacgatcccaagccgggaatcttcacccagatgcgtgcgccgtactgttcggaaccgaccaccggcagcattggcgacagcaacagcacgatgccgatcaccatgctgacgtacgagaatcgccgcaatacgcggtaatccctcatgaacaccaccagcaggttggcaaacaccagtgcgatcgccaaccaaagcaactgtcggaacgccactgtggttttggtgtcttggtcgaggcgtgcgatcatcgtgacgccgatgcccgtcaataccagcacgcagcacatgaccgattggtcggcgtgcggctggaatcgcagcagcagaccccaggcggtcaggaacagcgcgcttacgaacgcgagcatccacacatagttttgcgggaagccgttcgtggtgcgttcaaacatctggaagaacgccaccgcgcacagcagcatgctgaacagcagcatgccaagctgtctcaagcgtgttgcgatcatgacttgtcaccgcccgacttgttggtctgcgcggcctgatcggcggcctttttcgccgcttcgtcctgctgcttctgcttggcggctgcttcgtccttcgccttctgctcggcttcggccttctcctgctgcctcgcctcttgcttgcgcttcgcatcgttcagctgctttttgatcagacgggtatggcttttcgcttcgccgtacgtgtcgaaggagatgccctggtcaagctgttcgcgccagcttggcggcagatcgctggtcttcatattggtgtcggtgacggcatgtgacagtttggcaccgaagatgctcgtcggcacgccttggaaaatcgccactttgccgttgttgtcgccgatgtagtacttggtttggctccaacggtaggtgcccacgcccacgccggcaacgccaagcagcaccagaatgatgatgagtatggtgatgatgcggttgcggaatttgcgcgaccgtttcgtcttacgttcctcgatatgttcgttgcgaatcgccttggcgacttccggatcgttcggatcggcggaaatacgcccgttgcgcttctgcacaatcggaatttccccggtatcggtattgacacggtcgccattgtcttcgcggaccgacgacggctgcgcgacgcgctgttccggctgtttcggctcctcgttgggatccttgccgctgcgcagggccgcggcacgcgccgccggcgactgtttgccttcgcgcagaggcggggcggaagcgaccggttcgttgacgatgtccgcgatggtttccaagcttgcgctggccgcgccgccgaccagcggcgtctgatgcggcaggtcgaacgcgtccgcgtcgagcgcgagcgtcgcgtcggcgatcaccgcggtgacgttgtcggtgctgcccgcacgcaacgccatcgatacgagccgctgcgcgcactcctcctgatcggcgcaggtggacagcacttcttcaagcgtggaatcttccagcacgccgcacaggccgtcggagcacagcagccaacggtcgcccggatgcgccttgcggatggcgatgtcagggcgcgaatcgatgtcgaaatcgcccagcacgcgcatcaccacattgcgttgcggatggttgcgcgcctcggcctcgctgatacggccggtgtcgatgagatgctgcacgtagctgtggtcgctggtcatgcggaccagatggccgtcgtgcagcagatacgcgcgggaatcgccgatatgcgccaatacccagcagccggcgaccagtgccacggacgtgacggtggtgcccatgccggcaagacgacgctcacgtttggctttgccgacgatcgcgtcgtgcgcggccatgacggaagtcgccatcatatgggagacgacctgcacgtcgccgtcaacattgtcctgttcgatgtgcgccagcgaccggatggcgatggtggaggcggtgtcgccgccggcatgcccgcccatgccgtcgcagatggcgatgagatgctcgccggcgaacgcggaatcctggttgttggaacgcacggtgcccacgtcggagacgacggtggaatacatgaacaattgttgcgaagcggtggaagtcggcaaaaacgtcacctcaattcgaaggtggtcgcaccgatgcgcacaggcacgcgcgcgccaagaatcatcggcgcgttcagacgctgatgattgacgacggtgccgttggtggatcccagatcctcgatggcccaacggccggtggcgggatcggtgtagacgcgcgcatggtgggaggaaacgaattcatcatccagcaccacggtgttcgaagcggaacggccaagtgtgatggtgttgccggccagagggacggaactgccggcaagggggccatcgataatgaccagcagagttggtttggcattggttgcggcgcttgccgaaggggctgcggcggctacgggcgcaggcgattcgacggccttgcgcgcggcgcgctccttacgacgatgagcccgcgacttgcgcgggctgagcgtttcgatatccctgtacagcgaacgtaccgtacaggccacgaagatccaaagcagtacgagaaacccgtacttgaggatcgcaaacgttaattcagtgagcatagaaggcggctctccaggttggggctgattactcctgctcctgcgaggaggcccagtacaggatgcgggttcggccgatggtgatcgtgttgccgtcgagcagcgttgccgcctcaacatgatggccttcgacgtacatgccgttggtggagttcaggtcgcgggcgatgacggtgttgccgttgtcggtgacgtcgatctccatgtgacgacgggagatgccggggtcgtcgatgacgatgtcgcaatcggaaccacggccgatgatggtcttttcctcggtgagcagatactggtgctcgccgatctccaacatcgggcaatcctcggtctgcgcgtcggtcgtgaccggcacggtgttgccctgcacggattcgctggaaagccggtaatcgcccttggaaagttcaagatcctcttcgaagatcaccacgaccgggccgacgaacgcgtagttctggctcttcgcatactgggtgaggttgtcggcaagttcattggcgagcgtttcggcgccccactcgacgatgttgttgaaatccggagtgctgagcttgaaacggtactcgttcggggctacggtgcgatcgcgcgtgacgggcatggcttctttgtcgatctcgcgttccagagcgctggaaaggtcgacgggcttcaggtctttagacccgaacttcgcgaaaaccccgttgacggcgccttccacgctcttctcaaatcggtcgagaacactcatacttgtccctttctgtccttgactatcctacgctgtagcctgccgagcgccaattcgaaggctacttgcttgcaaaaatttcatgtgaagggggttgcgtccggggtattggcggcgagtggtgcgtgacggtcggtagattggaaggtatgaatgatgcgattgatgagtttcctgggctgaaggcccgtaccttgcgattcacctgcggcgcgccacgttccgcccgcgcgatcggcgacggttcgcgtgcgctgttcctgcgttcggacggtccggaggacaccgtcacctccctgtggatgagcgtgatcggcagcgatggcgataccgacgagattctgcttgccgatccgcgtacgctgctggctgacgccgacgccgaggatgtgccggctgaggaaaaggcgcgccgcgaacgtgcgcgtgaaggtggttccggcatcgtcggctattcggtcgatgcggccggcaaccgcgtgacgttcaccatcaacggccagctgttcctgacggatatcgcggccggcgtgacgcacggcatcgccatcgacgaaccggaattcaagccggtgctgaacccgcgcatcagccccgacggacgacacatcatgtatacgaccggcacgtatttggtggacgtcgatcttgcggacgtgtcggacacgacggacgcaggcgaagacgcgggcgatgcggtgtccatcgtcgcgtccgttccgcaagacgacgctgacgacgttgccgatacgcaggacggcacgaaagatgacgcgcaaagcgacgcggccgaatcgcaagcaggcgaatggaaaatcggtctcgccgaattcgccgcaggtgaggaaatggaccgttacgacggcttctggtggtcgcctgattccaagtatgtgctcttcgaaaccttcgacgcatcccacgagcagacctggtacatcgccgacccggccgatccaacgaaacctgcgcaggcccgccgctatccgcaggcgatgacggccaacgccgacgtgcatctgacgctgctggaactcggctacgatacggacggctgctactacggcggcatcgcacacaacgtggaatgggaccgcgaatcgtacgaatacctggccgccgtcagctggaccgaaggccacgagccgctgctacttgtgcaggaccggcttcagcagcacgaccaggtgctcgccgtccacgtgggcgagcctatcgtgaccatgagcgcgccggaaaacggcttcaccgacgaggacggcagcgaagtggagaccttctccatcgccatccccgaatacgcgcccggcgaagaacccggcaccacgcgcgtgcttgaggaacatagcaacgactgctggctcgacctgatcgccggcacccccgcatacacgcctgacggccgtctcgtgtgcgcgatgaacgacatggacgccgacacgaaccgtctgaccgtggacggcacgccattcacacccaagggcctgcaggtgcgcgaagtgctcgacgtgaccgacgacgacgtgctgtgcgtggtgcagcgcacgccggaactgctgccggccgccgatctgccgttcctgtggcagtccaacgcggacgatcacgacgcccgcagcttcgacgtggtctcgatccgttacgacggcgactgggagccgctcacctacgttcccggacagtggacgatgagccgcgccggcgacggttgcgtggtgaccggccgtggcatggacgatgccgcgatgcagatgcagcattgcatgaacgtgcgcacgacggacggtgatggtgatggcgtcgacgccgccgacatgatgtcgatggtggtttcgccgatcgaaaaccacgccgaaacccccggtttcatgccgaacgtgcgattcgtccgcctcggcgaacgcgccctgtacgcggcggtcatcctgccgtcggcggacagcgcatacgcgcatgccgaccagttgccggtcctcatgaagccttacggcggccccggtttccagcaggtcgtggaaagccagtcgttctactgggacgcgcagtggtgggccgaccaaggctacatcgtggtcaccgccgacggtcgcggcaccaccggccgcggaccgaagtgggatcgcgcgatctacgaaaacatgaaagccgtgacgcttgaggaccaggtcgacgccgtgtacgcgctgcccgacgcgcttgcctcgatcgccaccaaaaccggcgttgccgtgccgaaacccgacctcggccgcgtggcgatgatcggctggtcctacggcggcttcctgtccgcgctcgccgtgctggacgcgcccgacaccttcgccgcggcctgcgcgggcgctccgccgaccgactggacgctgtacgacacgcattacaccgagcgctacctgggactcgatccgaccacgtacgaacgtaacagcatcgtcgcggacgcgccgaaactcagtcgcccgcttatgctcatccacggtttcgccgacgacaatgtgacgatcgccaatagcctgcgattgagccaggcgctgatggcggccggcaggaagcacacgttcctgccgctcaacggcatcacgcacatgaccaacgacgagacggtggcgcgcaacctgttgctgctgcagcgcgacttcctcgccgacgcgctggtctgacggtgttccggcggaactgacgttccgatacaaccgaagaaaaaaaagaacgcgtccccctgcgattcgacggactgccaagtatccgtcgggtcacagggagacgcgtaacccttctcaatagggaagataggatggcgtgaacacccctgcaagtaagggtgtaccacatctgtgtagcaccttttgtagtaccctttcgtttctcgcgaccgtcggagccagtcacgattcggggtgtccggcaaggggtggcagggtttcgggcaccggaatcggcagataggcgaacagcgtccattcgccgtcgcgcagcgttgtctcgagtttgccgccatgcgattcgagctgtttgctgaaatacgcgaggccgtggcctcccggctgcgtgcgatccgtttcggtggtcctcgcctggttgatctgcgtgatttcgacggcgttcggcttgagtatcaccgacaggtcggctttgctgccggactgggcgtgacgcgcgatgttggcgtaggtctcgcgaagcagatcattggcgattccggccaggctcggggaggcgcttggcgcaccgcccgccacatggaggatcgaggtgatgtcgaagccgagcgcgcgtagacgccggtcgccgccggccatcgtggctttgagcaggtcggagaaggccttgccgtccgcatcctcctcaaggacggtgacgtccatatccagttcgtcgatgacgcgatgcacgttggtcagggcggacaggatgtaatcgttgacctgcgtccatttgtcgagctcatcgcgtctttcgtccgcgttcttgccgtcgtcaccatccgtcgaggcgctgccatcgccatcgcctccgccggacaatgcatcgatgcgacgttgcgcgacgaaagccgcggcggacagatctcccgtcacggcgtcgtgtatggcttccgcgatgtgactgcggctttccatctcccgtaatcgcgctttcgcctgctccgcctcggcgcggctgccggctacggcctggttccatcgcaaaccgcatccgagcatcagtaccaggctgaccatggcgatgatggccacgggattgctgcggctcgtgccaaggaccagttgacggaacagctggtcgcctatggaataagcgagcagcagcagcgccacgagattgttggtttcgtaggcgagcatgccgaacgtgtaaaggattcccggcagcgagttgacgtcggctccgggtatgagccaaggtcccgactggctcatgatcagaaacagcagcgacatcgatttcggaaagaacggtgacagcagcagcaccgcgatttcgatgatggtccagacgatcgccgcgggattgtcggtcggggcgagcaccaggcagaacaggatccaccatacggtgatgaccacgatggttatgcggatcggatgccagagtttcggatggtcggcacgcatatggttgtgccaggagcggaaggcgcttacgggtctgggttttgtgggttcagcgtgcatgcgatctcacccacaatgccactgcctggcgtgccgtcttgcagttcagcttcttgagaatgccctgcatatgcttgcgcacggtgctttcggagatgtccagtcgttcggcgatctccctgtccagcatgccgtcggcgcacagggagatgatttgctcctcgcgcacggtgagccgcggtgaggtctcctcctcgcgtctgatgcgcacgttggccagggcgggaggttcgaatccctccataacgttgcctccacagagccgctcgatggccttcgccagctgatcggaatcctccttgccgatcagtccctgcgctccggcttccatcagcctgctacggtagctgttgatggagaagctggtgatgcccagaatcggcagatgcctgtccatgagacggatccgatggcagatggccggcccctgcaagccctccatggacatgtccaatacaagcaggttgagattgtcgtcgttcctctggcaacgttcgatcgcttcgtcgccggaagtggccgtccacaccacgtaggccgtggggaccttcgcttcgatgagaaggctcagcgattccaacgcgcgaggatcgttgtcgaccagcgctacacggtggatttttggtatgggagctgcggatttcgcgggattcatcgcatggctcactttccacacagccagtaaagcggcggcgggcagtcgatgatggcggatgcggttcctctcgccgcgtcggcgaagatggcagccttcccgttggaaggggtcatcgttccggctggctgcatggtgcagagcatgacgaatgccacacacaatgacatgattttcataccgacattgtacgggggagcgcgtccacgagtgaggaggcgcgttcgatccgtggagccgaagcgtggggctctgaaggctgttcatgtgggattcgtatgatgaaagcatgactcttaggctgctcgacgaggcgaattacgacgccgaaatggaaagcaaggtgctgcccgcgctggacgcctgcatgacggaaggatggatggatccagccaccgttgactggaacggcgacgcgctgcccaaactggacgaacccggccggttgcactattgctgttacgacgcggccaaattcgacgtgctgcgtgaggacggcgcttcgggcgtgttccgcggtgcgatcgtcatttcgcacggattcaccgaattcgcgcgaaaatacagcgagatggcatggtatttcctgctggccggctattccgtatgcatcctcgagcatcgcgggcacggtcattccgtgcatgacgtggacaatcccagcctggtgtggatcgacgattggcgccggtatgtgtccgatttcgcagccttcgccgacactgtgggccgcgaatacgcgtgcggcgagccactgaacctgtactgccattcgatgggcggcggcatcggcgcggccgtgatggaacactatccgagcctgttcgacaaggccgtgttgtccgcacccatgatcgcccccgtcgtcggtatgccgacatggatcgcacgcatcgctacaggcgcgttgtgcggcttgggattcggcaaagcgcgcgtattcggtcacaccgatttttcccccgaactcgatctcgacgagcataagggcgcgtccgaggcgcgcgttcgctggttccacaagcagcgcgtcgacgacgtggcatgccagaccaacgcggccaccttcgaatgggcgcatcaggcgatggcattgtctcgagccgtactcaaaccggacatgtgcggtgcgatcgaaactccgacgctgctgttccaagcgggccgtgacgtctgggtcctgaacggtccgcaggacgatttcgtggaacgcgtgcgcgaaggcggcggattaatcgaaaaaatacggtacggcaagtcgttgcacgagatcttctccatgccgaacacggtggtcggaccgtatgtgaacaagattctcgacttcttcagcgcgcccgcggacagtctgtgagcggctgccactgcaagacacatgcggcgtgtacggtgtgcgatgagcgaacagtgaaggggaaggagccgcagtggcggaaaaaacgttcgaacgcacgccgaaagacctgattatcggcattgcgatgaccctgtgcggcggcgtgctgtggggcgtcaacgccaccgtctccaaaatcctcatgggcacgtaccacgcctcgccgctgtggatcgcatgcgtgcgcgaactggcagccggcgtgcttttcctcacctgctcggccatcatgacgccgaaactgcttaccggcgcgctacgcgatcgcaaatcatatccgcggctgctggccaccgccatcatatgcgtgctgctggtgcaggtcgcctacctcgaatcgatcaactggaccaactccggcaccgcgaccgtgctgcaaagcctgaacctgctgttcgtcttgggggtcgtatgcctgcgcgggcggcgactgcccggcgtacgggaaggcatcggcgtggcgctcgccttcgcgggaaccgtgctgattgcgaccggcggcgatttcaccacgctgaaactgccgttggtcggcctgatttggggcgctatcaacgcggcgtccacggcggccatggtgtttcttccggtcaagctcatcgaacgttggggcaacttcaccgtcaatggcatcgcgttcctgatttccgggcttgtgctgctgccgttcgtgcggccgtgggctacggcgccgcagttggattggctgggtgtggggctgatgacgttcaccgtgatcggcggcacattcggcgcgttctggctgtacatggccggcgtggtgcgcgtcggttcgatgcgtgccaccatgctcggcaccagcgaaccggtgatggccacgatttccgcggtggcatggacggacgcggtgttcgaaccgaccgatttggttggattcgtgatgattctcatcatggtgtttttggtacgttaagtgccgtgacgggcgttgcttttcgggcggcggcgtgcggacaaacaaaaaagccggacacccacttacgggcgtccggcttcgctttgcttagcgattaccgtgacttacgacgtgcgaatatgacgtacggcagctggaaatcagccttcaatcgcaatctgatgcttggtctcaacctgctgctgcgcttcgggcttcggcatttccaggcacagggtgccgtccttgtagctggcgtgaatgtcggaatccttcacgtcctcgccaacgtagaagctacgagagcaagagccggcgtagcgttcgcgacgcagccagcggccgttgtcgtccttgtcctcgtgcgagctgttgcgatgcgcggaaacggtcagatagccgttctgcaggtccagcgaaatgtcgtccttcttgaagccaggcatgtcgatgtcgaccatgtagcccttgtcggtctcacgcacatcggtgctcatcatgcctgcggacatgttcggatcgcatgcggctgcgcggtccatgttgcgccaaccctcgaagaacggatcgtcgaacagatcggagaacatcgtgtcattcatcaaagccggaaacattgccataatcggtactccttaagcaaatgcgcgttctgtgcgcggagtaatgcggcttggcagccggccgtgcgattatcgctgcggcgtcaccatccagcgagaccggcgaccgggttcgttgccgcatccggaaccctcccgggctcctgaccttgacctttcacttcacccaactcttccgtgtcctgctcattccgcgattatgctcacagtgaaataccgggaaatgcttgcgattgcgtgcgcggaaaagtcgtacggcgaatttcgtttttcttcagaatcggacgcatgggattggtctgcaatgcgttacgtatctgtttttccaaccggtcacgtgaagtgtggttttgggtggctatgtgttcgattctgccgaattggttattcggattgtgttttctggagaatcggacatttgtggtgctggttttgggtttggatgtccgtttgtctgtttctgctgagatagctgggctttcggcgcatttttagtacttttttgtcacatttcatacgttttggataaagcaaaagggctggaatcgttggattccagcccttttcggcccgtgcgagcgggggagttgaacccccacgagcatacactcactgccacctgaagacagcgcgtctaccattccgccacgctcgcagacagtgaattaatttacaccaaaacccacgcaacctcaaatcggcgtgtcgtgccgccattttccgtaggaaaattcaagcggcgcgacgcagcttgtccgattctggagaatcggacaaatagacatgcgaatacgcggctgtgaacgggcgtgaatcaaggcagcatcaaatcggtgccgccgagaaaacggtagccgccgtcatccatcaatcgggttttcgcaaaatgtaagcccaagagcgtggcttgcacctcgtcgatgccgtaaatgacatgctcccagacggtctgcccagaagcgtcttccagacgaacgtctacactccaggtgtcctcgtcgatttgcggttcggaaaccgacaacacccgatctccaccctcgtattggaattgtcgctgcatgctcgtctcccatcaaatgcgcgtatcttcgattgcgggttgttcgctcttcgggttggaagatagtgtttggctatttgtcgcattggaacttttccccgctaggcaggcggcataggctgcggctgccccggcccagcatactgcggccgcagcaccgtgtaggcgtttgcatgttttccctaaaagtttatattcgtgatcacacgttgcttttgaggagactgtgactgcagctgcattgcttactgatggattactgatggcgcatgggggcattccctgaactgttgataatatacaagcgaaggtaattgttagaatagttttcagcataatttaatgtcctgcgataactgatattggaattaaattaaaatattcgccagaatttgcgctacgcaatgtgcagtgcttgcgtttacgccatgctgacggaggaattgctcgattttgccagctgcccaattctcaggtttttgcagaaagccggagagatcgccgagccattttgctccactgaaaatttttgccgctactttaagcgctttggctacatttcctacggctccacgactctgtggcacgtcatccgtgtcattcaatggttgcaaggcgtttgcatttttagtggggaatattccggaagcctccgcctctgccgggtaagcatattgtttgtcggctgtgggctggacggagaggctatgtgcttcgtgttcgattgctgcgctgttcggcacctcatccatgctgggaagcgaagcttcatctgccattgctgtcgcgctccccgatgcaagtgtcgcacaagccaaaatagtcgcaataacacgtaacgtgttctttttcatatatatgtcttttcgtcaagttgacgtgacatcagtcgagagtagaagcgtgttcgcaattgtgatagagtgctgtcacctgttaggggacgtgtcgcattaaatattcaaacgggtgacattgctgttgtacggaaccgcattgcgtgatttacatgatgacggaatgtgtcccccggtgaaaggtgtgaatatgcgacggaagcaaaatgcatgcgactcgaacggtggcgtacatactgagcgcgtgacggccggcatgcatgaccttacatatggcttgaaagattttttccgcgaggtctttcttgataaggatgatatcgactatgagcgccgctttgacgtgcgttccttgccattgctggttgtagcgatggctgcaggatggctctattctcgtgatggaaacggattctatgcgtgtgtcagcgcgatttttgctgtttcctatactgtgtatttcatcgtcaatcgaggcgtgtacatcgtgcgcctgttccgtggggaaaatattttcggtaaacggcgtgtgagatgtatgaaataccgtggcacgatacattcgtcggttgcgggcgggctggcaaaagccttggaaaaattcgttgataacgatacgctgtatgcgtatatcggcggatatggtgttccgttgctgggcactgcgacaatgattgcttatgacgcgtcgcactggttatggttggcattagtcgggggagtcttgtgcgttgtatatgcgctgtattggctgatatatgcatttgttgccgcgcatcgggcgcttatcgcagtgcttgcggatcgcgataggagattggaacaggcgggttatcgcatgacggttatgcgccgagatgcaaaattggccagcaggacgcatgatacggttaccggtggtctgtcgtatattgcctttattgcgcagcagcagctggagggtaaaaccttatcggacgaggaacgggttgcgtggaaacatatcgatgatgcggctcaacgtacgatggacaatgttcatgaagttattgatattcttggacgagatatcgaccccgcaaatcccgttggcggcgaagggtttgattgcgaatcgcaagaaatacagatgccagatgtttcttcattggagagaattattcgcgagcattgtgatgagggggattctcggcttaagacgctcgggtttgttggaacaagtgagattcagctggatgttgcggatgctgatgatactggtgaaagtgtttgtgcggatctgattgatgagtgtacaagtctgattgatgagttatacaccaatatttcttgtcacgctgatacgagtcagccatacgctgtttttgtcagtagcgagaacggatgcctccgcatcacgcaggtaaacgctatagcgtgcccgcacgatgcgcagagcggctataagaagaaggtttcaggaaggggacttgcgtttcatcggaggatgcttgacgcgatgagcgggtcgattactacttgtgaagagggtgatacttggacgctgcatgtggtcataccgttgtgaaaacaataggttttggtgtagatatttgataattattcatgctgaagctttataaaatatcgcaagtaatttggtagttaatgtaatggaaactaatgtggaaagaattgacaaatcagttgaacatataggaatagtcgacaatgatgtgttgacgttgggtgcgttgtctagctatttggctcaacaatttggagacgagaaaattttatggcgatgcacgcttggtaaaaaagctgcggaattatgtagtaattcgcaaacacgtccccagatattactcatggatatgtcattatctgatgccgatggcgtgcagatttgccaggagattcggcgtactgttgacgatatgccgattttggcgattacttcttttccgttgcgccgatatgctgctgcggtggctcaggctggagtgcaaggcattgtcgcgaaacgaaatttgcgcactattgccgctgctctcgaatgcgttgtatctggacacgtttatctgccggatgagttagcggaaaccatgccggatctgcattttgagttgccagtacaggcgcatcgtaggatcgatgcagagactcttggcgggcaggccgtgaaaccagttttgtccgatcgggaaacggcgattatagtcaggtatgcgcgagggcagaccacacttcaagtgggggagtgcttaggattatcggagaacactgtcaagacttataccaagcgtgccatggcgaagcttggggcgaaaacgcgaggtcaggcaatagccctctggctgatgcaaaccatgacgcatggtgtgtgatttaggcagcttttatctctgataaacgtatatgtgctgtgaccgattctggagaatcggacactcgttgggtttaggaaagggcttgggtgtccttattctcccgaatcggacacatgggacgggatacggggaggcatgaaaaagcgccgacgggggttcatcggcgcttgagctgttttcaggatacttaatccggagtggctttgcctcagcccttggagccgttttcgtagaagtgcgcgagcgtctcgtcgcggaacttctcgaaatatccgccgtcgatcgacgcgcgaatgtcgtccagcagcttcacgaagaaatgctcgttgtggatcgtggccaatgtgaaaccgttgaattcgcgggcgcgcaacgcatgatccacgtaagcacgcgaataatgcgtgcacgtgtagcaatcgcagccctcttcaagcgggccaaaatcatgcttgaattgcgcgcgcttgatgttgtagcggccgtggcgcgtgaagatcgcaccattgcggccgcaacgcgcgggggccacgcagtcgaaggtgtcgccgccgttctccacgcaggcgaagatgtcgtccaccgcggcgatgccgagcacatggcgcggacggctttccggcatcgcgtcacagatccaggcgcaggtgtcgccgatgatgcgcttctcgatcgcgccgccgatgccgacgccgtcgaaatcgagcgaagcgatctgttcggcggcatgcctgcgcagatcctcgtaattcgcgccctgcaccacaccatacagcgcctgatacggcttgccgagacgttcctcggtaagccgcctgtgctcggccacgcaacgttgcgcccagcggtaggtgcgttccacggaacgttcctggtagccgcgggtgttcatcagcgtggtcagctcgtcgaaagcgaacatgatgtcggcgccgatcttgtgctggatgcccatggagatttcggcggagaaccggtgcagcgagccgttgagcggcgacttgaacgtcacaccgtcctcgtccacgaacgcgagccgctccttgccttccgcgatcacgtcgtccgatttcatgccggtgacgtccatggcgagcgtcttcttgaagcccgcgccgagtgacagcacctggaatccgccggaatcggtgaaggtcggaccgttccagttcatgaatttggcgagtccgccggcttcgtcgagcacctgttccccggggcgttcatacaggtggaacgcgttggacagcaggcattgcgcgccaagatccttcatggtttcgggcagcacggccttcatcgcggcctgcgtggccaccggcacgaacgccggggtgtggatgtcgccgtggggggtggatgatgccggtgcgtccgtatcgcgcgccgccgcggcccttgccatcggccgcatctggcaggcgggttttctgctcgaagtagaacgcgtcgcggcggccgggcttgccgggttccgcgccgcggggatgctcaataaggttttcggtcgatgccgcgctggtcgtgttgcctgctgcgtcgtgcgttgcgccggctgccgcgttggccgctgaggtctcgtgcgccaccgcgccggtctgtggttcgttcaagcttgtcatgctctcaactgtatgcgatagcgccgattgccgcggtggcgccatcggcggtcgacggtggcatcgtatggagtaaactgccaagcgattcgattgctactttcaacaaacattcaggaaacttccagagcaggtatctttactcttagatagcagttcgagcggcacgattgctgaccatgttgaatgccgcgagacgaataaggagcaacaatggctgaagataatagcgatcagaacatcgcccagccgcaggatggcacgcagcagaccgcgccgcagacgccgagcgagaacgtcgccgacgaagcacagacttccgttaccgaaccgattgcagtgccgaacgcgggcgagcagcccaccaccgcccttcctaccgtggacgcggcggatggcacggcaggcaataccgctgacgatacgccggattatgcttccgctgccggtgaacgcacggtgatcaacaacgcgacgcaggatgcgccgaccgaacagtaccgtccggcgcccgaatacggcgcgtacggtccggtgccgacgccgccggctggcgatgccagcggccagaccgtccagcaaccgcagtacggcgcgcagcagcagggccagcgccagccgcaggacaaccgtccgtcgttcttcggcgctttcggcaacccgtatacgaccggcaatcagcggaacaatggcaatccgttcggcaatccgtttggcggctcgtccgcgcagaacggcgcgcagcagaacaatcagcagcagccgcagtacggcgcgaacatgccccctgcgggaccgggcaaccgcaatccgttcggcgctccggggcagggcttcccgaaccagccgaaccagacgccggtcgtcaccaagcagaagtccggcatgaccagccatgtggtcaccgccgttgtggccgcactggtgtccggcgcgctgtgcctcggcgtcggcttcaccgcgatcaccaacggttgggtgcatgtgccgtcctccagctcgctgtccgacgtcaagtccaacacgtccggttccggttccgccaaggcgaagtccggtacggcggtcgattggaccgcggtggccaaggaagtgtccgattccgtggtggccatcgacgtggcgaccagcgacggcgaagccaagggctccggcgtggtgatcagcgacaagggctatatcgccaccaataaccacgtgatttccggcgcgcagcagattcaggtgacgctcgccagcggcgccgtctattccgcgaaggtggtcggcaccgacaccaccaccgatttggccgtgatcaagctcgacaatccgccgagcgatctgaaagtcgcggaattcgccgattccgacaatctcgccgtcggcgaggccgtcatggcgatcggcaatccgctcggctacgacgacaccgccaccaccggcatcgtgtccgcgctcaaccgcccggtgaccgtgaccgatgacgacaacaacgctatcgtcaccaacgccgtacagatcgacgcggccatcaacccgggcaactccggcggcccgacctttaatgcggccggccaggtgatcggcatcaactcgtccatcgcctccaccgcaagctcgtccggcacggcaggttccatcggcatcggcttcgccattccggcgaacctcgtcaagcgcgtgaccaacgagatcatcgacaacggttccgtgaagcatgtggtgcttggcatcaccatcaagagctcctcggtggaagcggacggtgtgacccgcggctgcgcccaggtgcaggccgtgaccgacggtggcccggcgtccaaggccggcgtgaaggccggcgactccatcgtggcgttcaacggaaaggcagtgaacaacaactactcgctgctcggttacgtgcgcgcctccgccatgggagacaaggtgaagctgaccgttgtgcgcggcggcaacaccatggatctcgaagtgacgctcgaccaggaagagaccaagacgaactcctccaacaagcaggaacagcgtcagcagaacaacggcaacgacgataacggcaacggccagaatggcggcagccagaacggccagaatggcggtaacggcaacaacggcgacggcggtggcctgttcgatccgttcggtctgtggtaaagccggatgcgcggcatcgtacggcaacgtacggtgtgcggcgttcatgccgacagcgatacgggtggctgccacccgataggctgacggcgaagtcgcaaccgcaatccgcgtaatcgcggaaaacgctgaacaagccgaaaaacggcggaaaacaagggctgtgcgagcaatcgcacggcccttttcgtatgcgcggaacgcgcgcgacgaacggaagcacacgcaaacgaccgcggcaatcgcaatgctctgttatgctggaaatatctttttacgccgtgtatcgatggtccgcgcaggcggggcgccgatgggttaacaaggcgtccgatacgagcgtaaggagattctcatgcgtagaatcatttccatttgcaaagaagttccgctgctgccgatcgccatcattgccgcgattccgttggcattgctgggttcgtggcgtccgtgggaggctgcgggcgtctcgctgactttcggaccgttcaatccgggtgtcgggcagtggatcgtgatcgcgctggtcgtgtacacgattgtggtgactgtgatcggcatgattgacgatttgcggcacggtcacgtcggtgtggatttgcttgcggttattgcgatcgcgtcgacggtggcggtgcaggaatactgggctgcgtgggccgtggtgctgatgatttcctccggcgaggcgattgaggaattcgcacagtcgaaggcggaaggcaacctgacggcgctggttgatgcggcgccgcggaccgcgcacgtggtgacgttgccgggcgtgggtgcacgtgcggcggctgctggggccgacggtactgccggtgatgctgagggcgacatgacggcggacggctttcgcaaggtcgccagtgtggatgtgcctaacgctgcggaaacgaataagtccaccacccaaaccaagccttacgacgcggccggcgagcatttcgaaaccgttccggtcgaccaggtcaagcttggcgacgtgatcctcgtgctgccgggcgaaacggtgccggtcgacggcgaactgctgtcgggcgtcgccacgttggatctgagcaatatcaacggcgagccggtgccgcgcgaagtgtatgcgggcgcgcgcgtgctgtcgggtgcggtcaacggatcgaccgcgctgacgatgcgtgccacgcaattggcgcaggattcgcagtatcagaagatcctcgaactggtgtcgtcggcgcaggaatcgcgcccgaccgtcgtcaaaaccgccgatgtgctggcggtgccgttcaccattctttcgctggcgatcgccggcattgcgtgggccgtcgcaggcacgccattgcgattcgcgcaggtgctggttttggccacgccctgcccgctgctgatcgccgctcccgtcgcgtacgtggccggcaccggtcgccttgccaaggcgggcattcttatcaaagcgcaggacgtgctggaaaacttgggccgcgtatcgcatatcttcttcgacaaaaccggcacgcttaccgtcaagcagccgcaggtcgtgcgcgtcgagaagccgttcgaaaacagctcgccgtacgacgagaaccacattctgatgatggccggcgtggtggaaggctactcggtgcacattctgtcgaagggcatcgcggcggccgggcagaaggccatgcaggaactgtacgcgcgctatgagaacgggcagcggctgtgcgccgaacgcgatctgccggggcatggacgcgattaccccgtggtgaagaacatcgaggaacagtcgggcaagggtgtgtccggcgaggtgaacgggcatgccgtgcgcgtgggtcgtttcgcgtacgtgacggccgacgaggccggcttcacgcatgtgctgggcgcaggtgcggcggccggtattgcggctggtgctgtggccgatagcgcggttggcgattcggcgaccggtaccgctgccggcgcttccaagaagccggaggtgaattcgctgttcgccccgctcgagccggacgaaatggccgcgtacgtggcgatcgacggcaagctcgccgcgcgcatcgtgctgcgtgacgtgccgcgcgaaaacgcgaaatcgtcccttgaaaaactgcaccggctcggcgtgaagaaactgtccatgctcaccggcgacaaggaggcttccgcacgcatcatcgcgggcgaggtcggcatcgacgacgtgcaatccgaactcttccccgaaggcaaggtcgcggccgtcaagaacgccacggaagacgcgcaccaaaaccagccggcgtgggacaaggtcgtacagcgcgtggtcggcgaatccatgacccgacaggtgacgatgatggtcggcgacggcgtgaacgatgcccctgtactggcggttgcggacatcggtatggccatgaccgacggcacgtccaccgccgcgtccgaatcggcgcaggtggtcatcatgaacgacgacatcgcctccgtgccgcgcgccatcgccatcgcccgccgcacgaagaaagtgatgctgcaggcggtgctggtcggccttggattggcgattatcggcatggtcgcggccgcgttcaacctcattccggtggtcgtcggcgcgttcatgcaggaagcgatcgacgtggtcagcatcctgtgggcgctcaccgccctgctcgaccgcgagtagcgccggttgcggcgacgagccgtgcggaggctgaaccgcgttgcgccgtgctacatcgagctgggcgagatttcgccagcgatgttccggcgcatccacgtgccgaaatcggccgcgtccacgccctgcgacagcaggaacatgatcttcgcgtatgcggcttccagcgtcatgtcgcccgatccgatcgcaccggcgcgggcgatcgcgtcgcccgtctcgtaatggccgagcagcacttccgcctgctgacattgcgatgcgatgacgaccggcacgccgtcatgcagcacgtcggcgatcacgtcggtcagtcctggctcgtcgctcggcacattgccaacgccgtacgcgcgcaacagcaccgcttccggacgagggtcgagcatcgcggccaatcgcgcggcggaaatgccgggagccatgtcgatcacggccacatcgtgacgggagtagggcagcggcgacgcccaaccgcaaccggagccggccgaatcgcccgcataccaatgccacggcgtgccggtacgtgccagcgggccggtggacggcgccgaaaacccttcgaacgcccagcttgacgatttgctcacacggttgccggcgaacagatgatggccgaagaacaggccgacgccatgaaaacgtccgctcatcgcggcgttcagcgcacccgtgacgttcgcggtggcgtccgattcgattttgccgagcggatgctgcgaccccgtgaaaatcacaggcttgccgaaaccggtcagcgcgtaagacagcgcggcgctcgaatagctcatcgtatcggtgccgtgcaacaccacaaatgcgtcggcgtcatcgcggtgcgcgcgcaggtcgtccgccatcgtctgccaattgtcgggcgtcgcgttcgacgaatcgatcagcgggtccagctcggtgaacgagaacaagctcgggtccagatgcgcgtcctcaatcagccggcgcagccagccgcgcatatcggcgcccggaaccagaccgttcggtgactcgaccataccgatggtgccgccggtatacgtgatgtgaatgcgcatggttgcctttctgctgcgtgttatctgccggcgcgtatctctatgtgcgtgtctctgcatgcttgtccttgtgcgcggaagccggatgtcatcgtactcgccgtgtgccgttgccgcgattgcggttttgtctgtcgtcgccgcggtttttcgaaaaccagttgcgattgtacgtgccgcgtgcgtccgattctgaaagcatcggacgccgagagcgtgactgcgatggggcggtgagacaggcgggtttccgaaggttcatcataggtttgccgaaggttccccgtgggatgtttgagaggcgcatcacagtgccgtaccgtggtcgcatgtgcgttattatgcttatggcttactgatgggggatattcaacgcgtggggcgcggaggatggggttatctatgaatacggttgctgactgcctgcaacggcattaccgtgtggtggtgttcgccgtgtatcttgcggtggtcatcgtcacgatggcgttccacgagccgtggttcgacgaggcgcaatcgtggcttattgcaagggattgcccttatcgagacctgctgctcgtccgcccgcattacgaaggccatccgccgctgtggtggctgttgctgtcgattccggcgaagctgggcgtgccatatgaatgggggttgaaaggggttgagctggtctgttcggcattaatgtgcggattgttggttttccgcgcgccactgccccggctggccgttgcgctgctgccgttcacctactttctgtgctaccaatacggcgtcacctcgcggccctacgcgttgatgtgctgcgcgttgttcgtcatcgcggcctgctggaaatcgcgcgatgaacacccatggcgattgacggccgcgttcgtgctgctgtgctgcaccagcagttacggcattgcgctggcatgcgcgttcgcattggtttggatggtgcgtgcgattcggggcgcaacaggccgtcctgccgtacgtgacgggcttttcggcaatcccgcccggttcgcggcttggatggtattgctggccgtcggtcttgtattgacggcgtgcgtcctgccgcgctccgacacgttcggcgcggtgcaggatcccggcggtaatccgccgatcgcgcaattcgcgctgttctggacggtgctgcccgccgaaagcatgttcaccgcttttgcgggcgatgtttccctgcatggtctgcacatgggcgttcttgcgattgcgttgtgcgtggcgctgtcactggcgatttggagcgtgctggcacgggtcgcgttgcgccgcaagaacctcgatctgctgttggtcacgtatgttctgctgagcctgtgcgcgacgaaatacttcagcatgcaccacatcggcatcatcttcgcgctgttcgtcgtgcaactgtggatcaacgtgcaagacaaggccctcggaatcgccgatattccactgccgacgcctctttcgcgttcgctgcgcgccgcctgtgccacgcacgccgtccgcgtcgcgcacatcgcccgtatcgcaatcgtcgtggcgctgctgccaagtctggtgtggaccgccgccgcgatcgcatgcgacattcgctacgactattcagccggtcgcgcgctggccacgttcgtgcgcaacaacaacctcgaacacaaccgttgggtgtcgttctggcggtatcttcccgacacgacctggcccgacggcacgcacacgaatcgcatggaagacacgtaccgctacagctggccggcgatcgcggcaaatccgtacttcgcgcgcaatctgctggactgcacgtacgagggccgcacgttcgtgccgaaccaggtgccgtcgcgggcgcagatgaaccgcgaaatcgcaagctgtgccgccaaaggcgcaccggaattccttatcggtgacaccgattttccgcaatatttcttccatcggctcggattgaagaggggcgattaccggcaaatcgtcgtcgccagccagcacgtgccgtggaaaacatgggtcacgtcttccgacatcgccgtgtacgtgcggtcggacgtgtaccgcacgctgccgcacgcgtgacctcaatatggaagagccgcaatacggcggaatcgtaatgccccctgttggaaatgcagggaatatattaggctggaacatatgagcgaaaccaacgaacttcgtattgctgtaatcggcgccggccccgcaggcgtctactcttccgatattttcctgcgccagctgggcaagctcggcgaagagctgggactgggcaccaaggcccgcatcgacctgttcgaaaagctgccggtgccgttcggtctggtgcgctacggcgtggcccccgaccatccgtccatcaaattcatcgcatccgcgcttgagaagacgctcgacaatccggacatccacctgtactgcgacgtggaattcggcaaggacgtgacactcgacgagctgctggaacgttacgatgccgtgctgttcgccaccggtgctgtggaagacaagccgctcggtctgccgggtgctgatttggacggcgtgtatggcgcggccaagttcgtggaatggtatgacggttatccgaccggcgctcgcgaatggccgctcgaagccgaggaagtcgccgtgatcggcggtggtaacgtggccatggacgtggcgcgcgagctgatgcgcaacgccgacgacctgaaggaacgcaccgacattccggacaacgtgtacgaaggcatcaaggccaacaaggccaagaccctgcacctgttcatccgccgtggcgtggctcaggccaagttctccgtgcaggagctgcgcgaaatggagaagctgccgggcgtgcagctgatcatcaacgaggacgatttcgatttggacgacgataccatcgaggaggctggcaaggacaagctaacccgtcagatggtcgaggagctgttcaccatccgcgagatggccgaggacatggaagacgacggcgacaccgatttcgaaggcaacccggcggatcgcaagtactacatccacttcaattccgctccggtcgaagtgctgggcaaggacggcaaggtcaaggcgattcgcgtggagaagacgacgacttccgcggacggcaagatgactcgcaccggcgaattcgaagagtacccggtgcaggccgtgtatcacgcaatcggctacaagccggccaccgcgccgggcatcgcgtacgacgagcgtcgcgcgcacctggccaacgcgaacggcgacggccgcatcaccacggaggcctccggtgagggcgcgcaggtgcgtgagcgtctgtacgccaccggttgggccaagcgtggtccggtcggcctgatcggctccaccaagtccgacgcgctgctcatcgtcaccaacatgctggaggacctgtccaaggccgccgaaggcggtcgcgtggccgctgaccgcgatccggaatccatcgaccgtctgctggcctcccgcggtgtcaagccgatcgacttcgccggctggaagaaggtcgatgcgttcgaacgtgccgaaggcgcgaaggaaggccgcgagcacaagaaggtcatcgacccggagcagatgcgcgcgctggctcatgcgtgaggtgggtgtttgaaacccagtctgataggtttcaggcttctttcatgcgtcttgggtgtccgattctggagaatcggacacccaagacgttttttatcctgtacttgtccgcttctggtgaatcggacatccgggagaagctgagcgtgcgaacttccgcaactgcccctagtccttcccgcggcccagtctccagcgcatatccagcaaaaactcagactctgtttctacgctggtgatcatgaacggcaaactgcaggtgcacggccattgcaatggcttgaagacaacgctgttattcgcgttgatgtggggcatcatcatgctcatttggtgggcggccggtgccagtcaaagcacgcttggaatctacctttgcatcggtattggctcgacgttcgtctcctattggttttccgacaaactcgcgatcgccagcatgcacgcgcagccggtaagcgagcaggaggcgcccgtactgtacaagatcgtacgcgaactgtcggcgaaggctggcaagccgatgccgcgtatctacatcgcaccgaccatgagccccaacgcgttcgcaacgggacgtaacgaacgtcacgcggcggtctgttgcacgcaaggtattctgcagatgcttaacgagcgcgaaatccgcgccgtgctcggccacgagctcatgcacgtctacaatcgcgacatcttgacatccgcgattgcgtccgccatggccaccgtcatctcgtacctcggatattcgctcatgtatttcggaggtggacggtcccgtgatgatcgcgacaattcggcatccggcggcttgggattgctgggtgtgctgttgagcacgattcttgctccgattgcggcgtcgctgattcagatggcgatttcccgcacgcgcgaatacgatgccgacgaggatggttccaagctgacggaggatccggaggcgctcgcttccgcgttgaacaagatttccggcggcgcggccgcgatgccgatggagaagaccgcgggaacgcagtcggtggctgcgatgatgatcgccagtccgttctccgcggagggcttctcgcgcctgttttccacgcatccgccgattcaggaccgcattgcgcggctcatgcagatgggtcaggagatgcggcagcagggcgcgcagtcgggctacctggccggcggatacgcaacgaccggcgttgccgcgatcgacattcgacagggcggttatgacgggccgcagttcggctcgcagtatggttccgcttacgattcgtacggttcgggtccggcgggttcggcgggttcgaccggtggatattcgcgcgactattcgcaacgccccatgcgcagaagagggtcgcgctgacgcccccacagcctcccgcgccgctggttcctgccccgactttcagccttttccggtactgatgttgctgcggacgcatacttgctgtgctgacgactcccaaaatcgctatatgtggcagataagagactgccgagaaagtgatttccgctatatgtggcactttccttcgcgaagatgcccccataccttcgatttcgtaccctctaacagctcttgcccgcggagaactgccacatatagcgcaaatcgattttgcggaaccggacaatctgccacatatagcgggaatggcgtgctagactaatggctcgtgcccaaaaggcacaccttgcggatgtagttcatcggtagaacgaaagcttcccaagctttaaaggcgggttcgactcccgtcatccgctccactcaaaacccttggaatcgttggaatttcaagggtttttctattgtcgtaaaagacccgtgaagccaacttcgcgtcgcgcaactgtcggttgcgtcgcaaaatttggttgcgaatcgcaatgcaaccgcaagatggtggcgtggaacgcgacgtttgtgacaagctgctgatgctttgcgacatgttcggtgtgacgttggatgatttggtcatgggcgacgtgtgcgcgtcggcgggccgtggaggtgcgggacgcgtggggctgtgtggatgcgggacgcatggacttggctgccgatacggctggtgtggcagcgtcggatggggtggttgactctgctgttggtgcggttccgggggtaatcgggttcgcggcatcgcaggttgcaggagtgtccgattctgcagaatcggacactcgtggagggcgatgggtaggctggagcccgtgaacacgaaccagaagtccccctccgattccggcgcaaaccaccccaccggcaactcctgcaatccgctactcggccatgccacatcacacgcggcgacactcatcggcctgttcgcaatcgtcctgtggggcttcatggccggcctcgtgcgactggtctccgaatcgttcggcgccacgctcggttcggcgctcatctacaccgtcggtggtgtcatgctgttcattgtgcgccgtccgaaaccaatccgcgaagcgccatgcaagtacctcatcgcaggcggactcatgttcatcgcatacgaggcgtcaatctcgctgtcgatcggcctggccacaacgaacgcgcaatccgtggaagtcagccttgtcaactacttgtggccgacgctgctggtgctgatgaccgcagcggtatcgcacaaacgtggtgcggtcgccaaagcgattcctggcgcggtgatcgcaaccatcggtgtggcgatggcggttggcggagaaagccttgatatgcaggaagcggtccacaatatcgccagtaaccccctaccgtatgtgctcgcgtttgttggcgcctttatttgggcgatttatgcgacttttacgccgtcgttgtccggcggttacgacggcacgacgattttcttctgctgtgtggccgttgtactgtggaccatccatttcgtttcgggagacggtttgccggacacggcgcccggcatcggtggatatgctgcgctgattgcgtgcgccgcttcgatttcgggcggctacgcgtgctggggatacggcatgttgcacggcagtatggaaacgcttgcgattggttcgtacgcgactccgctgttttccacggcttctagcacgcttctgttgggcgtggcgctgggcatgccgttctggatcggtgttgtgctggtggttgccggttctctgatcaacgtgtggtttgcacggtgcccctgagtgtccgtttctcccgaatcggacaacctggggtgaccggatgacgcgtgggtggctgattcgggggaatcggacacttgttggtgcgtgaggaggcgacatgtggggtagtggcggcgcagaggagcgccgggatggcgcagcggtacgtaagggaagtgactgggcaggacaatgccctacgcctccacgctagcttaggtttttgccggctggtcgatggtgacgaattcgtggctttgggttttcaggtcgtcgatgatggcgggcagcgcgttcacgtgtaccagccgaaaccgatctaaaccggctcaaaccagcccgttcaaatccgcctcgtcacatcaccttggtggactccagattgcggctcacccagttgttcaaccggatcaccggcttgcgcaacaccaatcccagcagcagcgaaggaatcaggaacaaggcgagatacaccatatcaagcaggtactcattgccgtacgatccggccatcgcggcgtgcatggcatcgatggcgtgcgggaatggtaggaacgggtagagcatttggaagaacttcggcagcgtctcgatagggaacgtaccgcccgaaccggcgacctgcatcaccagcagcaccacggccacggccttgccgatatcgccgaacgacacggtcagcgtatacacgatattcgagaacacgagcgcggcaagccaccccacggcaaggaactgcagcgcatgattcgcctgcacgccaaggaaatacatgtcacccaggcaaaccagtgtgccctgcagcaacgcgagcagtgcgaagatcgcgtaccgtccgaaatactcgtggtcgagacgcagtccccaacgtgaggcgttccccgggccggacgggccggcgacgcgcggcagcgtgtcgcccaagcccagcacatgcgccttctcgcggtccgaaatcgtcactttcagcatggcgcacaggatgatcgcacccacccagattgacaggatcgtatagaacggcgccatggccgaaccgtagttcgcgatcgggtacaccgagacgcgatgcagtgcgacaggcgcggaaatcagcgtggacagtgtggacgcgttggcggtggccagtgcacgtagttcgtccgattcacccgaatcggacgaactggcgtcgttgccaccattgccaccatcgctgttgccgtcaccggcgttcccgcccgtctccagcttcgtgatcagctccttcaccgtcgctgccgacgagtcgagtttcttcgcgatcgcgccgagcgtggaacggatggacgtcacattcgtccccacatcgcccgtcacatcgtccagatcgtcggcggtgccgctcagctgggtgattatgctgtcggtttgggagatcagcgtgctgactgtggaggcgagcgcgtcgattttcggcttgacgttcgtggcgtaatcgtcgcgcacattgctgatcgactgcttcgcggaggtgatgcggttcaggatctccttgcgggagcgttccgcggctgcggtatcctgcgtgacctgcgtggaagcgtctttcagctgctgcgcgagcttctgcgaatcgcctttggcggcttccagcagcgtgatctcccggtcgatggcttccagcagcgcctgtttcgcggaatcgctgtccggtagttgttccaccgattcgcgcatgtggttgaggcttgtgatgtacgtgtcgtacagcgattcgccgctggagatttgttcgctcaacgttgccaactggctggctgcggtgtctgagtccttgccgatcgcgtcgaacgccttgttcaccttggcagctacttggtcgaacgcgcctgacacctggtcgagcgcggtgttcaccgaggaggtgacgttcgcacctgcagaagtgagtgacgtggcacctgatttgccttgcttcaacgcgttctgggcctgtttgcccgccttggtcgccgaggcgagcagtttgcccgtggaatccacgatgtcgttcgccgagccgagcagctgcgaatacgacgtcacctgctgcgatgcgccgctcagcgtatccgccgtggtggtgagattgccgttgaggttgcgcatgtattcggccatttgcgggctttgcgaatagtgtaggatgcttgaggccaggtcgagtccgacttgcgcaatcgttttggcgaaggttttgtcgatcgtgttgaccacggttgtcgcgccctgatcggtgatatgcggggcgatcgggttgattttctcgttcagatagtacttgagctgcgcgtgtttgatgtcgggggagaacagcgtcatcatgtcggcgctgaaacctttcggaattacgatcgccgcatagtattcgccggatttcaccccgtcgattgccttgtcgcttttcacgaactgccagtccagctggtcgttggcgtgcagtgtgctgatgatggtttcgcccacgttgacgcgcaccggtatgagatccgacttgtaacccttgtcgttattggccacggcgaccttcaatgccttggtgttgccgtaggggtcccagctggccgcgatgttgaaccaggcgtacagcgccggcaccaccaccaggcccatcgagacgatcacggcgatcacgttgcgggtggcatggcacatgtcccgcttgaagatgccccagatcattttcactgttcgttcccctcctcacgcagactcctgccagcatttccgtccgtgtttccagccgcatactcagccgcatgttcaggcgcatgtccggccgaaccaccatgcgcagcctcatacagcctcgtacgtacggcatgcatcggcttgtaatgcatgcccggccggaacagcaggttctcgtgcaggatcgcgctgcggaactcttccgcactcatcgcttcctcgcccagataattcgcataccgttcgcgcagatactccaccacgatgagatacgtgtcgatggcgatgatcgaaatgatccaaccgagcagcatggcgagcttcatgcgcgtgatgaatagcaatagcaggaacacgaacggcagtaccgccagcgcgaggaatccccaacgcaccaggcgcgggtacaggcggaagaaatgaatcgcccgtctgcggacgagttcggggaactcctcggcgatctgctgcgcggtctcggtgagccgcaacggttccaccgtgccttcgttatgttcggtgatcatcagatcagtgtccgccagacggttgtcgaacaggcggttgaggtttaacgccagcttgcggaccaccaagccgatgaacagcgccacaggcagataccagaacagcgagagcatgtcgatccaataatggttggcatacatgccgccgatcggcccgcgcatcgcgttgatgccgtaggtgaacggtaggaacggtttcagacggcggaagaattccggcatcatctcgatggggtagaggcctgccgcgcccggaatctggatgatcaccagaatcacggcgacggccttgccgatatgccggaacgccacggcgagcgcgtaaatgatgttcacgtagacgaacgaggcgaaaatgccggcgaggatgaacaggaacggatgctcgcattggatgcccagcgcgagatcgccgatcgtggcgatgatcgcctgcaggaatccgaccgtgacgaacagcagccaacggcccatatagccttggcgtggcgtgtacatgcggatcttctcatcgcggtccacttcaagcttgtagatcgcgacgagcacgaatccgccgacccacagcgcaagattcgtgtagaacggcgtgaccgcggaaccatagtttttgaccgggtagaggacctgttcgtccaaatgcaccggctcgcccacgaacgagccgacctcgctcgcgtcaagtccgagcgcttgggaaagctgctggaacatcgccgaactgctcaacgcggccacatcggtgcgcgtggtgttgagctgtttggcgagattggcgagctgtgtctgcgtgccagcaatggtggtgttcgtttgggtcacggtgcgcgacaactggtcgagcagcccgttgccctgttccagcgtgctttgcagcgtggtaagcgtgccggacagcgacccattggccaggctgagtgtatcgagcccggtgttgagattcggcatgaccgtgccggtgatggtcgtgcgtgcgctcgccatcgacgccgtgccgttcttcgccagcgtggtgacatcgtcgttgaacccgttcgcggtgttcttccccgcgttgatcgcagccgtggtgtcctgatcgaaggcgtcgatgcgctgctgctggaacgtcagctgtttgcgggcttcggcgagctgcgcggaaagatccttatacgtttggctgttcggatccagctggctggcctgcaacgccttctccacgtcgtcgagcacattgccggtggtggtgttgacgtgatgcatggtgctggacacttggtcgagcgcgtcctgcgtggtgttcagtccgctgagcacggtgccggtggcattgctcacgttgacctgcaggccggacagttgcgtgctgccgttgtcgagcgctccgaccagcgtgttcgagaatcgttcggtttgtgtgcgcgtctcgctcagcaagtcggacgccttgccgacggtgtcaagcgagttggtgatttccgaggtgagcgcgatgttggactgtttggccgaatcgatggtggtgagggccttgtcgagcgtggagcgggtgtcgcgcagctgctgttggacggtttcgagctggttgatggtgtcggtcagatcgttgatgacgtcgctttgcgcgcttttcacgctgccggtggtttctcccgctgcctccttcacttcctttgccacggcgtcggccacgctggaaacgaaagtggtgttgatctgctcgtcgatcgtggtcgcgcccgtatcggtgattttcggcgcgatcgcgttcagcttttcgttgatgtagtacgtgatcgacggtcggtcgcctttaccggtgacggtgccgattagtctggagctgaagtcttccggcagtacgatcgccgcatagtatttgccggattccacgccttcgatggcttgctgcttgggaacgaaacgccagccgagctgatggttcttcttaagctggttgacggtctgctggccagcgtcgagatggccgaccagcgtggaggttgtgcccttgtcctcgttcgccacagcgacttggatgttgcccgtgttcgcgtacgggtcccagttggcgaggatattgcaccatgcgtacagtgatgggatgatggccacacccagcgtgacgacgagcgccacggggttcttcagaatgcgtttcacgtctcgaaggaagatggcgaaaacctggtgcatcaagcctcctcgcgggtattggtcgcaacatctacgtgcggcggcatgcccgtgcgggaacacccggttgggctcttcgtcgcgcgatccggtggacattctatgacttccgatggaacgatcgcaatggtttcgccatgtttattggtcggtcccgcaagtgtcgggatatgagacgaaaacgctcggcatatggctctagtggggcgggcgacctggatatggagcggacggtcgggaaaacggaaaggaaagatggcgaatgttgtcacatgacaagtgggatagggttgggcgataatggaggcatgactattgcaacgccggaacgttatgcgcaaatgctggacgccgcacgccgcggcggttacgcctatcccgcgatcaatgtgaccagcacgcagaccctgaacgccgcactccagggtttcgccgaggcggaatccgatggcatcatccaagtctccgtaggcggcgccgcctacttctccgggcaacgcgtcaacgaccgcgtcaccggctcgcttgccttcgcagccttcgcgcacgaagtcgcggcgaaataccccaacatcaccatcgccctgcacaccgaccactgcgccaaacagtatttggacgaatgggtgcgcctcttgctcgaccatgaagtcgaacaggtgaagcacggtcaggaaccgaccttccagtcacacatgtgggacggttccacagtgccgctggatgaaaacctcgacatcgcagaagaactgctcgacaaatcccaagccgcgcacaccgtgctggaaatcgaaatcggcgcggtcggtggcgaagaagacgggcacagcgccgaaatcaatgacaaactgtattccacgcccgcgcaaggcatcaccgtcgcgcaacgactcggcctcggcgagcgcggacgctacatggccgccttcaccttcggcaacgtgcacggcgcatacaaaccgggcgtggtgaaactgcgccccgaactgctcgacgaaatccagaccacggtcgcgctcgcgatcaaggccggcgaaatgcccgaccccgcgcactcgctggatgtcgctcccggtaagccgttcgccctggtgttccacggcggttccggctccgcgccggaggagatcgcgcaggccgtgagctacggcgtggtgaagatgaacatcgacaccgatacgcagtacgcattcagccgtgcggtggccggtcacatgttctccaactatgattcggtgctcaaaatcgacggtgaggtgggcaacaagaagctgtacgatccgcgatcctggggtcgtgaagctgaatccgcgatggccgcgcgtgtggtcgaagcatgcaagcagctcggcagtgccgggcgcgcgctgaactagccaacggtctttcgaactgttttcgggcgttttctggtctgtttttcggaccggttgcaatccgattacggtcggtccggagccgtgagcatccctcagacccggtagagggtgaagagtaacctttgtaaggctttaggcgcaaggcttaaggcagaatcgcgtacgcacggaggtgcaacaacatgcctggaattgttttgatcggtgcccagtggggagacgagggcaaaggcaaggcaacggatctgatcggcacgaaggtcgactacgtggcccgcttcaacggcggcaataacgctggccatactgtggtggtcggcgacgaatcgtatgcgctgcatctgctgccgtccggcatcatcagccccaacaccacccctgtcatcggcaacggcgtcgtcgtcgatccggaagtgctgttccaggagatcgacggccttgaaagccgtggcgtggactgctcccgactgctggtgagcgaaagcgcgcacatcatcgccccgtatcaccgcgtgctcgacaaggtgaccgaacgcttcctcggcaagcacaagatcggcaccaccggccgtggcatcggcccggcatacgccgacaagatcaaccgcgtgggcatccgcgtgcacgacctgttcaacgcggagcacctgcatgacaaggtcgaggccagcctgcatcagaagaaccagatgctcgtcaagctgtacaaccgtcgcccgatcgacgtggacgagaccaccgacgagctgctcaagctcggcgaacgcctgaagccgtacgtggccaacacctccctggtgctcaacaaggcgctcgacgagggtaagaccgtgctgttcgaaggcggccaggccaccatgctcgacgtggaccacggcacctacccgttcgtgacttcctccaacccgaccgccggcggcgcctgcaccggcaccggcgttggcccgaccaagatcacccgcgtggtcggcgtctccaaggcgtatgtgacccgcgtgggcgaaggcccgttcccgaccgaactgttcggcgaggaaggcgaatggctgcgcgcccaaggccacgagtacggcgtgaccaccggtcgcccgcgtcgctgcggttggttcgacgcggtcgtcaaccgttacgcggcccaggtcaacggcctgaccgacatcgtgctcaccaagctcgacgtgctcaccggcctcaaggaaatcccgctgtgcgtggcgtacgacgtcaacggcgagcgtcgcgacgatatgccgaccgaccaggccgagttcgccgccgcgaagccgatttacgagtccatgccgggttgggacgaggacatttcccaggtccatgacttcaacgatctgccgaagacctgccaggattacgtcaagcgtcttgaggaactgtccggctgccgcatttccgtgatcggcaccggcccgcagcgcgaccacatcatccagatcaactcgctgatcgactgaagctgattcggctgattcgtcgatatgaacgtcggtaacgaacgtcaatgacaagtgccggtgggcctgtgcctgccggcactttgcgtatggtgcgtgcgatggcgtgcgcgtatgacgcacaccgcatacacaccgacggggtgcgcggcggaggaacggaaaaggggagtgcgatgactgcaatgccgcctaacgacaggttcgacaggtttgacaggttcagcaaactggtcccgcgattcgaccacctgaaatggaagatggccgctgccggcattctcgtcggcctgatttccggcttcctcgtcgtcctctaccgtctcggcatcgaatacggcaccgacaccgcgcgctggatctacgcgcgcatccgcgaaaccccgtggctggtcgcaccgtgggcggtcgccgcaatcacagccgcgctcgccatcgcatggatggtcaaaaaagagccgatggccggcggcagcggcattccgcaaaccaacggcgtggtgatctgcggcctgaaaatgcgatggcagacgattctgccggttcgcttcatcggaggcctgctcggatcgctcttcggcctctcgctcggccgcgaaggaccgtccatccaaatcggcgcatcgggcgcgcagttcctatcgcaccggctgcgcggcaagaaacgtgaggacatgcaggagcattatctggtcaccgccggtgccgcggccggcctgtccgccgcgttcagcgcaccgctgtccggcatgatgttcgctttggaaggggtgcatcgcagtttttcgcccgcgattctgatgggcgccaccgccgcgtccctgaccgccgatttcgtatcgaaatactgtttcggcctgcgtccggtgcttgacttcggcaccatcggccaactgccgctcggcgaatacgggtggctgattccgctgggattggtggccggtttggttggttcgctgatgaaccgttcgctgctcggcttccaaacgctgtacggcaagcttcccgcatggagccgccctttgatcgcgatcgcactcgcgctgccaatcggcatttggctgcctgacgtgctcggcggcggctcgaacctgatcgccatggccgagcatgcgcgcgtcggcttgggcatgctgtgcgtgctgttcgtggcgaaagtgctgttcacctccaccagcttcggttcaggcgctcccggcggcattttcatgccgattctcgcggttggctcactcgccggcggtatctgcggcgagacgttgcaccagttcggcaacctgccgtccgattccgtggcgattttctcggtatgcgtgatgacgggcacgctggccgcgtccgtgaaaacaccgatcacgtcgattctgctggccgtggaaatgtccggcacattgacgcacatgctgccggtcgccgccgtcgcgttcatcgcattgctcgtctccgacctgctgcgtacgaaaccgatctacggcgagctgctggaacggtacatgcgcgcgcaaggcggcacgacggcaatcgccaatcgcatcgacaacggcatcatggaactgcctgtggaaatgggcgcgaccgcggacggcaagctgatgcgtgacgtgcgctggccgtacggctgtctggtgattggcctgcgtcgcggcgaacggcagatcgtgccgcatggcgatacgcggctgcgtgccggcgactatctggtcgtgctgttcagcggcgaggacgaaagcgacgcacggcatgcgatgcggcggctgtgcgacgtgtccgtctgacgcggtcttaccgtcttccataaccattcgtagacgtctagggccacccgaagttatccatagttatccaccgaatcggacatgttcgatgtttggttgcaacgcacgtgtagactcgtacaaggttaggaagacggcacctgcggccagctcgttgccgtatggctggggcggaacgacgctgtccgcggaaagccaagtacaaggggaatgtgatggaatcgcaagaacaacgggcggcagactcgccaaacgcgggtgatgagccgaatcccgccacacagtcgatcgacgtcgccgaagtggcgcgcgcggatgtgcgcccgtccggtgccgccgcatccaagcatccgccgcagattccgctcgcgccgatgaaacgcatgcaggcgcgattcaaccctcttgccgatggtctgatgtatctcgtggtgttcgtcggcggcttcgtcggcgtcgggttccgtcgtgccacggacctgctgctgccgtcggtgaacggttcgccgttcgtggtgggcacgttcgtgtcgaatatgctcgcctgcttcctgtttgcgatgctgaccgaatacatggcgaccgcgtcgtggctgcgccgcagggtgcggcaggtcgtcagccgtggcgtcgggcttggtttgcttggcggactgtcgacgatgtccggcgtgatgttggaaaccatggaaggcatgcgcgagcagcgtttcggcagcgcgctcggctatcttgcgggaagtttcgctggcggtctgatcgcggccgcggttggcgtggcgctgatgcaggcgttgctggcgcgcggcacacgcaagcgggtccgtaacgcgatcgccgatgcctccacggcttccgtatcctcaatgtccgattcgggcgattcggacgcgtacggcatcgtgcaggacgtccagatgaccgacactgcagtatcggctacgcagagtgttacgcagacggtccccatggccgattcgggcgaatcggacgtgccggccgcgcaaaatgtgcagaacaacgtgccggacgcgcagggcgtgcgccacgtgaaggtggcggatgcggcgcattcggccgcgcaggccgcgttggaggccgcgcaggcggcacagcaggcggcccaggtcgcccagcaggtcgcgcagaccgggcaggtgccgaaaatcgaatcgcagccgcagtcatcgcaacccgtcgcacctctgcccagcttcgaacccaagccggtcaccgcggaaatcccgctcgtcgccgacccgaccacaggggaggtgcgctgatgacctggatgatctgcctgttcggcggcatcggcgccatggcccgttatgtgcttgacgtgtcgatccaacgcagctggaaccgtaacggcaaccacagcttccccctggccacgctcgtcatcaacggcgtcgcctccctgtgcgccggcatcgccatgatgtcgtactatgcgcagtcggttgatatgggcacggtaatgacgttcgttgtggggttcctcggcggattctcaacattctcgtcggcgatcaacgaggtgctgtcgctgattcgcaaacgccgtttcgccatggccctgggctatggcgctgccacggtcgcggtgccgctcgcctgcgtggcgctcggattcggcatcgccatgctgggcggccacgcatagctgtcaccggcttggccgcgcgtaattttcacgttacacgggcggtcatcgggtaacgttcaggaaatctgagcgcaaccgcgcgagctgtttcctctcctacgttgtgaaaacaacaagagaggaaaaacctatgacagccgtaacgtatctcacacggcatcgtcgaccgggaatcgtcatactctgttcgattgtcgccgttctctcgatgcttttcgtactccctcccgccatcgcgtccgcagccgattccggcgcgcaggccgtcgatgaatgcaatccgaccgccagcaacggctgcgtcaatggcatcctgcaggacgccgacaagaagccgatcgccgacgtcaccatcacgctgtccggcaaggcaacggcggaaaccaaaaccgctgccgacggcaagtgggcgttttccgttgccgatgacggcgattacaccgtcaccatcgacgcatccgttgcgaaagagcacggtctgaaggcaagcagcgcaacggtgacgatcaggaaagccagcttcgacaagcagcgcggagtcgtccgtttcgaccaagctggcgattccaccggcagcggcacgtccggcacatctggatcgtccggctcggcaaacggcacgaaaggcgcgaccggcacatccggatcgacggcggccacgcaatcgccagtcaaaaaaggcggctccaatgtcggcaaacgcatctggcagcaactgtattccggcattatcttcggcctgatgctgggcctcatgtccgtcggcatgaacctcgtctacggcaccactggcctgcagtcgttctcacacggcgaacaggtgacgctcggcggcctcatggcatacgtcggcacgcagatgctgcacatgccgctcatcgcctccgccatcttcgccatcgtcatcggcgcgctgaccggcttcatccaaaacgaaatcgtctgggggccgctacgcagacgccacgtcggcaccatgcagcagatgatcgtcaccatcggcctgtccatggcgttgcagtacacgttccagttcttcttcggtggcgacatcaaaggcatcgtcaaatcggtgccggacagcttccagctcggaccgatcaccaccgacatgccgacgctggtctccgcgctcatcgccatctgcgtgatcgtcggcgtcaccctgttcctctacaagacgcgactcggccgcgccacacgagccgtgtccgacaacgcggcgctcgccgcagcatccggtatcaacgtggatcaggtggtccgcgtggtctggatcctctcgtgcgcgatggcagccctgtccggcgtgctgctcggcgtctacctgaacggcatctcctggaacaccggcgcgaccctgattctgctgatgttcgccgcggtgacgctcggcggcctcggcaccgccaatggcgcgttgatcggctcgctggtcatcggcatcgtggcggacatgagctcgctcgtcatccccaacgatatgcgttacgccagcgcgctggcaatcctcatcatcgttctgctggtgcgcccgcagggcatcttcggcaagcagcaaagggtgggctgatccatggacatcatgacaatcatctccaacgcggcgggcgaactgatcgccccgaccacggcggcgtacgtactcgccgccatcggtttgaacattcacttcggcatgacgggcctgatgaacatgggccaggccggtttcatgctcctcggcgcttacggattcgccatcacgcagtcgatgggctgcaacctgttcgcctccgtatgcgcggcgctcgcgctcgcggtcatctacgcgctgctgctgggcattccgacgctgaaactcggacccgactatctggccatggtcacattggccgccgcggaaatcatccgcatcatcggcagatcgacggccatgacgaacttcaccggcggttccgcgggcatctcgccgcaggacttcaccgagaaattcgaatcgctttcgccgctgccggacggttcgaccacgttcctgctgtggacgtacagcaacaacatcgccaactcctggtggctgcgcatcgtggcatgggttttggtggtgatcgcggcgctgctgtgctggcgctggttccactcgccgtggggccgcatgctcaaaggcatccgcgaggacgagaacgcgatccgttcgctcggcaagccggtgacgcgatacaagatggaatcgctgattctgggcggcctgttcggcgcgatcgccggcatcatcttcgtcctgccgcgttccgtacagcccgattcgctcggccgcaccgtcaccttctacgtgtggacgattctgctgctgggcggcgcggccacgattctcggcccggtgcttggctcctgcgtgctgtgggtgctgctcaccttcgtcaaggaggtcatgcgcaacaccgttcccgaaaccctcatctcttccaaccagatcgaagccctcggctgggtgatcgtcggcgtcgcgctgatgtgcctggtgatcttcagaccacaaggcctgttgggcgaccgaaaggagttggctttccatgcctgatacaacgaattctccgaccactggcgtgcagccggccacggaacccgcaaccggcgtgcaacccgtatccggtgtgcagcccggcgtaccattccaggacctcaccaaatgggccaccaaagctccggaaggcgagaccctcatctccaccgcctatcgtgacaaagtcaccgacgatctgaaattcgtcgaaaacaagccgggcgtgcacaagcccgacccgatcctcgtggccgacaacgtgacccgcaaattcggcggcatgaccgccgtggacgtgagccacttcgaaatcgaacggcacggcatcaccgcgctgatcggaccgaacggcgccggcaaaaccacgttcttcaacctgatgaccggcttcgatacgccgaacaccggcacctggcagttcgacggcaaggacatggcccacgtgcagcccgaaaaagtggcgcgcatgggcatggtccgcaccttccagctaaccaaggtgatgagccgtctgaccgtgctcgacaacatgctcctcggtgcccccgtgcagccgggcgaaggcatgttccgcgcgctgttccccggcatgtggaggaagcaggagcaggcgaacatcgaaaaagccgaggcgctgctggaacgcttcctgctgatcaaaaagaaggacgattacgccggcgcgctttccggcggccaacgcaagctgctggaaatggcacgagcgctgatgtccgacccgaaactggtcatgctggacgagccgatggccggcgtgaatcccgcgctgaaacagtcgctgctcgaccacatcatggcgttgcgcgaggaaggcaccacagtgctgttcgtcgaacacgacatcaacatggtgagacacatcgccgactgggtcaccgtgatggcggaaggcaagatcgtggccgaaggccaaccgaagagcgtgatgaacgatccggccgtgatcgacgcatatctgggcgcccacgcgaacgtggacctgggcgacgattccgtgctggaagacctgaaggaggcctgaaatgagcgacatcgcaagcgtggccgacgagccgctgacccgcgcgcagatccacatgggcgagcccgaaggcgaaccgttgctcgacgcggtcgatttggtggccggatacattcccggcgtgaacatcctgaacggcgcatccctgaccctgcatgaaggcgagatcgttggtatcatcggcccgaacggcgcaggcaaatcaaccctgctcaaatcattgttcggcctggtgcacatccactccggcaagctgctgctgaaaggcgaggacatcaccaacctgcgcgccgacaaactcgtctcccgtggcgtcggcttcgtgccgcagaccgaaaacgtcttccccagcctgaccatcgcggaaaacctgcacatgggcgcgttccaagcaccgaaactgttcaacgaacgcttcgactacgtgtgctccatcttccccaaactcggccagcgcaaaaaccagctcgcaggccaactctccggcggcgaacgtcagatggtggccatggcccgcgccctcatgatgaaaccatccgtcctcctgctcgacgagccctccgcaggcctgtccccaatgcttcaggacgaaaccttcatccgcgtgcgccaagtcaacaaagccggcgtatccgtggtcatcgtcgaacagaacgcccgccgctgcctgcagatctgcgaccgcggctacgtcctcgaccaaggccgcaacgcctactccggcaagggccgcgacctgatgaacgatccgaaagtcgtctccctctacctgggcaacctggaagaagaggttcaagaggaaggaaggtaggacccaggaaatcgcggaacggagcgtataccgcctttccttgccgctcgacgtacgttcgtacgccttcgggctcggacggcggtctccgcacgcgttccgcgatttccccctatgattcaaaattctcaattccgattaccgctgttggggcactgcccgacagtggcttcggcatgcctgaaaacaagctcaaaaccttgtgtttccaacagttttcgggcttcaccttcggttaacttcacgcatacacattcggtttcctcggcacttatagtgcgattcaagatggtcgagcaacacatctcgataatcgtcaccaagggttcggcaatcagcggagccaagagaggaaacggtgattcaaatgaagaagatcaacatgaagggcatgaggaaactgtccatcacagccaccgccatggtggccgccgcagtcatggcgctcgccggctgcggttcatccaactcgtccagttcatccagcagttcggcaagcacctccggcaccaaaaccagtaagttcgtgcttggtggcctatggccggaaaccggctcactggcctacctggccccgccggaactggccgccgaaaaacttgccgtcaaagacatcaacgacgctggtggcgtgctcggcaacaaaatcaccaccgtcgacgccgacacctccgacgcggaccacgccgaccagaacacctccgccgcccaatccgtcctcagcaagaacccgtcgttcatcatcggcccggcctccagctccgtggtcaagaacacctacaagtccatcacctcgcaaaacattccgatgctgtcgatgggcgccacctcggccagcttctccggcctttccgactacttcttccgcaccgtcgcccccgataccgtgcagggcgcggtcatgggcaacctgattgcccaggacggcgtgcagaagctcgccatcgcggtcttcaacgacgaatacggtaccggcctgcgcgacaccatcgtcaaaaccgcatccgcggcaggcgtcgacatcatctatggcgaaaaggacacgttcgacccgaccgaaacgaacttctcatccatcgccaccgccatcaaggcatccaaccccgacgcgacgctcgtcatcgccttcgatcagaccaaaccgctgctgaaggcgctcgcttccgccggagtcaacaccaagaagctgtacttcgtggacggcaacacctccgactattccagcgaactcgacgcgggcctgctggaaggctcgaagggcaccatcccgggtatcaatccgtccgacgacttcgtcaagcgcctcgaatccaccggcgtcgacctgaaaaacaccaccacctacggcgctgaaacctacgatggcatcatcctcgccgcgctcgccgcacagaagggcggcagtgccgatggcaagaccatccaggccaatatggcggccgtctccggatccaccaagggcgagaagtgcgattcctacaaggcctgcgttgccctgctgaaggacggcaaggagattcagtacaagggccagacctccatcggcgcgttcaacgacgcgcatgatccgagctcggcttccatcggcgtctataagtacgacgccgacaacaagccggtcttcgaccactcccaggaaggttccgtaccgaaggcatgacggtcggttcgtccgtggtgcggactgacgtgatggccggacgtgacggctgacggccaagccacgcaacgcaaggggcggtgcgacgcaagcgagatgatcgcaagtgtctcaccgccccttttgcgggcggaacgcgtgtggagtacatgcggagcgtgcgtggaagatgcgtggaacgcgtcgtgaaacatacgtcgttcacgggtgaaaaagtggatttttcgggggaattgaagagggggagggcgtctttcgtcaattgatagttcatattgtgcgaacgattgcaaagaaacgttacagatgcatgtaaaataacacataatatcgcgatttgtaaggaaacatcccgacgatgcgggggagaggtgttgggcaatggtcggcatgcgtgacgtggcgaaagaggccggggtttcgctgagcacggtttcgctagtggtcaacaagacgggctacgtgtccgacgacatgcgcgcgcgcgtcgaagccgccatgaaagagctcaattacgtgcccaacgagctggcacgcaacctgtacaagaaccgcacgaacctggtcggcgtgatcgtgccgaccatccgccaccccttctttgccacccttaccgcgcatctgcaacgcgagctggccgcgcaaggactgcgcaccatgctgtgctccaccgccgacgcggaaaacggcgaggttgaatacgtggacatgctgcgccgtcacatgatggacggcatcatcgtctgctcgcacaccacccatccgaacgattactggacgtccatccaccgcccgatcgtcgccttcgaccgtgtgctgggcggcggcatcgcgtcgatcggctccgaccatgagcagggcggccggctcatggcgcacatgctggtcaacaccggcgcgcaccacgtggtgatgatcggcggcccgcgcgaccagttcttcgatttggcggcgcgcaatggagacagcccggacgatttcgacctgcacaagacaacgttcccgaccgtccgctactaccttgcgctggagcaggagctgaaagcggccggcgtgcggtacgagtacgtcgaagccggcaatgtggaggatttccaagggtataagaacgcggtgaatgctgtgctcaacagtatgccggtggacggcgtcgatgccgtggtcagctccgatatcggtgccgcgctttgcgtgcgcgaagcgatgcggaggcatatttcgattccgcgcgacctgcagatcatcgcctacgacggcacgtatctgaccgacctggccggtatgaaaatgaccgcggtggcgcagaatttcgacaaaatcgcgcaggtcgcggtcggcaatatcgttcgtgcgatcgccaaggaaggggatgccaaggcagatacgacaagcgccacgggacgcaagccgtacgagccggacgtgctgattcccgtgacgctcaaactgggcgataccacccgctaagcgggccgtatcgcccatcattggacgggccgttttacctgctaagcgggtcgtttcgccttattcgtaatcgccggtcggaccgattttcaacgcgtcctcgtgcgtgcggcccgaatggatcgcatcgttgatcgcctggatctccgctgcatccacggcaagtgcgcgcccgtcgatcgcgctgatcggaatcgaccatccgccgtgcgtcatgtacaggctgtccgcttcgcgtagttcggcgatcggcagcttcctgtactccgcctttttgccttcttcaagcgcccaggcgaacatttcgcgctgtgatgtgccattcagaataccgatgcgcgggtcgggcgtgacgaacgtatcgccatagcgtgccacaatcgacgaattcgggcattccatcgtgtagccgtcctccgtgaacagaatcgcgtcgccgacgccacggcgggcgcattcgcggtgcacggcgcagttgaacgcgtagctcagcgtcttcgcgccgttgagcagccacggggcgcgtgcggtgatgtccgacgggtagccgcgcgtcatcgaagccatggtgatcggctccagcgaatgcagcgtgcccttcgcgtcaaggaagatgtagacggtcggcgtgcggtcggccgccttgcccacgccggtgtccggatcgagaccacgggagacgatgatgcgcagcatcggaccgggttccggatcgtcatactggtcgatgaccagctggaccgcgcgggtgagcgctggaatgttcggttccggcatatccaccagacgggccgaattcgcaagacgcttcagatggttctccagcgagaccgggaaacccctccataccgtggtcgcttcgaaaatgccgtcgccgcgcagcgcgcacaaatcgaacgcgttgatgatgggactttccggatcgacgaaacgaaccagatccgcgtcgggcgccacgcctgagcctccgaatagcgtcttgccgttaccgactgccagaacgatcgaactcatgggaacctctcttccgcgctccgcgtcttttgattgccgctttattgctgttgcgctgttgtgttgcgtcagcgttcgcgtgcgtcttcggcgtccaacctaaccatggtttgtttccacttggcaccgccaatttgcaatgcggaaacatacgcgtcatgaatcgcgcggctcccgtaacgttcggcgaccaaggtgagggaaagcgactctgaacgtccgtttctgcggaatcggatttcggagttcgtcggcagttcgttcggaaaaggccggacggcggccgacgggaaaggtaagcgcaatggtggatgggatgtccgatatgggaacaaccgaacttggcgcggcgagcacgcccgaacaggcgcgcgccgcgttccgtgacggcctggtccgcccgacctgcggcattgcgcaaggctacgcgcaggcgaatctgatgattctgcccaaggagcaggcattcgattttctgctgttcgcgcagcgcaatcacaaaccttgtccgctgctggaagtgatggagccgggcgtcaccgcacccgtcaccgcgccgggcgccgacatccgtaccgacgtgccgttgtaccgcgtgtggaagcgtggcgaactggtagctgaagtgcccgatattcgcgagtattggcgatccgatttggtcacgtttgtgattggctgcagtttcacattcgagtttccgctgatggaggcgggcgtgccggtgcggcacatcacggcaggccgcaacgtgccgatgtacgacacgtcgatcgagtgccgttcggccggcgcgttccattcgacgatggtcgtgtcgatgcgtggcattccgtctacgcaggtggccgacgcatgccggatttccggctattacccgtccgtgcacggtgcccccgtatgtgtgggcgacccgtccgcgatcggcatcgacgacatcatgcatcccgactatggcgatgcccccgtgttggagccgggcgatgtgccggtgttctgggcgtgcggcgtgaccccgcaggccgcggtgatggcgtccaaaccggaattcgcgatcacgcacgcgccggggcacatgttcatcaccagcaaacgcgatttggaatacatggtgtgaggccgagcggcaggttgcggggcgcggcatgagatgcgtgctgcggcgactgcggcagaagggacgtcgcggctgaagaacgctgcgacggtagaacgacggaaaggcgacggaaggaatggaaacgatggctgtgcaggaaacagacggaaagcagacggctatgcgaatcgatatgaacagcgatatgggcgaaagcttcggtcgttggacgctcagcgacgacgaggcgctgctcgacgtggtttccagcgcgaacgtggcgtgcggcttccatgcgggcgacccgtccgtcatgctgagaacgttgtcatacgcggcgtcgcggggggtaatggtcggggcgcatgtggcgtaccgcgacctggccggattcgggcgccgctatgtggacgagtcccccgacgaactcaaggcggacgtgatgtaccagatcgtcgaatacggcggcctcgacggcgtgcatatgacgaacgtggcgaccgtcgacggcctcgaacccgaccgttactttaagcaggtcggccagcttacggactgcgcccgcagctgaagtcctgtgcccaaggctgagagccctgcgctcgcggctgcccccgcatgtccgtcgctttcgaatcgggcgccggagacatgcgccgcgattcggccgaaagccggttcgacacgcccgaacaccggttgcggttttggtgtcgagccccattttgcggtaatatcgaaccggttcgacacaaccgtgggaatggccgtaaggactcccgcaaagaatctcgcaacgactttttggaaccgaaggaggctccatgaaaaacaaggtgcagctcatcacttacgccgaccgccttggcgacggcaccatcaagtcgatgaccgacattctgcgcacccgcttcgacggcgtgtacgacggcgttcacatcctgccgttcttcaccccgttcgacggcgccgacgcaggcttcgacccgatcgaccacaccaaggtcgacgaacgtctcggcagctgggacgacgtcgccgaactctccaagacccacaacatcatggtcgacgccatcgtcaaccacatgagttgggaatccaagcagttccaggacgtgctggccaagggcgaggagtccgaatactatccgatgttcctcaccatgagctccgtgttcccgaacggcgccaccgaagaggacctggccggcatctaccgtccgcgtccgggcctgccgttcacccactacaagttcgccggcaagacccgcctcgtgtgggtcagcttcaccccgcagcaggtggacatcgacaccgattccgacaagggttgggaatacctcatgtcgattttcgaccagatggccgcctctcacgtcagctacatccgcctcgacgccgtcggctatggcgccaaggaagccggcaccagctgcttcatgaccccgaagaccttcaagctgatctcccgtctgcgtgaggaaggcgtcaagcgcggtctggaaatcctcatcgaagtgcactcctactacaagaagcaggtcgaaatcgcatccaaggtggaccgcgtctacgacttcgccctgcctccgctgctgctgcacgcgctgagcaccggccacgtcgagcccgtcgcccactggaccgacatacgcccgaacaacgccgtcaccgtgctcgatacgcacgacggcatcggcgtgatcgacatcggctccgaccagctcgaccgctcgctcaagggtctcgtgccggatgaggacgtggacaacctcgtcaacaccatccacgccaacacccacggcgaatcccaggcagccactggcgccgccgcatccaatctcgacctctaccaggtcaacagcacctactattcggcgctcgggtgcaacgaccagcactacatcgccgcccgcgcggtgcagttcttcctgccgggcgtgccgcaagtctactacgtcggcgcgctcgccggcaagaacgacatggagctgctgcgtaagacgaataacggccgcgacatcaatcgccattactactccaccgcggaaatcgacgagaacctcaagcgtccggtcgtcaaggccctgaacgcgctcgccaagttccgcaacgagctcgacgcgttcgacggcacgttctcgtacaccaccgatgacgacacgtccatcagcttcacctggcgcggcgaaaccagccaggccacgctgacgttcgagccgaagcgcggtctcggtgtggacaacactacgccggtcgccatgttggaatgggaggattccgcgggagaccaccgttcggatgatctgatcgccaatccgcctgtcgtcgcctgacggaaaatttcttgcgattacgtattttcttgcgattacgtacggccttgcgattgcgttccaccttgcggtcgcgcacccggtccgtcgcacccggtccgtcgggcggacggcagtggccgcacgtgttggtatcgtaagttgcgttgaagaatcgcccgaatgcgctgaagcaatgcgtccgggcgattttcgtatgtgtcgctcgtagcgggcgggcgcatgcgtggagtatcgaagcacatgaaacgcgacaagcagaaaacgcgataagccaagaaaacagcagatatgaccgaagacaatcagaataacgaattcaaaccgcagccgctgcccggccaggtgttcatccgcccgggcatcgacgatcgccccgattatgagaagaccctgactcccgaagcgaaggcggccatgcgccggctgtcggtgcagcagcatccgcgtattccggaagcgtccaacgagcgtccggaaacccaggccgcgcgcatcgcatcggaaggtggagcgcccctaaccgcggccgcgcatcttgacgtggctgtgccgaacctcgaatcgtccttcctcgacctgcgcgacccgatgaccgctccggacggcaccaagccgaccgcaatgcaggccaaccggctcgttgcgggttttgcgcttggctcaatgctgctgtccgctccgatggcggcgttcaacacggtgctcattccgcaaaccgtcagccgtttgtcgggaatcaaccgcgtcacggatttggcgatgctcgtcatcgcaggtgccatcatgacgttcctgctgaatgcatgcatcgccgtcggttccgaccattcctactgccggttcgggcgccgtacgccatggatcgccagcggcagcgtattggcggctatctgcatggcgattctttccgcatgcgattttctcccgtgggccgtgttcttctggctggccacgcaggccgcgtatgcgatggcggccataccgttcgccgccgcgttcggcgaacgtgtgcctgacaagttccgcgaccgcgccgattcctggcacggcaaggggctggcgcttggccagctggtcggcgtcgccgtggctgttgcgctgacgccgcatgccggtggcgaaggttgggatggcactacgggtttcgcgatgctggtattcgcgggttggcttgtcgtcgcggccgtcgttacgctgttgatattgccgttcgaaggggccagcagctacctgccgcgtagggatgttgagaaaggcgatttcttctcgcaataccgtccgccgcagaacgcgccgaagttttctgtggcattcgcggcccgcatgttcgccgttgcggccacagccggaatcgccgtatatcagtggtatctggcgccgaatatcgtcggcaataccgatgaggccggtttgttcggcattgccggtgccggatcggtggttgtggtcatggccatctgcacgtttgtcggtgctttgattgcggcgttgctgcttggccgcgtcgtcagcctgtttggcgatctgcgtattccggccgtcgcgtccgccgtgttgttcatggtcgctgcgctgctgccgttgctgatggacgacggtttcctggcggttgcgctgtacgccctgcttgccggcttcgcatacgtggtgttcgatggcgccagccaaagcttggatcttgcgatgctgccggatgtgcgttccgtgggccgatcgcttgccgcttatagtctggccaatacgttcggcacgatactgggcgtcgctgcctgcgccgcggtgattgtggcgaccggtgccaccgtgctgatcttcgctgtcgccactgtttcgatgctgttggcgggtctgctgacattgcggttgaaatcgcaacaatgacggcgactatgacggtgctagatcgccaatgattggaaaataaagcgaaacggcgcgtccacatagtgaacctttagtggataggggagatggacgcgcctatgtttacggcttagttcgagcggaaatcccgcccggggaaatgactttgcgaaaggaggttcgccacgatgaacggaatggtcgcacacgtactgctgtccgcacgaattattattccgctttcgttggcggactgattcgagcattgcggcttcaatccctcgccaacgaaggcagggtttgaggcgcgcgtaacacacacgttgatggccctgcataatgcggggccatttttgttgcagcccacaaggcagacgcagcgaaaaccttttgaagccggccggcatagcgcacaacagaaaacagaaaaactacaaacaacatcgttatcggcggaagttgggaaccggtaacaggacgtacagggagtacatcaatgagtacagtcgaagcggccgctggcaaagcgcaggcgatggtccgcgattcggtcaaaaccgtgatcgcagcatccatggtcggcaccgccatcgagttctacgacttttacgcatacggcaccgccgctgcgaattatttcccgaaggtgttcttcggagacaccaccaatccgaccgtcgcgctgctggccagcctgctgaccttcgccatcgcgttcatcgcccgtccgctgggctcgttggtgttcggccacttcggcgaccgtatgggccgcaagaccacgctggtggtctccctgctcaccatgggcattgccaccttcctgatcggctgcctgccgacctacaaccaatggggtgtcgcggccgtcgccgtgctgtgcctatgccgcttcgtgcagggcatcggccttggcggcgaatggtccggcgccgcgttggtggccaccgagaacgctccggaagacaagcgcgcgctgtacggctccttcccggagctgggcgccccgatcggcttcttcctgtcgaacggcacctacttcctgctggagaccttcaacgacaatgacgcgatgcttgcctggggctggcgcgtgccgttcctgctgtcctccatcctcgtgatcgtcggcctcgtcgtccgcgtccagatggaggagaccccgatcttccgtatggcccaggagcagaagaaggtcgtcaagtccccgcttaccgaagtgttcaagaagagctggaaggaagtcatccaggccacgttcctggtggccgtcacctacacgctgttctacacgctggcaacctggtccctcgcttggggcaccaagaccgtcgagcagggtggcggcaacctgggcttcaccaaccaggagtatctgctgatgctgatgatcgccgtctgcgtgttcgccgcgttcatcgtgatctcctgcgtgaacgccgacaagttcggccgcaagcgcgtgatcatcatctcctcctgctgcctcatcgcgttcgccctgctgttcccgttcctgcttgatccggcggtcgtcggtcagcgcaacttcgccaccaacctgctgttcctgtgcatcggcttcgctctgatgggtaccgcgttcggtccgatcggcgccttcctgccggaactgttcgacgccaacgtgcgttactccggctccggcatcggctacaacctggctgccatcgtcggcgcggccttcgtgccgaccatcgccacttggctgtcccatcattggggcgtgcattccgtgggcctgtacctcggtgtgatggccctgtgctgcctcatcgcggtgttgagctgcaaggaaacgaagaacgtcgacttcaccaagtgacgccgaccggcttgccgggctgcttcgcttggggtggctcggagccttagaaaaaacgtttgacgtgaatatagccactatgtgaacgccaacagacatcataaagaaagcggtactagaacagttccgcaggagaggcggagtggttcctcggacacaatccggggggagcaacatcctaggaatcactcgccgtgataacaaccgaaaaaagaatagaaaatagcgagtttgttcggaaaaagcaagttccgaatcgcaaaaaacaataaaggagcgccaattatggcagcaactatctggtacgaaaaggacgccgatctgtccgtgttcgatggcaagaaggtggccatcctcggttacggttcccagggccacgcccatgcgctgaacctgcgcgattccggcgtcgacgtcgtcgtcggcctgcgtcctacctccaagtccgtggagtatgccaaggagcagggccttgaggtcaagcctgttgccgaggccgttgccgaagccgacgtggtgatgatcctgctgcctgaccagtaccaggccgccgtgtacaagaaggacgtcgagccgaacctgaagccgggcgctgctctggccttcgctcacggcttcaacatccactacggctacatcaagccgtccgaggaccatccggtcttcatggtcgccccgaagggcccgggccacatcgtgcgtcgtgagtacgccgctggccgtggcgtcccggtcgtcgtggccgtcgagcaggatccggatggcaagacctggccgctgtgcctggcttacgccaaggctctgggcgcgctgcgtgcaggcgccatcaagaccaccttcaccgaggagaccgagaccgatctgttcggcgagcaggacgtcctcatgggtggcatcaaccacctgtgcgatatgggcttcgatgtgctgaccgaggctggctaccagccggagatcgcctacttcgaggtgttccacgagctgaagatgctggtcgacctggccaacgagggtggtctgaacaaggcccgttggtcctgctccgacaccgcccagtacggcgactacacctccacggtcatcaccgaggagaccaagaagcgcatgcagtaccagctcaagcgcatccaggacggctccttcgccaaggagttcatggatgaccaggccgctggcgctccgaagttcaagaagctgcaggaagagtacagccacccgcacctggagaccgttggcccgaagctgcgcgccatgttctcctggaacaaccaggtggacgccgacgccgatatggccgagtccttcaacggcaagatcgctcgtactcaggttcagtgagattgcttcgctagctgcataagctatttagcgaattagaaagcgtcgcccgcttcgtgcggacggcgctttttgcatatcgtcgtgcgtgcgacggttgcgtacgttccggcataacgaaaggccgccacccaacttgggcggcggcctttaatcgcagttaatgcgattaatcgcaatgaatgcgagacgttactcagccacgggcgatcttgccggtgaaagtggccatgtcagcgtcgtcatccttgccgttgttccaagagaacatggcgcgcagcttcgggccaacgctctcgatacgcacgttgccgtattcttcctgcagctgcttgaacttcggagcgccagcgtcctgatcgtcgatgaactccttggcgaaggagccgtcctggatgcgcttcaggtggtactgcatgcgctcacgcacgtgctcgtcgatgcaggtgttggtgtagtcgccgtactgggcggtgtcggagcaggaccaacgagccttgttcaggccaccctcgttcatgaggtcgacgagcatcttcagctcgtggcagacctcgaagtaagcgatctccggctggtagccagcgtcagtgaggacctcgaagcccatttcaacgagcttgttcacgccgcccatgagcacgttctgctcgccgaacagatcggtctcggtctcttcggtgaaggtggtcttgatggcgcctgcgcgcagggcgcccagagccttggcgtaagccagggtgatgtcccaagcgtcgccgcgcggatcctgttcgacggccacgacgaccgggacgccacggccgttggcgtactcacgacgcacgatgtggcccgggcccttcggggcgaccatgaagaccgggtggtcctcggtcggcttgatgtagccgtagtggatgttgaagccatgagcgaaggcgacggcggcgcccggcttgatgttcggttcgatgtcgttggcccagatggtgcgctggtactgatcgggagccagaatcatgatgatgtcggcctcggcggcggcttccggaacggacttgacttccagaccctgctccttggcgtgctcgacggacttggaggtcgggcgcaggccgacgacgacgtcgacgccggaatcgcgcaggttcagcgcatgggcgtggccctgggaaccgtaaccgatgatggcaaccttcttgccttcgaggaccgagagatctccatcgttctcataccaaatttgtgcagccattgtacttggcactccttttgtgtagtggggtgaacgcttggaaagcgttcgggtttctaccattcgcagatgaaattcgtggtttcgtgcatggattttgtcctgcaaactggggtccatcctaccggagcggccgttttggtacgtatccagtccacaaagtgagccgcgaaatcgtaaaaaattcgtcgcggcgcaatcgtgatacctttcctgcgaaacccctaaggaagcgacgtttcgggccgttggaatgttgtttccgttgggaattgcgattaagcccctaccgaagcgacgtttcaatcgctgaaaatgacgtttgtgtgggcaagcatgtgcttatttaggtgacgcttcatgcattttggtaggaaagtggcttaggataggcacgtaggattgtttgatgaggaagctgaagcaatggtcactgcgacggggattgcgcctggttccgaaatgacggcgcagatggagcaggtggaggagcgtaatgtctcgggcgtgctgcatatcgcctcgattttcgcctcgcacatggtattgcaacgcaacaagcccattgcggtgttcggcgcattggctgccgattgcgccggtatggaggttgtggcggaaatacacgactttgacggctccctgattgcgcaggaacatgcttattcttcgcagaacgtggtcaacggcttttcgcagtggcgcgtgatgctgcccgcgcaaccggaaggcggtccgtacacgcttcgtatcgtcgcgggcaatgatgccatcgaattcgacgacgtgcttatcggcgaagtgtggctcgccggcggccaaagcaatatggaacttgagttgcgtaacagcgagcatgccgacgaagcacttgaggattgcgccgatccgctgctgcgtttctacaatgtgcccaaaaccggtgtcatcaatcgcaatgcggaaaatacgtcgagttggcaggaatcatcgccggaaaacagtggcgtgatgagtgccgtcgcctactatttcgcacgcaagctgcgctccgaactcgaccccgatctgccggtcggcattgtcgactgctatatcggcggcacgtcgatcagctgctggatgagcgaggacgcactcaattccagcgatgccggccgcgactatctgacgcgctaccagcgtgcgatcgcaggcaagacgcaacagcagttcgagctggaaaccagcgaatggcagtcgcagatggacgcatggaacgcggctgtggaaacggtgcgtcagaccaatccgaacgcaacgagcagcgagttgagcgaacagtgcggcacctgcccgtggccgccgccgctcacccctacatcgcaatggcgtccgtgtggccccttccacgccatgctggaacgtatcatgccctactcgctggccggtttcctgtggtatcagggtgaggaagacgagcaatacagcggttcctaccgcgagctgctcggcatgatgatcggcgaatggcgtgcgctgtggagcgaaaatctgccgttcctcatcgtgcagttgccgcaatggatcaacggcaagacggctgcggacggcaacgatccgatgcgctggccggtgctgcgtgaggcccaatgggacgccgcgcagtccatagacaacgtgtacgccatctgcacgatcgactgcggcgaatacgacaacatccacccgctggacaagcgcacgcccggcgaacgccttgccaattgcgcgctgcggcaaatctacggcatggatcgcgttccggtgcacggcccgacggtgctgggcttccgatgcgacccgaacggccgcgtacgcctgttcttccgctatgcgcacggtttgcatttcgaaggcaccacgcccggcggcggcgacgacgatgatttcgatggccagctgccgactttggtgcgcgtgccggaacattccggcttcgaactggccggttccgacggtatgttccacccggcgaccgccgcgattttcgtggattgcgacatcgatgatctcgtcaattccagagtgaacgtggtcgattacaacgctacggaattcggcattccgattaacagccgcagcatcggcacgattacgctggcgactccggatgtgccggagccggtggcgatgcgatacgcctggcgcagttggggtccggctccgctgttcaacgacgacggcctgcccgcgcagccgttccgtctggacctgaccgaccatacctcccccgtcgagtccgccgagcccgtcacccccgacggcaccgctgactgaggccgtcggtctggtcgcgccggtctaatcgccccgtctaatcgcaaaaacggcattcccatccggcttttgttaccgtaaccagccgattcgggtaacaaaagccggaagaggaggccgttttgtgtttcttgcgattactcagcggttgcagcagccgcgtcgacaatcaccgccgcgtcctcgccacgctcgctgccggacttgccaagcgcaagctgggcggcggcgaacagcaccgccagccagatgacgccggcgatcacggcgatgcgatagcttgcggagaagcacatgagcaccacaaccagcagcatgaacgcgattaccacatacggcgtcacattggcgaacggcagcttgaacgcgatcttgtcgagcgcttccttgcccttcagccccttaagttcggccgggccatcgccagccgcaaccatgcgacggaacttaatctccgtaatcataatcatgatccagttgatcgcagccgcgatagtggcgatcgacatcagataattgaacgcgaattccggccatacgaacacgacgacaacggcaatcgcaataattatcgcggaagtgataacacccccgaccggcacgcctttcttgctgagcttacccaggtaagccggcgcgttgccctgctttgccagcgaatacagcatgcgggagttggcgtacaggccggaattgtagacgctcatcacggcggtcaggcacacgaaattgaggatgccggcggccgcgtgcacgccgacggaatcgaagatctgcacgaacgggctggaatcgccgtcgattttgctccacggaatcaccgccatgatcacgccgagcgcgcagatgtagaagacgagaatacgccagatgatgccgttcgtggccttcggaatggtggtgcgcggattctcggtttcgccggcggtgatgccgatgagttcggtgccgccgaagctgaacatcaccacgacgagcgccatcagcaggccggtccacgtgccgtcggcgttgcgggtcatcaggccgtgcggcaggaatccgccgtccacggtgaaccagttggcgaagctcgcgcgaatgcccgaagcggtcggcacgttggcgatcacgacatacaggccgccgagaatcatggccagcacggccacgatcttgatgatggcgaaccagaattcgaattcgccgaacttgttcacgcccatgagattcagcgccgcgatggccacgaggaacaccgccgccgacacccacttcggaatgttcgggaaccagtagttcacgaacgagccgaccacggcaagctccaccatggccaccagcacgtagttgaaccagtagttccagccggaaatgaagcccgctcgccgtgaccagtagcgcgtcgcgtagtagctgaacgcgccagccttcggatcctcgaccgccatctcgctcagagcgcgcacgatcatgaagatcgcgagaccgccgacgaggtaggcgagcagaatggacgggccggccagctggatggattcgctggagccgtagaacaggccggtgccgatggcgccacccagcgcgatgagctggatatggcggtttttcaacgatttacggagcgtcggcggaaccggcacgtcgtcggttccacgcggcttctttgcggcggtgacgtcgctcatggagatttcctcttctctgtttccttgcgattgcgcgttgtgcgttgcgctcgctgcttgcgttgcgtgctgttgcacgcttgcatgtgcttgttttgcttgcttttttgcgattcgccctttgtgagggaacgtttccgattgtagcgggaagcggcgggcaaagtgttggtttgttcgttccggaatgtctggtttgcttaacgggttgtttggtttagaagttcgattcgcgcgattgctgtgcgattcgaacgcgcgatttggacacgtgttgcggatgtgcggtttggcgcgtctttccaagcttcatggtgttcaatggaatgaggggctacgaacggaggtcgacatggcattcgtcaaggacatgctgcgaatgtgggcgcattcgtggaaaagattcatttccatcgccatgatcacgttgctcggtgtggccgtgctcaccggcatttacgcgggctgccgtgacgcgttccgcagcaccgatcgctttttcgacgcgcagggcctgcacgacgtccaggtgctgtccactgcgggcctgtcgaacggcgatatcgccgcgttgcgcaaggtgaacggtgttgcgaaagtgcaggcggaacggtcgcaggaagtgacgttcgatttggacggccgcaagtcggcgaccatgcaggaaatcggcacgaacggcattgaccagccatacttgcaggaagggcgcatgccgaagaaagccggcgaaatcgcggtaaccaggaaatttattcgcgattcgggcaagcgtatcggcagccgcctcaccgtaacccccgaatcggcttcctccgatacttccgatacgaacgatacgaacggtgcggacggcacgaatgaaacgaacggcacggacgaggcgccgagcttcccgaccaagctcaccatcgtgggcgtggtgctcgatccgcagaacctgagcaacccggacggctactccgccatgacctcgttccgttccaccgccaccaccgactacacgttcttcgcgccgtccgatggcgtgaccggcaccctctacacgtccgccacgctgctcgtcaagggtgcggccgccgaaagcacgttcgacgaatcgtacgaaaacaccgtcaagcaggtgaccgaccgcatcgacggcaccgtgaaaaccgaccgccagaaggcccgtcggcaggaactgctcgacgcgggcaacaagaagatcgccgacgcgcgtgcggaagccgacaagaagttcgcggacgcgcagtcgcaaatcgacgcgaatcggcagcaattcaaccagcaggtcgaccagattgtcagcatgcaggcgggcgcggcagctgcgggagctgcggcaaacggcgcgaacgcaggtgcggcggcggccgcaggtgcaactacccccaacttgacgaaaccacgcgtgaaacaatgcgtgaaaccatcatcgccgctagtcccgaactgacgcaagccaagcagcagctcgaccaggcgcaatcgcaattgaacgagcagaaggcaagtaccgaacatacgctgaaaaccaaggaaaacgagctgaaaaccagcattccgcaagtgcgctggtatgtgcaggaccggcagtcgctcggcgggttcagcgcgctcaaatccgacctcgactccatccagtcgctcggcaacgcgttcccgattgtgttcctgctggtggccgtgatgatgagcctgaccgccatggcgcgcatggtcgaagaggaccgctcgctcatcggcacgtacgtggggctcggctacgggcggctggcggtcgcgttgcgctacctgctgttcgcgttgctcgcctgcctcatcggcggcggcctcggcctgatcgccggcttccttggcattcctgcgttcctgctggtcgtattgcaaggcatgtatgtgatgcccggtctgcgattggaatacgactggctgtacggctcgctcggcatcgcgctgttcgtggtcggcgtgctcgccgccaccatctacgcgtgcgtgcaggaaatgaggcagacgcccgcctcgctgctgcgtccgaaagcgccgcgcgccggctcgcgcattctgctggaacggattcggccggtctggaatcgcatgggcttcctcggcaaagtgaccgcgcgcaacatcttccgcttcaagtcgcgcctcatcatgacggtcggcggtgtggccggctgcaccgcgctgatcgtctgcggcctggccatcaacgacaccgtcgcagacctcggcatcaagcaataccgcgacatctaccagtacgacctgatggtggtttccgacgattcgggcgcgtcggcgatgcgcacgaaagtcgcgtcagacgggcgcgtcacgtcatcgcttgacgtgcgcatagagtcgggcgatttgacggttgcgggcagtggcgacggtgacagcggcaaggccggcagcagcggcagcgaaagcatccagctggtcgcggtgccggaaaagcatctgtccgatttgggcgaaatggtcacgttgcagccggtctcgtccggcatactgggcacgtccggcgtcggcaaaaccggttcgctgaaactcgatgacgatggcgtgatcgtcgcgcaatcggcggcaagcgcgctgggcgtcaaggccggttccaaggtgcgactgaccaacggtgacggcgtgcaggcgacggcgaaggtgagcgcggtgaatcgcaacctcatcggctcggatgtgtatgtaagcgaaacctactacgccaagcttttcgactcgaaagacgcgaagaacaccaagaattccaagagttccgaggattccgaggctctgacgtggaacgccatgctcgccaagctttccggctccgacacttcgcaaaccgactatgcggaatcgctcgaagaggacagttcggtgatgaaggccgtaagttgcgcgcatatggccgacagcttcaaattcgacctcatgggcgcggtggtggcgctgatcgtggcgctcgccggcggtctggcgcttgtggtgctgttcacgctcgccaacacgaacgtgtcagaacgcgtgcgcgagatggccacgctcaaggtgcttggcttcttcgaccgcgaagtgcaccattacgtgaaccgtgagatgatgatcctcaccgtcatgggcgtgatactgggtctgccgctcggccggctcgtcggcggcatgctgacgatggcgctcaacatgccctcgttgtatttcgaggtggaggtcaagccgctgagctacgtgatcgcggccgtggcgaccatggccttcgcgctgctcgtgcagctgttcgtcaaccccgtcctcgaccgcatcgaccccatcagctccctcaagtccgtggagtagcgctcctccgaagccctctcagttcttcgggtagcggtagttgtgggggagttgggtggtgagctgcgggttcaggccgagttccttgagttggcggtcgatttcgaggcgcgcacgttccacaagttcggcgcgacggctgtccaaaccgttcagcccctcctgcttttccagcgattccaacgtctccgccatacgcttgagccggtcctgatggtgcagcagcgcgcgtacctgcgcatgttcgcgtacgatcgtccgccaatcggatggcgtgtgcgcgatctcccgaaccgcggtgaccggatgtacgtcggccacctgatatgtgatcgagccgagcagcggcatcaggaacaccgtgatcgcgccggctgcgaccagtgtcgacgcggtgtcgctttgcatggtgccgaccttcaccgccagcgacgtgacggcgacgatgatcggcagcgcggtcgtgcaatacagggctacggtgacgcggtgatgcgatgacagcggattcttgcgtttgtcgagcgatagcgcaagatatacgggcaccgcgcgaatcagcatgagcatgacgatgaacgcgacgagcagtgcgggccgtcctgccacggcgcgcacgttgatcgcggcgcctgacaccacgaagaacacaggaataaggaagccgtagccgacgccttccagtttcatttccagcgacttgctgccgtcggggatgatgtaacgcaggatgaagcctgcggcgaacgcgccgagcaccgcgtcaagttcgaacagtgcggaaatggtgacaaggaagatgagcaggaatgtggtcagtcgcatgagcgtttgcgatgacgtgttcgcgttttccgtaaggaaacggtacaggcgatggccggttttcagtgctttcgtaggtagcatcgcgcacagtaggcagatggcgaggaacgcgccgagcacgagcatggtctgccagccggttcgggtggatagcaggatggccatggcgaggattgggccgagttcgccccacgttccgtacgagatgatggcgtcgccgatgggggtgccttcgaggttgcgttccttgagaatcggcatgagcgtgccgagagcggtggtggtaagtgcgattaccgtggcgatgccgttgatgccttgcttggtgaagaacggaaggaatgtcacgaccagccaggcgaggcctagcgtgattccccatgtaagcagtccgactttgccttgatgtccggcgagtcgtttggggtcgatttcgtagccggcgagcaggaacaggaacgccatgccgagctcgttcaagagtttcacggcgtcgttcacttcgattatgcctagtccgtacgggccgagcgtggctccggcggcgagcagcagtacggtttgtggaatgaatcttcccggaatcagctgcgccacaatcgggctgacggccgccaccgccatgatgatagtcagggaaacaagctcttgcgtcataccgtcgagcctagtgagccattgtgaccggaggttgaagaatgtgatttccgctatctgtggcaggtttcttcggggaaaccgacctagggggcatgattcctacccccctaggtctggatttgctcaagggacctgccacacataacgcaaatcgttttcttgtgaagggcgaatctgccacatatagcacgtttcacgacattaagggggtcggtcgcgtttgcgaggcggccaacccccggttctcgtccgccgcgcgcaccgcccgcccgccaaatgctatctagcttatagatgacgggtggttcgccccatttgccagttcggggtataaatcatacccccgaaccgcctattctcgtctagcgcccgccatctataagcgaaatacctttccgcaaagccccaaatccgccatctataagccagatagacccatcagtttgaccatggatagactcggttagagatgctcttggcaaaaatgccaatttcggcctcctgcaagggttttgctggggctaacccgcgatttgcataaaacctaacccacgatttgcgtaagtcctaacccatgatttgcgtaaaacgtggttcgctcagagctgtggccggagaccgtccaagttcgaccgacattatcggaatcgtcagggaagaaggcacgcgggcggagtgcaatataatgttccctatggctggcagttcaagggggcaagactgatggcagtttttccgcatgggagcgcgcggcgggtcgagaagcgacggtccgcagcaaattaaggacttacgcgccgacgatttttatggcgattcgcacgatggcaacgacggctcgcgcggtccgcacgacaccacgcgcaacacctgcacctacaccctcccgactttcgcggaggcgaccgacgcgtccgaagcgatgcgcgagcgtcgcgcggatcgcaacaagtccattgccatgcgcgtgcttgcggcggtgctgattcttaccgcgctcggcattggcatgtttccgagagtgttgcaataccgttcggcgcgcgagctggcgagcacgtcggcgcgttccgaaaagcgcgtggcgggctggccatacccgcaggccgatgaggcgttcgccgcggccagggagtacaacaagcgacttgccaagtcggggcagccggtgattggcgaggcgaaggatccgctcgccgaactgtatgacgatccgcagaatgcagccaacaacgccagcgccgacggctcagacaactccagcgactccgccagcgccaaagacacggaatatcaaagcctgctcgactccggcgatggcgtgatgggggccatccgtattccgaagatttccgtgaacctgccggtttaccacggcacgtccgagctgacgcttgcgtccggcgcgggtcacctgtacggcagtagcctgccggtgggctcgactccgaaaccgccatcagcatcatcggacagcaggcccgccgcatcgacgaggtgcagcgcgaaaacgaagacctccgcgccaaactcgacgagctgaccgcctagcccgctcattcttcatcatgccggcttctgttcctcccaacagagccggcaagcgtcatctgtcagacaaaagcgggcgcattgggcggttcccgcggtagggtgtgaccattatgactttagggaatacgaataccgggaaggccggcacaaacacgcaagctgccgacgcgtctgacgcaacgcagaacgcgcaaagcacacaatcgcatatcaaatccgtcgaaagcctcgacaaagacaacgacatggaacgcggcctgaaaaatcgccatgtccaattcatcgccatcggcggaaccatcggcactggcctgttcctcggctccggcaaatcgattgcgctgaccggaccaagcatcatcttcgtgtacatcggcgtgggcctcatcatgttcctgctcatgcgcgccatcggcgaaatgatgtacagcgacccaagccagcacaccttcatcaacttcatcacccgctacctcggccgcgcgtggggcaaattcgccggctggacgtactggattgtgctcatcctgaccggcatgaccgaaatcacggccgtcagcacctatttcgtcacgttcttcggcacgttcggcattgacctcaacgcgtggaaatggcttatcgaactgtgcttccttgtggcgctcaccggcatcaatctcattgccgtgaaagtgttcggcgaggcggaattctggttctccatgatcaaaatcacgctgattgtgggtctgattgtcaccgccgtggtgatgctgttcctcggtttcagctacccggccacgcatatcgaaggcgtggacggcacggtttccggtgccactgtgagccttacgaacattgccgacggcttccagctcgcgccgaacggctggatgaacttcttcatgagcttccagatggtgttcttcgcctaccagctcatcgaattcgtgggtgtgaccgtgtccgaaacccagaacccgcgcaaagtgctgccgaaagccgtcaacgagctgatcatgcgcatcctcatcttctacgtgggcgcgctcgtggccatcatggcgatcgtgccgtggcgcaacttccaccagaacgcggacggctcgttcggctccccgttcatcatggtgtttaagtacgcgggcctcgactgggctgccgcgctcgtgttcttcgtggtgatcaccgcagccgcgtcagcgcttaactcgctgatctactcggctggacgccatctgtaccagctcgcgcaggattccgaatcgcccgccatgcagcgtctcggcgaagtgtcggaccgcaaggttccggcgaaggcgattatcgtgtccggctgcatgatcctgttctccccgctgatcaacgcgattccgggcgtttccggcgcgttcgtgctgttcgcctcggccgccagcgccgtcgtgatcttcatttacattctgacgatgcttgctcaccgccgctaccgtcaaagcgccgactttctgccggacggcttcgtgatgccggcctggcaggtgtgcgattggattgcggtcgcgttctacgtggtcgtgtatgtcacgttgttcctgtcttccgacacgctcggttccgcagtcgccggcctggtctggtttgtcgtgttcggtggctactgcctgctgcacgagcggttccagaaccgcgacctgaaggcggctctagggaagtagacgtattgcctgtcgctgcggtatgcgtggcatgcgcgtgttgcgctacgtgccgcgcatctgacgaaagagggtcggtggaaaccttgcgaaaatgtgcgtctccaccgaccctcgtcgtgtaatcgcaataaaacagtgcgaaacgttagtgcacgaatcgtacgaaaccgacgcgaatcagccgatgtagtcggcctcgttcgttgggctggacggcacggcatgatcttccgtaaccttgcccaagccagacaaatacgcttcacgaccagcttcgatcgccttcttgaacgcgcgtgccatcagcggaatattgccggcggaagcgatggccgtgtatgccatcaccgcgtccgcgcccatttccatggcttccgcagcctggctcggacggccaataccagcgtcgataatcaccggaacattggaattcttgataatcacttcaatgaaatcgcgtgcacgcagacccttattcgagccgatcatcgcgccaagcggcatcacgcaagccgcacctgcgtcttcaagacgcttcgccgcaatcggatcggggaacatgtacggcatgaccacgaagccttcttttgccagctgtttcgtggctttgatggtttcctcattgtcgggcagcagatacttcgcctcatgctcgatctccaccttcacgaagtccgtctggcacacttcgcgcgcgagacgggcaatacgcaccgcttcctctgcattgcgtgcgccggacgtgttcggcagcatggtgatgcccttcggaatgtagtcgagcaggttgttttcggtggtgcggcagcggcgcagcgccatggtgacgatctgcgtgcccgcgttctcgatggtcgccttgatgaggttcaggtcgtaacggccggaaccgaggatgaaacggctcgtgaacttgtgcccgccgaggatcagcgggtcggcgtcgccggtggcgatctcgtcgtacgcatgagcgtccggctccggcaggatcgccgtgttcgtggtggtgccgaccagctcgtcgagcgtggcgttcggtgcggccgcgacgtcggcggctgcggtggtgatggtgttttcggtgctcatcgtcggttcctttcgttggggtgtttgttgttgttgcgattgctgtgctgctgttgtgttgccgttgcgtcgctgttgtgttgtgtgcaacgtgcgtttgtaatcgcaataaaaatttcgattacggcagtggagtaacgtagcagtgcgtcaggcgtcttcctcgccgaggatcagtcgcgtgatcatgttcgcttcgtggcaggcgaccacgcccacgcgcggcgccatcaggccggcacccggtaccggagccgtctcgccatcgccacagaagtagaagttcttcgaaacgcgacgcgtgctcaccaggttggagctgcggaagccggccatgccggacgcgctgacgagcttcttgcccggcagattctccagcaccgcgttgacgagcatcgtcttgttttccggcacgtcgaacgcctcgcagatgatgtcctcgttttcgaacagcgtcggcacgttctcgtcggtcaccttgacggtgtcgatggtgatgtccgtgaacgggttgatttggcgcagattgctgcgcagcgcctccgtcttgtactggccgaggtccttcaggaaatactgctggcgattcaggttcgtcatatccacgcggtcgaagtcgatcaagtgcaggtggccgacgccgatgcgggtcagcgccaccgcgatggtggagccgaggccgccgcagccgcagatggccacgtgcgccgcgtcgagcttgtcctgtgtggcggccgtgtgacggtcgagcagggctgcgcggatctcctcgcggctgaccaaggtggccgggtcgggctggttgtcgaaagcgtgctggcgggcgtcgatctgcgcctgcgatgcggatggttcaaaagtcatggttgttctcgtattctcgtttccgttcgtatggtttgtttcgctgctgtgctcagccgccctgcacgaacgtgacgatttccaacgtgtcggtgcccttgagctgcgtctgcgcacgctgggcgcgcggcacgatctcgccgttgagctccacggccacgcggtcggcgcgcagaccgcgctgctccactagttcggccacggtgatcggcgtggcgacgtcctcttccttgccgttgatgatcatttcggttcccttctgtatgtcaggccccacgagtgccgttcccgccgaaacggacgttcagaactgctttgtgggcttccgagcgtctgcttccggtgaatcggacattcacggttggtacgaaaaaagggtcgccgaaggaaccgtaccctatgaggtggtgcgcccctccgtgaccctaatcacgcgatattcggttatcgcgaacggaagatgagatacgccttgcggcgcgaacaacccgtctccttacggcggcattacccgcatcaagtcctcggtcgaagctgtatgagctccctctcagcctttcggctcccgttcggttgtgcctttatcttcgcgcaggcgcccgacaagcttgcgccggttcacgttgggttagtcttgatgtgaacatgtgcgaatcggctgcgtgcttgcaaggaaggggaagatgatgatgaacggtgagttggcaggatttacgattcctcggctcggcatgggaacgatggctttggcgattgaggggcgtccggatcgcgatactgcgattcgtacgattcatgccggtttggacgcgggtgttcgctatttggatacggcttggtcgtattatctgccgagcgagcctggcactggcactgcgaaagatttggggtacggcgaaaagttggtgcgtgatgcgctcgcttcgtggaatggcccccgagatgaagtgctggtcgccacgaaaactggctatcgacgcaccatggagatccccgcttttgttgctcctgtgtccgattcgccagaatcggacactcaggggcgggattccgagggctgcagtcgtcggcctggcggggaacgccagcatttgcaggcggcgggcagtcaatacgggtggatggcggattcgcgccccgaaaccatgattcgtgacgccaaggaatccgcgctgcacttgggcgtcgatacgctcgacctgttgtattcgcacggaccggacccggaagtggcttatgaggaccaggtcggcgcgctgaagcagctgcttaacgagggcgtgatccggtacgcgggcatttcccgcgtggacaacgcgcagatcgacatcgcccgcgagattctcggcgacaagctgatcgccgtgcagaaccagttctcgccctcgcaccccgaccctgagcatacgatggagcactgcgcggaacttggactcgcgttcgtgtgctggagccccctcggcggcttcctcgacgcgttcgaccagcgcgcgtacgacccgttccgcacggtcgccggcaaccacggctgctcctaccagcgcgtggtgctcgcctgggaactgagccgctacgagcggttgttcaccatccccagcgcccgcaatccgcaggaaatcaacgattccttcgccgccaccgaactgacgctcacgcaggatgagctggcgatgctgaacgcctccgtcgacgcccgtcgcggctgaattccgcgcaatacgtacgattggccgcgcccgattccgcacaataatcgcgattcgggccgcggcctttttcgtgccttctgtagcttgctcgctgcaaaatcgccctgggaataacttacactgtaaaatgtttacactgtaagatattatgacggcgattgcgacggaaggaggtgccgcgtgggctttgaagaggaactgttccacgaattggcgaccaacacatgggacaaacgctcgcgcatgcagcaggagatggtgaaaggcgcgaagggcgaacccttcgccgtgcaggaactctataggaaaggcccgctgacgccatcgcagctcgcctcttcaatgaaaaccaccaccggacgcgtgtctgcactgttgtccgcactggagaaaaaaggccagatcacgcgcgaatccgaccctgacgatcgccgtgtggtgcacgtgaaccttaccgaagccggcagggagcgcgccgaacgtcagcgcgaaagcatgcgcgaggcgatctgctggatcttctcgcaaatgggggagcgacgcgcgcgcgaattcgttgagctcaccgaggaattcaccacgtacatgtcgctgtgcatgcccggcaaaccgcgccccacggcggacgaggtcaaagccgcgttctcaggaaacgcacaggaagacgcgtagtatcttacgctgtaaataattcacagtgtaagtaatcgcaatccagtaatcgcaaaaaccgcgaaaaatcgcaaaaactaatcgtaagaaaacaagcaaaacacaaaacaagagaaggaaccaagcatgcttcgcatcgtacgatacctctccaaagcggagatcggtcagatgctcgtcgcgctggtcagcatcgtcggtcagatctggcttgacctgaccctgccggactacatggccgacatcacgcagctcgtcgaaacccccggcagcgaaatgcacgacatctgggtggccggcggcaaaatgctgctcgtctcgctcggatcggcggcctgcgccgtcgtcaccggcttcatcgccgcgcgcgtgggcgcctcgttcagccagcgcctgcgttcgcttgaattcaacaaggtggaaagcttcggaccggcggaaatgaaccgtttctccaccgcgtcgctcatcacccgctccacgaacgacatcacgcagatccagatgttcatcaccatgggcctcatgatgatcgtcaaagcgccgatcatggccgtgtgggccgtgtgcaagatcgcaggaaagggcttcgattggacgctcgcaaccggcatcgccgtggccatcctgctggtggtcatcgccgtgctcatgcacttcgtcatgccgaagttcaaggccatgcagcgcctgaccgacaacatcaacctcgtggcgcgcgagaacctcaccggcctgcgcgtggtgcgcgcgtacaacgccgaggactatcaggaagccaagttcaccgaagccaacaaggaactcaccgaaacccagctgttcaccaaccgtgccatggccatcatgatgccgttgatgaacaccatcatgaacggcctgatgctcgccgtctactggatcggcgcgtacctcatcgacgctgccgaagccgtcgacaagctcaccaccttctccaacatggtggtgttctccagctactccatccaggtcatcatgagcttcctgctgctgagcatggtgttcgtgctctggccgcgcgccgacgtgtccgcgcagcgcgtgctcgaagtcatcgacaccgagccgatggtcaccgacggcacgcaggacgcgggcaagccgggcgaggaaggcgaaatcgaattccgcaatgtgagcttcgcctaccccgactcgcgtcacgccatgctcgaaggcgtcaatttcaaggcgaagaagggtcagacggtggcgttcatcggctcgaccggctccggcaaatcgtccctcatcaacctcgtgccgcgtttctacgacgccacgcaaggcgaggtgctcgtcgacggcgtcaacgtgcgcgactacaagctgaaggcgttgcgcgacaagatcggctacgtgccgcagcagtcgttcctgttcaagggaacgatcgccagcaacgtcgcgtacggagatacggaccgcgacgacgacaccgtgcgccgcgcatgcgacgtcgcgcaggcgacggaattcatcgacaaaaagcagaagaagtacgattccggcatttcgcagggcggttccaacgtttcgggcgggcagaagcagcgtctgtcgatcgcacgcgccgtctaccgtcatccggaaatcctgatcttcgacgattccttctccgcgctcgacttcaaaaccgaccgtgccgtacgtgacgcgctcgaaaaggaagcgaaggattccacgaaactcatcgtcgcgcagcgcatcggcaccatcatgaatgccgaccgcatcatcgtgctcgacgacggcaaagtggtcggccagggcacgcacgaggaactgctcgacacgtgcgaagtgtatcggcagatcgccgaatcgcagttgagcgaagacgaactgaagcgctgaaagggggagacatgccaagaggaatgggacgcggccgtggggccgtggaaaagccgaaggacttcggcggagtgatgaagaagctcgtgaaattctgcagccggtacattccggtgatgattctcgcgctggttctgggcgctgccggcacggtgtgccagatcatcggcccggacaagctcaaggacatgaccaacgagatcacgaagggtctgccggccatggtgcacggcaagcccgtcatgaattcgatcgatatggacgcggtgtcgcgcatcgcatggctgctcgtcgcgctgtacgtcgggtacgcgctgctgagctacctgcaaagctggctgatggccaacgtcacgcaacgcacggcacagcagctgcgtgaggcgatcagccagaaaatcaatcgcctgccgctgaaatatttcgacaaagtcagctacggcgacgtgctgagccgcatcaccaacgacgtcgacgcgatcggacagacgctcggccagtcggtcggctcgctgatcacttcgatcacgctgttcttcggcgcgctcatcatgatgttctacaacaacgtgaccatgacgctgtgcgccatcggctccgcgctgctcggcctgatcatcatgggcgtgatcatgaaggtgtcgcagaagtacttcacccgccagcaggtggcgctcggcgacgtcaacggccacgtcgaggaaatgtacaccggccacaccgtggtcaaggcgttctgcggcgaggaacgctccatcgagcagttcgagaagtacaacaacgacctgtacgtgtccggctggaaaagccagttcctgtccggcctgatgatgccgattatgaacttcgtcggcaacttcggctacgtggtggtgtgcgtggtcggcgcggcgctcgccatggacggcaatatcgaattcggcgtgatcgtggcgttcatgatgtatatccgcctgttcacgcagccgctgtcccagttcgcgcaggcgttccagaacctgcagcgctgcgcggccgcatccgaacgcgtcttcggcttccttgaggagccggaactgtccgacgaaaccggcaagcaggcgctgctcggcgtcggtgcggacggcaagccgcagccggtgcgcggcgacgtggaattcagccacgtgcgcttcggctacgatgcggacaagaccatcatcaacgacttctccgcgtccgtgaaggccggccagaaggtggccatcgtcggcccgaccggcgccggcaagaccacgatggtgaacctgctgatgcgcttctacgagatttccggtggcacgatttcgatcgacggcatcgacaccaagtccgtgccgcgttggaacgtgcacgaccagttctccatggtgctgcaggacacgtgggtgttccgtggaacagtgcgtgaaaacatcgcgtattcgaagaaggacgtcaccgacgagcagatcgtggccgcatgcaaggccgtcggcctgcaccactacatcatgtcgttgccgaacggctacgacaccgtgctcgacgacaaggcgtcgctttcccagggccagcgccagctgctgacgatcgcccgcgcgatggtggaggacgcgccgatcctgatcctcgacgaggccacctcctcggtcgatacacgcaccgaggagctgatccagaaggcgatggacgcgctgaccgtgggccgcacgagcttcgtgatcgcgcaccgcctgtccaccatccgcgacgccgacatgatcctggtgatgaacggcggcgacatcgtggaacgcggcacgcacgaggaactgctcgccaagggcggcttctacgccgacatctacaacagccagttcacgctggccgagtgaggttggtgtgctgactcgctaaaaaatccggagggaccacccctccggatttttgcgttttggcttcggcatttttattgtgttgcgctgacgggacggcggatttaccattgaggtgactgacgtcaatcgattgacgtatttgaaaatcacaaagaaagtgggcagtcatgaaaagcatcgaaatcggcaaatcggcagtggtcgcatcgcaggcggcgctcggcgtgatgcgcatggacgcgctggatgcggatgctgcggcagaagtcgtgcgtacggccgccgagcatggagtcaacttcttcgacacggcggacatctacggattcaacgtcaaccgcgaccatgccagctcgcgtgtgctcggccgcgcgtggaaggacgccgggctcaagcgcgaggacatcttcctgcagacgaagttcggtatcaacatcgacttcagcgacccgaacaacgtgcacgccacccgctacgacttctccgcgaagcacctcatcacgcgactcgacgaggaactggaagcgctcggcactgactacgtggacttcgcgctcctgcacaggcccgacaccctgatggaggccgaagaaatcgtcgaagcgttcaccaccctgcacaaggcgggcaaagtgcgccacttcggcgtgagcaacgtgaacccgtggcaggcggaactgctgcagtcctggctcggcgacgacccggccatgaggctcgaggcgagccagctgcagttcggcctgatgcacgcgcagatggtcagcgacgagctgatgaccaactccggcgccgaaggcatggtcgtggccaaccattcggacggcctgctgtcctactcgcgactgcgccacatgaccatccaggcgtggagcccgttccagtccggcacggaatacggcccgttcgtaggcaacgagcacttcccggagttgaacaaggcgctggacgaaaaggccgccaagtacggtgtgagcgccaacgccatcgccaccgcatgggtgctcaggcatccggcgaagatccagatcgtgctcggctcgatgaaccccacccggctgggcgaaatgctcgacggcgcggacatcgacctcgacaagcaggattggtgggacctgtacgtggccgccggcaacctcattccgtgagttttgcttgcgattggccggtttgcggtctgcgattggcgggccgccaaccggccaacctggcaatcagtgaccggtcggcaatcagaagaaacggccggggaaaccggcgctgatggtggcgtgacggtcggcgtccaacgtggcgcaatcgaaaacaaaaacgctgcgcagttcattcgggtccgcaacgaacagcgccgtagccaacccgtccgccaccgcagtcggatagtcgccaaatgacgcggattgcactgcaacccaggcggcttccgtttgttgcacgggcaggccgtcgatggcgttgagcaggtggtgaatcgccagatgcgtctgttcgttcaccgccacctcccaatggcgacggctgggcgcgctcgcacagaacgcgccatcgccgatcagtgcgacgccgaccgcgcaggacggatcatccggatcctcaagcgccacacggatcggcttgttcgtgcgcgccagcagatcgccgcccgcatcaatcacaaattccggggcagcgctttcgcgtttgctgtctgagatggaagattggcatgtcgggttggtcgtttcggctgacttgacatgcgatgtgcgcgaaagttctgaatcggtgagcaatccgcccagcgaatccaccagataacccttgccgcacgcgccgaaatccacatgaaccggactgcgtgtaaccaatgtcgtaccactcgaacgaaccacatcacgaccccatacggcccgtccgtgcagcgcgcccaggcgctcgccggcgtcggcttcaacggtgaaactcagcgcgggatcgtaaccgagacggatcaggtcctcgcccacgcacgggtcgatcgcaccgcgcgtggcggcgtgcagcgcgtcgtacaaatcgaatagcgggccggcccaatcgggaaaatcgaaatgcccgccatgcttcgcattgccgatgtgcgcaaccagcgaatcagcgcgaaaccgcgaaagcgcatgctcgtattcatcgatgaaccgttccatctcgccgcgcaattccgcagtgatcgggcgaggcgtcgaaatcagcaaccccgtgccgagcgccttggggaaagcggcggtgtacggcatgcgatgcgcgagcggtgcgagggaatccatacccacgatgctagcgcgtgcccggcttggcggagttcgtgcctgggcaacctgatatgcgctatatgtggcatgaggcatcgccttattttgatacccccgtagctttgtatagttacgattatactaatcgtgattatacagaccgacgctttggcatggagttcgcttcacgttttcgggcggacgggggtgttgcggaacggcggtgagcgtcacaatgtgagacgacacgcggaaaacgggaaaaataaaaacggcggaattccaacgtttttccatgcgcgatacaacaagaccaattaaaaatcaagactgttattcaaaaaagtttcgttctatcttggcttccgatgcgcgcttcgtacgtcgggtacgtcggggaaagcgcgccgaaaagatttgcggaaggaaggttcgacccatgtcatctcgcgtcgcgcagcgccatgcagccggttcctacgattcgtgcgattcgcgcgtctcggcttccggccgtcttgccgcgctcgtcgccgcgctgatgatcgcgctcgccacgctgttcgccggcaccgcgatgccgcagcaggcgtccgccgccgacgacagccaaacgaatttcgattcctggaccgccgctgcgcagaacatcgccaagcagctcgccaccgccgaaaaagactacaacgacggcgattacggccaggccggcaccggcttccagaccgcgcattggatcggctacgacgcctccaacttctcgaaggccgtcaacgacaccatttccgccgacaagcagcaggcgttgctcacacagttcaccgacttggaaggcctcgcctaccagcagggccagggcggcgcgatcgccggcaaaatcgatgcgctgaacgcggacctcaccgccaccgcgcagacgctcgatggcaacgcgaacctcgccgaccccaaaacctacgcgaagcagcgcgccgaacagaccgcagccgaacgtaagaagctcgacgcggccaaaaagaactcctccaaaggcaaaggcgaccgcacgtggggcgaagtcgccagcgaaatgaacgtcatcctcgacaaggcatacaaggccgccatctccggcaagggcgcggaaggctccagcctcgtcaacgacgcgtactaccagtactacgaaaagctcggcttcgaaaagaacgtcatgaacgccatctccggcgaccgcgtctcgcaggtcgaataccagttcaaaatgacccgcaaaaccatgcgcgacggcagttcagacaaggaaatcaagaagctcgtcgacgacctgaaaagctggctcgtcgaagacgcggccaccctcgacggtggcgcggccggcaacgtcaacgccttcaccaaagccatcaccagctccgccggacaggcgttcctcatcctgatccgcgagggtctcgaagcgctgctggtggtggccgccgtggtggcctacctcgtcaaatccggcaaccggcgcttcaccaagtggatctacctgggcgtgctcgccggtctcgccggttccggcctgatcgccgtgctcttcacgttcctgttcggcggctccggcccgattcaggaaatctccgaaggcgtgtgcgcgctgatcgccatgctcatgctgctgtggaccagcaattggatgctcaacaaaagttccgtggaagcgtggaaccgttacatccgcaccaaaaccgagtccgccgtggccgacgcgcaaaacaaagtcgccgccggcgaaggcgtgggcctgggtatggtcgtttcgctcgccatgctgagcttcctagccgtgttccgtgaaggcgccgaaaccgtcatcttctacgaatcgatctactcgatgagtcgcgacgcgcaaggcatgtggatcggcggcatcgccgcgggtgtggtgctgctcgtcatcttcctcgtgctgcgcttcacctccgtaaagattccgattggcccgttcttcctcgttacgtcgatcctgatggccgtgctggtcgttatcttcgccggcggtggcatccacgcgctcatcgaaggtgacctgatcgacggccactacctgtccagcgtgcccacaaacgactggatcggcctgtatccgtacgtcgaatgccttgcggcacaagcgatcgcggcgattgccgtactcgcgctgttcgccgtcggcttcgcacgcaaacgcaagttgcgcacgcctgacaatcgcaagtaatacgcaaattttccgagatttaccgatattttttccacatccaacaacaaaggaaagagaaatgaagaacaagaagatcgccgctctgctcggcatcctgctggccggctccatggccttctccctgtccgcatgcggcaattccagcgattccgccgcttcggacaagtccagcgcctccgcgtcggcttcgaaggccgacgactccagcaaggacgattccagcgattccgccggtttcgaagagatccaggtcgatgagaagcactccgaccaggaatgcggcccgctgaccgtcaacgccgtctacttccagccgatcgacatggaaccgtccggcatgggcctcaaggccgccgatgcgagcttccacctcgaagccgacatccatgccaaccagaagggcaccgaactcggctacggcaagggcgatttcgtgccggacctgaccgtcaactacgacatcatcgacaagacctccaacgcgtccgtcgcctccggaaccttcatgcagatgaacgcctccgacggcccgcactacggcgccaacgtcaagctcgacaaggccggcgcgtacaagctcgtgctgaagatcgaatccccggagaagaagggctggatgctgcacgtcgatccggagacgggtgtgaagggacgcttctggacggaaccgatcgaggtcaccttcccggactggaactatacgccgcaggagtggtgatctcctagcgtagcccgttcgcggtttcggtatgcattacccgacacactcaaggccgttcggtcaagcttacggtcgggcgatgcataccgaaaccgctctctcgcgtttagggggatggattcacctctgcgattgtggggggggtccgggaaatcctcgcattttaggggagggatgagaggggtgggactctttgggatggggcggaatgggaatcgttgggctctttgagttgggtttttggatgaaaggattttgggatgctgctgcagtttgtgacggtgttgcagggggtgttggcgccggcgctgctcgtcatggcgttgagcgtcatgctcaccgtcggtgaggggcgtgacaagcctctgagcgcgtactggcggctggccggtttcgttgttggattcgccggcgcagtcgtattcgccgcgctgcgcgccaccgccgtcatcacgcaacgcacgttcgtcaactatccgaccctgtggtgctgcgtgatcctcgacgtggccgtgttcgtcatcgtcctgttcgcctgccgcatcaccgccgactggcacaaccaccgcgcgctgctcgacatcgcgaatctcgttgcggcgcttgcgatcgcggccaccacctttcgtgcgctgcccgacgtgattctgcgactgacgatcttcgtcgagccgggcgatcccatcttcacttccgacatgctgttgcgcgcgctcggcttcgctttgggcgcggccgtcgcaatcatcgccgcgcttatcttccgcacgatgcgttccaccgccgtccgctggtcgttcacgacggcggtgctgctgttggtcgcgctgttgttcgcacagcatttcaccgaccttgcgcagatcctccaatccaaacgcatcgtcagcttcccgaccgccgccttcctcgcgctcgtgtggggcatcaaccatcagcgcagcctgaccatcgcaatggcgctcgtcttcgccattccggcaatcgccagcatcgtcatgggcttcaaagtcaagccgaccggcgccaacgaggcgatcgcacgcacgcatatcgcattccgccgccgcgcgaaagcggccggcgcgttcagcctggtcgccatgatctgcgtcaccgtggccctgacgtacggcgtcgcgcaaacgcagaaagtcgtcacgctgtcgccgccggaagactactcgctcgccgacggcgtggccaccatcaaattcagccagatttccgacggccatctgcaccgcttcgaataccgcgcgaaggacggcacctccatgcgattcatcatcatcaagaagaacggcggcgcgtacggcgtcggcctcgacgcgtgcgacaactgcggcgacgccggctactacgagaaggacggcaaaatcatctgcaagaagtgcgatgtggccatcaacctcgccaccatcggcttcaaaggcggctgcaacccgataccgttcgactaccaggtcaagccaggcaaaatcgtcatccaaacgtccacgctcgacgcgctgtcgagccatttccagtgagcgccgagaaaggtaagggggtgccatgttcttcctgaaaatgatctctcgctcgttcagccggcagttcaaacgccgtctgctcatcgccgtcaccgtgtgcctgtccgccaccgtcagcgtggccatgctcggcgtggtgttcgacgtgggcgacaagctcaacgcggagctgagcacgtatggttcgaatatcgtcgtgcagccgaagtccgacgctgtggtgagcgatttgtacaataccggcgattctgctggctcggcttcgggtagttcgtccggttcggacgggggttccacttccgacggctcggctgcggcggacagtgccgacccgaccgcgtttctgaaggagtcggacgcgcagaagatcaagaccatcttctgggcgttcaacatcaccaatttcgcgccggaattgaacatccacgcggatgcggggtgtgtcggttcgggggctagttcggctggctctgctggaacggctggtgcgtcaggtgcggctgcttccgcggcgaaatgcaaggcgaccaacgtgccgatcgtgggcacgtggttcgcgaaaaccctgcacatggactccggcgagtccaccgtggccggcatgaacggcatgcgctcatggtggaaaatcaacggaacctggccgaaagacgacagcgagcaggcgatggtcggcagcgcgctcgccgcgaaactgggcgtgaacgtcggtgacagcgttacgctcgacaagacgatcgccgtcggtgcggacgacaatacgaacggaggtaccgggaaaaccggcaaatcctccaccgaacgcaatcgcgtgaaagtgaaaatcgtcggcatcttcgattcgggcgattccgacaacagcgccatttatatgccgtccatcgccacgcaaacgcttgcgaatctgccgaattccatcgacaagattgaagtcaaggcgctcaccacgcccgacaacgacctcgcgcgcaaggcgtcgaagaatccgaacgcgctcacgcaggacgagtgggagacgtggtattgcaccgcgtatccgtcgtcgatcgcgtaccagatcgaagaggtgctgccgggcgcggtggccaagcaggtgcgccaggtggccgcgctgcagggcgatgtgctgaacaagacgcaggcggtgatggtgctgatgaccgtgctgttgctggttgccgccgcgatcgccgtggcgaacctgatggccgcgtcgattggcgaacgcggttcggaattggcgctgttgaaggcgatcggtgccacggacggcgcggtttcgcgccttatgctcgccgaaacggcggtgatttcgctggttggtgcgattgccggcgcgctgcttggctcgggcgttgcacagatcgtggggcacgtggtgttcggctcgggcatcaccatgcgtccgatggtgttcgtgttggttttcgtgttgctggcggtcactgtgctcgtggcctcgctttcgtcgattcgggcgattctgggcttgcgtccggcggaggtgctgcatggtaggtgagttgtgcttggctttcgtagggggtgtgcgatgacgaatcgcaagatgttcttcactatgctgtggggcgcggtgttccgccgtcgctcccgtgcgatgatggccgtgattgcgtcgctcgtcggcgcggccacgctgttctgccttgcatccgtgtgcgtcgcggtgccgcagcagatgaacgaggaaatgcgcgcgtacggcgcgaacctgatcgtcacgcccgcgtccgcaacgggcaaatcgcaaggcatcgataccgcaaccgtacgcaacgtgacggcgctcatcggcgccggacacagcgtgaaatcagccgcataccggtatgagagcgtgcgcatcaattccgcgccgtacaccatcgccggcgtggacgtgaaagccgtccgcgcgctcaatcgccattggaacgtgacgggcgactggcccggctcgggcaacgtgatggtcggccgcgacgttgccgacgcgctcggcgtgaaggtcggcagccgcgtcaccatcggctaccgcgccgccgacgcgtctgcttcagcgtcttcttccgcgtccgcaaaatccgattcggacgaatcaactgaaacggcagaatcgtccgcgcagggcacgcagagtacgcaaactacgcaaggcgaacagaccacgcaagccacggaaaacggccgcgtctcgtccgacatcatggataacaacggcaccgaattccgtatcgctggcatcgtcgataccggcggcaacgaggattccatcatctacgccactaccgcggacgtgtccaaacttgcgggccacgagcgcggcgccgacgtggtcgaatactcggtgaacgccatgggggatgagctgaacgccatcgtcaacagaatcaacaaaaatacaaacactgccgtcaaagcgcagaccgtcaccaaaatcacctcgtccgacacccgcatcatcgccatgctgcagaccctgttctggattgtctcgctcgtcgtgctcgtgctgacgctcgtcggagtgggcaccaccatcagctccatcgtgagccagcgtcgcaacgaaatcggcctgcgcaaagccctcggcgccgattcacgcgccatcggcgtcgaattctacgtggaatccggcatctacggcttgatcggcggtctgctcggcactgctatcggctatgtgctggcgcgtgtgctgtgcgccaccgtcttcggtcgcgcgatcggcttcgactggctgctcggcgccggatcgctgctgctgagcgtggcgatcgccgtcatcgcctccattccgccggtccgccgcgccacccgtatcgaccccaccatcgttttgagggaggaataatcatggacaacgaacatatgctgctggaactcgaccacatttccaagatttacggcgatctgcacgccgtcgacgacctgagtctgaccgttccgcaagggcaatggctggcgattgtcggctcgtccggttccggcaaaaccacgctgatgaacatgatcggctgcatggatacgccgtcgaagggttccgtcatgctcgaaggccgccggctggaggatctgaacgcccgccagctcgccgatgtgcgcaagaacatgatcggactcgtgttccagaagttttacctcgtgccgcatctgacggcggtggagaacgtgatggtggcgcaatactaccattccgtggtcgacgagaagcaggcgatggaagcgctggaacgagtggggttgaaggagcgtgcgcatcacctgcccggccagctgtccggcggtgagcagcagcgcgtgtgcatcgcccgcgcgctcatcaactgcccgaagctgattctcgccgacgagccgaccggcaatctcgatgagaggaatgagaagatcgtgctcgacctgttccgtcagctgcacgagcagggcactacgatcatcgtcgtgacgcacgatgcgctcgtcgcctcctgcgcgcaacgcgaaatcatgctcaaccacggcgtgctcgtcggcgaacagtggaacgacgaggatgcgaaacgcgcgtacgaagcggccggcggcaagcctgcgcacaccggttccgccgaggaaggcgcacagaacgggggtattgcgattttgttcgccgaccctacgaaggccgcaaaaaccggagatacggacgcggccaacgttgccgttgcggctggcgttgccgacgatacggacgtagagcccgacgtcatgaaaggggagcaggcatgagcaccgcacaatcgaacgcagtcaaagtcatcgcgctatccgcggcgagcatcgcgctgttgtcggcatgcggcgaaccgaaagccacgccgatggacgacgaatacgccggcaattccggcgaaagcgtgcaatcgcaggaaaataagtcgaaaaccgacggcaaggcggctgacaatacggccggcggcgacgccaccaccaaaaaccatgccgatgacgcgaattccacgacgtccagcaagcaggacaccggcaactacgcggatggcgactactcgatcaacggccagtacgggccggtcggcgaggacaccatcgacgtgcaactgaccgtcaaagaccagaacgtgacggccgtgaacatcgtcggccatccgttcacgtccatctccaaaaagcatcagaacgacttcgccaaagccgtgccggacgcggtggtcggcaagccgttgaaggaccttaaagtcgacaagctcgccggtgccagctggacctccgaagccttcaacaaggcgttggaagtggcgcgtcaggaagcgtcaatccaatagcccattccttctgaaaccgacacggcatgcccgtcttgcgtcggtgcggacggttttcctgtggttaccgtgcggattcggcgcatacgttcggccagagcaacgtggccatgttctcggcccaggaatcagacttgcgttccttgccggattgccgttcccctccggcttcctgccccgccaacgctttgcaagccagcatggaacccagcaccgtgctgaacaggaacgtgtagtccaaacggttttgaaacactccgtcggcgatgccacgttccatgaaccccacgaaccgttcttcggccggcgctagaacttgtgctgcgatcgccttcagcgtggcgttgtcggaagacagcaccacgcccacggctttcaatccgagttcgctgtcgaagcagttctggatgcgtcgcagcatggtggccagtccgctccgcgacggcttcaaatcgttgaaattcggtagtccggcaacttccggttggatgcgttgcaataaatcgtcggcgtttcggtagcgtcggtagattgtggtctttgctacccctgaacgtcgtgcgacctcttcgatggtcaccgctccgataccatcggaaatcactatccccaatgtggctttcatgattttgcggtcggtttgctcccgtaatcgctcacgtcggccacgtactgtgccgacgtcttcctgcgtggttttttgcaccgtcttccgcgtgccctcttgcgtggttccgcccatcatgccgcgatcactttcgtgctttccagcttgcttacgtaccaatggttgaacttgaccagtggaatgcgcagtagcagacctatcagcagcagcggcggaatgaacagcagtagcgcgccaatcgcaaaccagtaatcgttactgtagattccgccgatcgccgcgcgcattgctgtgattgaatgcgtcgcaggcaggaacgggctgatgccgctgatgattttcggcagcacggccagcggatatgcgccgttcgctccggagatctgcatgacgagaaacagcacgccgatggctttgccgacgttgccgaagctggccacgagcgtgtaggtgaagaacgagaacactaggctgctcacccagccggacagcatgaacagcagcggatgcaccgcctggacatggaggaacagcagactgcctcccaaggagaacgtgctctgcaatagtccgatcacgccgaacacaccgtaatgtccgagaaacagctgatgcggtttcgggtcgccgagttccttgcgcaccttacgcgagacggtggtcttgagcgtcactgccatgagcagcgaaccgacccacagtggcaggatcgtgtagaacggtgccatctgcgaaccgaaattcttgactgggaacaccgcgttgcgtttcacttttacaggggctgcaagcgcggcggccaacgagtcggtattatcgctgagcacatctttgacggcgctcatatcgccgctgttcagcgcatcggtcaatgttcctgtgaatgcgcccagttttttgcccgcgccggccagactatcggcggtggaatccaacacgctgctgatggcggtcagattcttatccgcggtcttggtggtgccgttcagattgcccagcgcgcctttcagatcggccgctgtggcattgagcgcggtggtggtgctggtaatggacgtggcgatatcgtcaagttgcggtttcagttggctctcatagtcggttttgatgccactgacggacgttgccgcctgctgcgccagtttcttgatctccgcacgttcggccgtggtatcgcttactttggcgtcgatgttgtcggcgctgccattcagcgccgatgctaggtcgttgagctgtgtgatggtggtgccgacgttggttttgagatggtcgatggcgttcctcaccgcttccggcagcttttcgtttgcgctgagcgcgtcgagcgaatcatagatctgctggtagctttgcgcctgcttgctgatgttcgtggcctggttgcgtaatgcgttggcggtgttgccggcctgcgtgcccgcattgccgaataggctgtccacatctgcttccatggctgtgaagctgttggcggaatcagtcagagccgtgcccagcgcggtggtgccggtcttcaacgcgcccgtcagatcctccacgccgctgccggcttgcttgagtgttgttcctgcgcttttcgcattgccgctgacattggcgatcagaccgtcggaggactcaagcagatgccgtgcgctttgtgtcagcgtgctgaacgtgcggagcgttccggaagcgtcggtgagcgtttccgcgaagtcgctgatattgccgttgaactgcgtgagttgttcctgcgcggctggcttgtcgagttggttggcgagttgcgatgccacactcagcgcggtgctggtcagtgtttcggagaacgtctcgttgacctgcgcgctgaccgtatcggcgccttggcctgtgatcttcggagccaaggcgttcttcttttcattgttgtagtaggcgatttcggcgtggtcgccatcggatgcgaagaacgtcatcatacgggtgctgaagttcttcggaatcaccacagctgcgtaatattcgccggatttggtgccgttgatggcttcttttttggtggtgaaggtccagtcgagctgatcgttggaacgcagcgtgttaaccacttggtcgccgatgttgatcttcactggaatgaggtcggaccggtatccgtcgtcctcattggctacggcgaatttcagattgccggtattggcgaacgggtcccagctggcggccacgttgaaccatgtgaagatgccggggatcacaacgagtccgatgacgatgatgatggagacgacgttgctggtgattcgccggatgtcgccgacgaacagtttccagatggttttcatgcgttgctcctttcctcggtgttttcggttgtctcggttgtctcggcggtctcggtagtctcggtggtgtccgtggcggcatcgttcgcggcggcgcttggaccggtcgtctgcattttctgcaccagtatggcgattccgtcatcttcattgtggttgacgcccgtcacgttttccgtcgtttctttgatgacgctggtattgcgattatcggatgtcgtgcgtttgccgctggtgcgtctccgcgttttgcgcagcagtctgttccgccgttcctgttgcgcccgctttttgcgacggatgcgtgccgcttggcgctccaccagcatggattggatcgattcatcgctcaaatggccgagctccacttgacggttcagattatcgcgcatgtattcgatgaccatgaggaagcccatgatgagcagaatccagacgacccacgtggccagtaccaccactttctctccgttggtgaacgagaacaccgccgccagagttaccggaactacgaatccgatcaccagagctccgcgcttgagtttcgggtacagttccgcgaaccgacttgcgcgttcctcgatcacctcgcggtaaccgcctttgtcggccagcacctgaatggcttgggacatgttgtatccgcgttccggaagctccacttcctcgccgataatcatgtcgctttccttgatttcgcgggcgaagagtcggttgaggttgaccaacagaggacggaccaccagaccgatgacgaacgccatggcggcaaacagcagcagcgtgccgatcgccttgatccaatggccgtcgtagaagccggcgatggtctcgcggaatgcgtctatcgaatagctgaatggcacgaacggatagaccatgcggaagaacttcggcatcatctcgatcggatacaggccggaagcgcctggaatctgcacgatcaccaacgccacgcacaggcccttgccgatgtgcatgaacgtggtggacagcgcgtacgtgatgctcagatataccagcgatgtgatcatgccggtcagtatgaacagtggcgcgcaagccgtctgtacgccgagtatcagatcgccaacggtgcagatcgcgccttgaatgacgcccatcgtgccgagcaacaggtatcgggccagatacttttcggttgcggtcggatcgagaccctcaagcccctcgtcgtccacctccactttgtagatcaccacaaaggcgaacgcgcccacccacagtgccagattggtcatcagcggagccatgccggagccgtaggagttgacgggatacacgttcttcgtgtcgattacggtcggggactccatgaacgaggcgatcttatccgcgtcaagcgaaccgctgccggtcaacgatgcgagcagatccgtagtgcccagcgccttcaggtcggtgctgacggtggtgagcttcgtctccatcttcgccagctgctggtcggtttgctcaaggccgatgcgggcgtctgacgccacttggtcgagttggtcgagcacgatgttggtttgcctgaccacgctgtcctggctggtcacggtgccggcaagtgttccggccgtcccagccagcgagcccagcgcggaattcagtcgcggcagtgcgcctgaattgatggcgttgcgcgccgtgcctgcgcttttgagcgagttctgcgtgcctatgttgaaatcggtggacagtttggatacgctgccggctgtgtcctgtgtgttctcgctcagggttttgaggtcggcgagtgttccggctgccgtgttgttggtattctccagtttgctgatgatttgctggtattgcgcgttgtcgctggcggatttgagcttctcgagcagtttcgcattgctgtcggtgatgttttgcatgccggtcaccgcctgctgcgccgatccacttgccgcggataccgccgacgagatctggttgatgctggctgtggattgcgccgtcgcttgggaaacaagtccggatccggtttccagcgcgctgttggcgttggacgaaagcgtgttgagctgggtttgcgctgtgccgatggcggtggatgcgcctgctagtcctctgcctgcgctcgccgcggccagctgcacgtcgttcagggcattgcgtgctgcttttgtctgctgtggcacattggctaactgggtgtcgaaatccgcgattgcggagcggatcgtgcctacgttccgcttggtgttgtcgagttcgccgatggtttcgttggcgatggcgttggtgttgccgctgatggtgccgttggccgagttgacggctttgacgagcacgtcgctgacggtggagacgaaggtgttgttgacggtgcggtcgaccacggtcgcgccttggtcggtgattttcggcgaaatcggactcgccttctcgttcacgtaatattcgagcgtggggcgatgcttgctgttggtgacgacgttggccagatcttcgctgaagtcggaagggatgacgattgcggcgtagcagtcgcccgactccaccgcttccatcgcattggctttgcccatgaactcccagccgagctggtcgttgctcttcagcgtgccttcgatttgatcgccgagattgactttgccaagcagcgcgttgtctgtgccttcgtccatgttggccacggccactttgatgctgtccgtgttgccatagggattccagaacccgtagatgttgaaccatgcgtatagcggggaatgagaatcaggccgatcataatcacccacgcggcgggtacggtgaccaatcgtttgaagtcacggcgcaggatctgcagtacgttgtgcattgtctctccggtttggcgaatcaattcccttatatggcgatacgtgttccgtagcgctacgcggttcgtatcgtataccgtgctcttggacaatcgccatcgcgtttcatggatgacggaaatcgggtcgagtactgcggcaaagcctcggcaaaaccatcgccggctgacgtagccccttccgctcacgtccgtgacaaatcgccatttctgtatgtccgtgagcgaaaggtggtaataaatcgctattttccgtccgtatttatacccccattcgctcacgatgcgctatacatcgccatttcttgcggacgtgagcgaaaggtggtgtgcgaatggcgattgcagccagctgacgtccccctcttttgctcgcgtccgccaataatcgcacctgaaccgcttttcttgcggcggatattgcctacgtttggtagcgtgggctgaaggaaggagcggcatatgagcgaaaccgcacaatctgaatcacgatccgaggattccgccgcgggcaagacggatggagaaatcaaggcgattgccgccgaaaccgaaatcgcggctatcgaagaaggcggaaagcagggcactggcgaagtcggcaatcccgctgaccgtcgtctgccgttaatcgttcgcatttacggcatcgtcatgcttattgaaggcgtggtgacgctgccgttcattgtgttggcgtgcctgtactcgattcgcgcggtgttttccggcaaagtggcgttcgatgcgctcagcctcaccgcgattctgtcggtggttcacgcggccgtgctgctggtcgtcaccgcgtgtctggcggtgttcggcgtgatgcttattatgaacaagcgtcggcatatcgcgcaatggacgtatctgatgattccgctcacccttgccgaaggcttgctgtcgctggcattgcagggacttggtgtgaatttgatcggcccggctatccagcttgtcgtgctcatagccctgcatgtcactgccgatccgtcgctgcgtgaggaacgtcgtctccagttcgcgttgcgacgtatggatgcccgtagcgcatacgaagacgccgcttcccagggtatggctggccgcgatttgaccggcaagggctatatttcgctggatttcttcaatttgttctggttgttcgccatcggttgtgtgttcggtttggtgatcgagaccatctaccatttcgtgctgttcggcgaataccaggatcgcgcaggcttcctgtgggggccgttctcgccgatttacggcttcggcgtggtgatcgtcaccgtgttgctcaaccatttgtggcagtcgaattggttgctgattttctgctcaagcgcggtgatcggtggcgcgttcgaatatttcaccagctggttcatgcaggccgcgttcggtattcgcgcatgggattacacggggcaatggctttcgattgacgggcgtacgtccggcaaatacatgttcttctggggtatcctcggcttgatttgggtcaagttgattctgccgcgattgttgcgattgatccagcgtattccgtggaagattcgctattcgttgacgctggtctgtttcatactcattttcgtcgatggcgtgatgacgctgatggcgcttgacgcttggtattcccgcatggctggggttgcgcagaattcgcccgtttcgcagttcttcgccacgtatttcaatgacgatttcatggcccaccgattccagaccatgaagatcgacccgtccactgccggtcgtatgtaggctggtttttgcgttttgcgggttttgctaagcggctggtcgggcgatgttccggctggccgctttgctttgggtggctgattttgaacgatttcggacgattgcagtggggttttgttgcgggttttgccgcgggggatttgattcttccggattattgccgtttgggattcgtgccttccggctgtctggatgcttgactgctgttgccgcgcctacgccgcgatgctttgcgccagctggcggatgaggtcggggcgatgtccgctccatgaggaattcggtgagatgacgaccggaatttgcttgaagccggcgtccttgatctgttcgaatgtggacggattctgcgtcaaatcgaccgccacgtaccgcactcccagtttggaaagctcttgttcggtggcctcgcattgaggattgttcggattggtgaagacggtcacggtcattacttttcctccctatgcaatcggcttcctttggtgcggaagatcttgtcggccacgtttttcgattttgcccggctgagcaggccgttcatcagtatacactacccgtagtggcgtttcgtgcgttcgcccactgtatatagtggggaatttcccgtaataccgaatctatgcgaacaaatgttcgatatattcgagtctatcattatcctcgattgcgccacgccggttgcatgcgtatggtccgtccgcgaatcgcccgcgggctgttcgctattcatttcggaacacatattgcgatttcgctcgttttcttacgattgtgagcgaaaggtggtgccgcatagtgcggtagggggtataaatcgccttattttccatacttttcggcgcacgtcgcgaaataatcgaccgaaattgcgattcgtgagcgaaagagggtgcgcgatatggtgcgttccgtattgaagtgctgagacctcatcccgaaacaaatgaaaaagtcctgagaaccatcggcttccaagacttcgaacctgtgccccccgtgggattcgaacccacaacccacgacttaaaaggacgctgctctaaccgttgagctagaggggcaacagcaacatagtatacagcatattcggaccaatcgccaccacgggcgtcggacgggcgtcgaaatggccttcggagtgttggtgtgcctacaatcgaaaccatgtcatgtaccacaattcttgtaggcaaaaaagcaagttacgacggttcgaccatcatcgcccgagatgacgactctggttcgggacgttacgatcccaagaaattcgtagtcgtcgcaccgcaggagcagccgcggcactaccgcagtgtgctgagccacgttgaaatcgaccttcccgacaatccatgccggtacagcatcgtaccgaacgtgcttccaaatcgtggaatccttgcggaagctggcgtcaacgaacgcaacgtggccatgagcgccaccgaaaccatcgccgtcaacgagcgcgtgctcggcgccgacccgctggtcgcactgcagccggccgacgaagccaatggtaagccggaaaccccaggcggcatcggcgaagaagacatcatcaccctcgtgctgccgtacgtcaacaccgcgcgcgaaggcgtgaaacgtctggccgaactgctcgaaacgtacggaacgtacgaatcgaacggcatcatcatttccgacgtggacgaaatctggtacgtcgaaaccatcggcggccaccactggatcgcccgccgcgtgccggacgacaaatgcgcgatcatccccaaccagcttggcatcgactatttcgattttgatgacgccttcagcgacgcacgtgaattcatgtgtagcgccgatctgcaggaattcatcgaaacgcactatcttgggcgcgcggcgggtacgcagggcggcatgaacggcggccactgcaacccgcgtatcgtattcggcaccgccaccgcgaaggaccacatctacaacacgccacgcgcctggtacatgtaccgctatctcgatccggccgacgcggaaaaccttacccctgaatcggacgatattccatggtgtctcgaaccggagaatgccgtgaccgtcgaggatgtcgacttcctgctcggttcgcacttcgaaggcaccccgtatgacccgtacggcacgcagggaactgaggaaagccgccatcgctaccgtccgatcggcatcaaccgcaccggacacatggtggccatgcagattcgcccgtacgcgcccgtcgaaagccgttcgatcatgtggatttcgtacggttccggcgcgttcaccacgtccgccccgttctatgcgaacgtcgacgacacccccgcctacctgcgcgacaccacgccggaagtctccacggactgcctgtattggacgaaccgcctgattgcaacgctcgccgacgcgcacttctacgagaccagcaacgcggtcgagggcttctcggaagatgtccgttccttcggccaccgtctggtggaacgtacggatgatgcgcttgcgactgccggcgcaacggacgccccgtccgtcaccgcccgtcttgcggcggccaatgacgagatggcggactacctgcggaagcgcaatacgaagctgctcggcgacgtgctatacacgtccagcaaccttatgcacaacagtttcgccatgtccgaccgctggaactgagcgtgattccgcgcgctgaagcgttcgataagcgttcaacacgcgttcggtaaacgttgaggggctatcgactcgtgccgatggcccctcaacgttatacgggaatcaaaacctgcgagaacttcgaaactcgcgcacgaagatcagttgaacccgaccacgtgctcggccaggaaataccccttgcggatcacgaatcggccggccgaaccgcgcaggttcaacgcacgcgacatcgccttcttacgcacgtccttgtaaatcgtcggcgaatatgcctcgatatccgcccacatggccttcttcttctcgtaattctccggctcgcgcgacaggatcatgaatacgctcgccacggagctttcaatcgcaagaaaatgaatcatatagcggtacagtccgtctggcaccgtaccacgttcggggtggcgtgcaccatgcattggttgacgagccgcagctggtccacgcgtcggatcatcacgtccgtctgcacgctctgcccgtcgcggccgatgaaatagtgatagaacggcgtgtccagatactgcagcgacttgacccacgggaacggctgatacgcgtagatgaagtccacgtagaacgtgtgctccggcagctgcatcttcgattcgcgtaccacggccgtgcggtagacaagcgcgtgcatgaggatgtattcggtcagtccgaaatgccctagatcgtcccaggtgagccgtttgccgggctccatagcgtgacggaagttcaccacgtgcttgttgcgcttgcccaccttgtcgtacacgtagttggtgacgagcatgtcgagcgggtcgtccttgccgacctcgtcgcgcagcacggccagaacctgttccagcgattcgggaccgacccaatcgtccgcgtccacgaccttcacgtacatgccgctcgccgccgcaatgccggtgttgaccgcgccgccgtggcctttgttctcttgatggatcgcgcggacgatccccggattgcgcgcctcgaacgtcttcgccatctccagcgtgccgtcggacgagccgtcatccacgatcagcacttcgatgtcgtcgttgcgcttcgacgcgatcaacgattcgacgcaccgttccaggtattccgtcatgttgtacgcgggcaccacgaaggtgagcgtcttcttctcctgcatattcttcctcggatcgggctcgtgtcgggccgtgcggctggccgaccgctccggccaaaagcataacgaaactaacgtagcaccatgtgcggttccggggcacggttttgcacacaaacggcaccctgaaatacgcaatctgcacctgaaatttcccctagggtcatttcgggtgacggtatgtcagttttcgtcaattgttgattgtttttgcgattcgtgcgggctttgcgggttttgcgattcgttcgtctcgtctgattcgtttgattcgtctgccgcttgcgatttgcctactgcttgcgatccgtccgtcacggttgtcccgtccgtcgcgtcatctcccgcagcaaccgccttctcctgcgatttcgcggccttcttgccctgcttctcctgcttggcgatcgccttcgcttcccgcgcggcctgcttttccgcctcgcgggcggccttttcgctttcgtagcgcagttccggcttggcttccatgcggctcagcccataccatgccaggttcacgatatgcgcggcgagctgctccttgctgagcttgcgttggtcggcccagtattggcaggtgtacacggtcatgccgatgagcatctgcgcgtaatacggcacgcttttggccggcagatgctggcgtttgaacgcgtcggtgagaatgtcctcgacgcgtacggcaatgtctccaagcagcgaattgaacgagttggacgggtcggttttcggcgaatcgcgcgtgagcacgcggaagccttcggcgttttcctccacgtaggtgagcagcgcaagcgcggtgcgttccacgatttggcgcggatgcgcctgcgggtcggacagcgcgttgatgagaacgtcggtgagcgcgcgcatttcgcggtccaccaccacggcgtacaggccttcctttcctccgaaatgttcgtagacgatgggtttcgacacttttgcggtcgaggcgatctcttccacgctcactgcttcgaatcccttcgacgcgaacagcgaacgaccaatttcgatgagctgctcgcgccgctgatacgacgtcattctggatgtgttagccatgctgtccagtttttcacgtcccgtggatagctccttgaccgtccgacccccacgtatcgtccgattctggtgaatcggacacgtgtgtcatattgacaatgcttcattgcagctttaatatatttaataaataataaattttattaaagggggtgatgtggaccgtctaccagaatggttggccaaccttgcggaggaggatttggccttcatcaagaacttcgtgctatcgtcaggatctctgaagcaaatgtcccagctgtatcaagtctcctacccgaccatgaggctccggcttgacaggcttatcgaaaaaatacggttgaacgacaacgagacggaggatccattcatcctcttggtgaagagtctcgccatcgacgatagatacgacgtcgacacggctcgaatactcatagacgagtacagaaagagaagggatgaatcatgagctggacatggatcgcattgttgattgagatcctaggcgtaatcgccgtattcgttctggtcttcctcatcgcgaggagcctgattcgctacgcaaattccctaaagaaaggaggcagtccttcaaagcaggcagcggaagacaaaaaaatcactcttcatgatttataaaaacgttaccagatatatcgaagtcaaaaatcgcattatcgatgccctgcatggcagagcaccttattcccctggcggatcggacattcgtggtgcgtccgcagggcggagccggagtgtccgttgcgctttttaggctggagccatggatacgaatgtgattattgcgattgtcgctgttgtcgttattgcggcaattctggtgatcggcggatggtgtctcggtaagacccgcaagaacgccgtcaacaagtccactgaggatgcgaaagcggctgctgatgcccgtcttgctgcggaagcaaagtcggctgcggctgatccttccacggtgaagccgtccgtcgattccaatgttgatgcagctgaaaaagctccggctgaaagtcagcagaagtcctcagctcaagcttcctcttccgaaacggcggctcctgcaccagccaccgaagccaagcccgaaccggttcatgaaacccccgaatccgccggcacgcgcatgcagcgtcttaaggcgcgcctgtcgaaatccggcaatccgttcggcaaggccctgttcaacatcctcgccaaggatcagctctccgaagctgactgggaggacgtcgaagacacccttctgcttgccgacgtgggcgcggaagccagcgaacagctcgtcgaggaactacgcaacgacgcccgaatcgcaggccagtccgacccggccgaagtgcgtgccgcgctgaaagacaagctgctgaagctcgtaggcactgacacggatcgccgcctcaatgccaataaggaaggcgcgaacaaaccgagcgtcatcatcatggtcggcgtgaacggcacgggcaagaccaccactgcgggcaagctttcccgcctgcttgtttccgaaggcaagcaggtcatgttgggagctgccgataccttccgcgctgcggccgccgaccagttggagacttggggtgcgaaggtgggcgttccggtcgtgcgttccgacaaggacggcgccgatcctgcgtccgtcgcattcgaggccagtgccaaggccaaggaagagaacgccgacgtgctcatcatcgacaccgccggccgcctgcagaacaaggcgaacctcatggacgagctcggcaagatccgccgcgttaccgaaaagaatcttccggtcgacgaggtgctgctcgtgctcgacgccaccaccggccagaatggcatgacgcaggccaaggtgttcgccgaagccatcggcattaccggtgtggtgctctccaagcttgacggttccgcaaagggcggcatcgtgatttccgtgcagaaggagcttggcgtgcccgtcaagctcgtcggcctcggcgaaggcccggacgatcttgccccgttcgatccggaaggcttcgtcgacggcatcctcgcctgacgttcccatattttccggatttgcgatttccgtagcgaaaacctcccgtcacgttccgtacgtggcgggaggttttcgtattgcgattactgctcagcgccagccgtaccggcagccgcagcccccactcccggcaccttccggatcgtcagcttcagcagcagcggcgcgaccagcgtcaccagcgaaatgatgaagatgatcgtcgaatagtattcgctgccgagcacatgctcgttgaagccgatttgcgcggtaatcaacgccatctcgccacgcggtaccatgcccgcgccgatcatcagcgccgaagcgccgccaaaaccggccatgcggccacccaaaccgcagccgacgaccttcgtgatcacgccgagaaccgtcatgatcgcaatgaacacaatcatcttcgtatcatccacgcctgtggtctgcaggccgatgcccacgaagaacaccggcacgaacaacgtgtctccaaccggctcgatataccggtccgcgtcctccgcgtaatcgctgttgcttaccgcgatgccggcgaaaaacgcgcccaccgcgtagctcaacccggccagattcgacgcccacgccatcgccaggcagatgatcacggccatcaccgcgatgccggacggcgccttcagcacgccagccagcgtcatcagcgccggcgccacccaaaccaccaccacggcggccgccacaaagaacagcacctgcttgagcagaatcaaacccagccctgccacgtccacgctgccggtgttgacgagcgtgcacatcacggacagcaggatcacgccgatcacatcgtcagccacggccgcgccgagaatcgacacgccttccttcgaatcaagcagtccggcttccttcagcaccgccacggaaatcgacacggacgtggcggagaacaccacgccgatgaacgcagccggaatcggcttgaagccaaacagcaggctcactccacccatcaccgccacggggaacaccacgcccatgcacgcgatgatgaccgccgccttcgaatatttcttcagcaactgcaggtcgcagccgacaccgcccaaaaacatgaggatgatgatgccgaggtcgctgaacaatgacagcgaatcgctcatgtgcatcacgcccagcagcgaagggcccacgagaatgccgacgaggatctgcccgatcacttccggcagctgcgctttgcggcagatcagcccggaaaccgtggtcagcatcaaaatggcgcacagtgaaatgatgaacgttgccatggtcctcgccgctctctcgttacgcgcgccatacgttcgccgcaccgcgcgttcggtgtacatgccacgcgctcgccgtacgcggcgttctcccgtcgcgtgccacgcgtgttccgtaagtttcagctacctaacttactccgtccgcagcgttgcccgccgcttccgtccaccgtcgcaatttcatattgcgattgccgggcgattatgccttccgtatttccgtaccgccagtttcgttggaattccgccatttttcggcgtaggttgacgttccgtgcggatggcgttacgttggcgtaacacgtcgtaacgttttcaaaacgcggccggcgttccatatcgttctgtcagccccacacgatggggacggaaatgttgaaccaaatatagagaaagaaagaggagggtgacatgggccagcttgattctggaaatgccgcgtggatattgacttccgcgtcccttgtgttcctcatgacgcctggtgtggcgttcttctatggtggcatggtccgcgccaaggccgtgctgaatatgatgatcatggaggcggccgcactgtccgtcacgatgatcatgtgggtgctgtggggttggtcgatcgcctacgccggcacctcggtcggcggcatcttcggcgacccggcaaccggcttcctgctgaaggacaccatggtttccgataagggcgtcttcacatcggccgcactgaacggcaacaactacccggtcagcgtcgacgtggccttccagtccgcgttcgccatgatcaccgtcgcgttgatctgcggcgccatcgccgaacgtgtgaagtactccacgtggatgattttcgtggcgctgtggatcacgttcgattacgctccgctcgctcacatggtgtggaacggcggcctgctgtccgctgacggcgccatttcccaggcgatcggcgcagccgcccacgatttcgcaggtggtacggtcgtccacatcaatgccgcagtcgccgctctggtcatcgtgctgatcatcggcaagcgtaagggcttcggcacgcagccgttccgcccgcacaatgttccgttcgtcatgctcggcgccttcctgctgtggttcggctggtttggcttcaacgccggttccgccttcgcagccaacggcaccgccggctacgcgtgggtttccacgtccgctgcaaccgctgcggcaatgctctcctggggcttcactgagaagatccgcaccggccactacaccgcaatgggtgccgcttccggcatcgtcgcgggcctcgtcgccatcaccccggccgccgatgtggtctccccgctgtgggccatcgtcctcggcgccatcgccggtgtgctcacctgcctggcctgcggtctgaagttcaagctcggctatgacgattccctcgacgtcgtcggcgtccacggcgttggcggcttcaccggcaccgtgctcatcggcttcttcggcgaaggcaccggcctgttcgcaggcggcgactggaggcagctggtcgtccagatcatcgtcgctctcgtggccatcgtctggtccgccgtcatcaccggcatcatcgccttcgctctggagaagacgatcggctggcgcgtcaccgaagcccaggaagtcggcggcatcgatcttgccgaccagggcgaacgtgcttacgattttgctggtaccgccagctccgtcctcaaggaggtgaagtgagatgaagctcattaccgctatcatccagccccataaactcgacgatgtcaaggaagccctcgcagccgcgggcgtgcacggcctgaccgtgtccgaggcaaacggttatggccgtcagcgcggccacaccgaggtctaccgtggcgctgaatacaccgtggatctcattccgaagatccgcatcgaggtgctgtccgacgacgccgatgccgaaaccctggttggcgtgatcgtcaagtccgccggctccggcaccatcggcgacggtaaggtctgggtggctccgcttgactcggtgacccgcgtgcgcaccggcgaaaccggttccgccgccatctgatccgtccggccttgtgatcgggccgattcggacaagatgaaataaagacccccgggcttgaagttcgggttatcaattacgacacatccccgtacgtgcctcgcgccgtgcggggattgtcataagtcgtcataggtttcataaggaacgtgcgttatgacttcagcagtcgatggtttcaaacaacggttcatggccatgagccagcccgacgccgacggcgtctaccgcaatggcgcggcgaaacgcaaagcccgcacggaattggccatgggcaatctcacacagttgtggaacgaagcctgcgaggcggtttccttcgatgttccggcaaccggcatcggtctcggcgcggtcggttcgctggcacgtggacaggtgggccccagctccgaccttgatctggcggtcatctacgagccgcacgcgctgaccgaccagcagctcaacgagctcgccaacaaactgtggtatccgatttgggattccggcctcgacctcgaccagtcggtacgtaccgtcgcgcaatgcgaggccgtcaccgaccgcgacctgcccgcagctatgggatggttggacgtggtgccgatcgcgggggacactggacttatcgaaagcacagccgtatccatattggaacgatggcgcaaggccgcgcgcaaacgtctgccggaactgctcggctccgccaaatcgcgcctcgacgaattcggccgcatggcctacatcaaccagccggacatcaaggaggcacgtggtggcctgcgcgactccgtattggtgtccgcgctcgccgcatcctggcttgccgaccgtccgcacggcacgtatgacgacgccgtcgaacggttgctggacgtgcgcgactgcatccatctggtcgccggcaaagatacgaacatgctgctatcgccctaccaagccaaagtcgcggcgatgctcggtctggccgatccgacgctgcccgatggcgaacgtgaggcgaagtcgatcgacgatctgcaaacgttgctggcacgcgtcggccggcagatcgcgttctcccttgattccaccgcgtcgcgcgccgagcattcgctgacgcacgacaagccgcgattcgccttcttccaagtgttccagccgcgcggtggcggcaaacgtcaggcaccgaccttcgatgtgattgcccccggcgtggccaagcatgaagaggaaatagtgctcgctccgggcgcggaaccggccgccgacccgaacctcgtgctgcgcgtggccgtcgcggccgcggaattcggcctgccgatcgccccgggaacgttgcggaatctcaaaaagtgccctatcggcgaccggaactggacggacgaatcgcgtgaactgttcatacgattgctggcttccggccccgcgctgctcaacgtgtgggaagacatcgatttcatcgacgtgcccggcaagctcatccccgaatggttgggcgtgcgcaaccggccaagcgcgtccgccgcgcaccgctatacgatcgaccggcacatggtggaggtcgtcacgcggctcggccgtgaaacacccagcggtgggcggtacgacgaccggcattacgaggcgctgctgctcgccggcatcctgcatgacatcggcaaacgaccgggggtggccaaccatgcggcggaaggcgctcggcatgcgaccgtggtcgtggaacgcatgggattcgaccgcgacatcgtccgctgggtcacgctgctggtacgcgagcatctgacattgtcggagttcgccacaggccgcaatcccaatgatcccaacgtcggcgatgatctggccggccggctcgaccataatcccgtgctgctcgacatgctgttcgacctgacccgcgccgacggctcctcgttgggggccacgtccggcgagaccatctccaaacagtacgggtggagcaaatggcgtgaaacgttggtgcgcaccatgtacaacgccacccgataccacatgtgagcgggtttctcgcatgcgccaagccgatatgcccccgtatttctcgtcgtttacggaaaagcggggtgcatatcaccttccgttcacttcggcaaatcgaaataagggaatcggggtacatgctttaggatgtccccaagttgtccactcagttatccccactctgtggataagtcgaaacgttttccacatggttatccccaatatgtggataactcggcttttttcgactttcttatccacaccaaagccattcgcgcgtgtcgttcggtggatgcggagattcatccataatctcaatgcaacaccggtcgtgacggcacgcacgtattatggttttcctcggtattgaacacattcgattgactgctgcggttggagggacatggcggagaacgactcttggaacaacggttcggcgcagaaccgcggattttcgaacgctggaaacggtgcgaacggcatgaacggccgatccggccaagccgtgcgcgacgccctgttcgaccgcgtgccgccgcatgacgacgccgccgaaatggcggtgttgggcggcatgctgatgagcaaggacgccatcggcgaagtatcgcagatgattgacgtgtccgacttctaccagccacgcaaccaaaccgtgtacgaagcggtcatcaaactgttctcggcctcccagccggtcgacgccgtgctggtggccaacgagctgctcgccgaaggcaatctggaaaaagtgggtggctccgactatctgcacagcctggtcgcatcggttccgaccgccgcaaacgccacgtattacgccgacatcgtgcatcagcgcgccatcctgcgtaatgtgatcgcggccggcaccaaaatcgcacagctcggctacaccgcagaaggctcgcaggccgaagacgtcgtcaacctggcgcaggccgaagtatatgagatgtccaccggcaaagtgcggcaggactacgcgccgatcggtaccgtcatcgccgatacgcttgaccagctcgaccgtctgcaaagcggcgaagtgtcccgaggcgtgccgacgggcttccgcgacatcgacgacgtgacgcagggcctgcagcccggccagatgatcgtcgtggcaggccgaccggccatgggcaagtccacactcggtgtggacttcgcccgttccgcggcactgcatcacggattgacgaccatcatcttcagcttggaaatgagcaaaaacgagttggcgcaacgtatcatctccgctgaatccaacattccgctcgccgccatgcgccgcgcggacgacatcacgccggaacgttgggccatcctgaacgagttgcagggcaagctgcagaacgcgcccctgttcatcgacgacagcccgaacatgagcctgatggaaatccgcgcgaaatgccgccgactgaagcagacgaacgatttgaaactcgtcgtcatcgactacctgcagctcatgacctccggcaaggccgtggaaagccgccagcaggaagtgtccgacttctcccgtgcgctgaagctgctcgccaaggagctggaagtgccggtggtggcactgagccagctgaaccgtggccccgaaatgcgtcaggacaagaagccgcagctgtccgacctgcgtgaatccggctctatcgaacaggacgccgacgtggtgttcctcgtgcaccgtccggacgcctacgacaaggaggaccgcccgggcgaggccgacatcatcatggcgaagcatcgtaacggtccgaccgacacgttcaatcttgcgttccttggcgcgtattcgaagttcaaggacatgccccaggattaccagtcccagcaggaggcggtgtgatatggcttggaattccttcgcgaccccgttgatcggcaaggccgtgcgcgcggcctcccgtttggcgcacggcggtggcagcgcgttccccggcaaaatcgtggaacgcatcgacccgcaattcctgtcgcgcacattggcgcaactgccgctcggcgtggtgctcgtctccggcacgaacggcaaaaccaccaccacacgcatggtggccagcatgctgcaatcgctcggattgaaggtgttcaccaacccgaccggctcgaacttcacccgtggcgtggtttcgtcgctgcttgcggaagtctcgctttccggcaaactcgacgccgacatcgcggtgctggaactcgacgaggcgtacgccgtgcatttcgtcaagcaggtgccgcccgactactgcctgctgctcaacgtgatgcgcgaccagcttgaccgtttcggcgagatcgacaacaccgcgcgactgctgtccaaagctgcggaagccaccaccggtaccgtcgtgctcaaccgtgaggacccgcgcatcgcccgtcttgctgacgtggcgcatacggaagacggcgtggaagtacgctacttcggccttgacgaatcgttgcgcggcttcttcccgtcggatgacgacatgagcaccactgttgacgcggaagcgcacgacagtgcggaacatggcggaaatattggcgattcgggcaatgccggcgatactgccgatgccgttgcggctgccgcgccggccacatcgcaaccgcaggacggtcccgacgcgctgcccgccgacgtgacgttgcgcgccgtgggcgaccaccgcgccaccttcgcgatcgacggcgaaacgtatgagacggccgtgaaactggaaggcgtatacaacctgtacaacgcggccgccgcgctcgccgtggtgcgcgccgtcgcagcggacgcgcaggcgatgttcctgccgttcgaagacgcgctcgccgacagtgtcgacgcggacggtcccgatgccggtaccgaaacggacggcaacggctcgcatgacgccatcgaccaggccgctgcggacgagattctgcgcgcggcaggcgtctcaccccgtatgatcgccttcgcgcacgccaccacgcaggccatgatcgacaccgccggcgaggtcacaccggcattcggccgaggcgaggtcatcaccgtgaacgacacccccgtggaactgctgctcgtcaaaaaccccatgggcttccgcctgtcgctggcctcgttcaagcccgaaggctgcgacaccatgatctgcatcaacgacgaatacgccgacggccgcgacatgagctggctgtgggacgtggacttcacctcgctgcgcggcaccggcgtcaaagccgtgtccggcgtacgcgcgtgggacatggccctgcgcctcgaatacgatcaggtgccggtcgaatcggtcagcaccgacctggaggaatcggtcgtgaacttcgtgaacgcgaattctggcacccccaaacacatctactgcacgtacacggccatgctgaaaacgcgtgccgcgctcgccaaaatcgccgacgtggccgacgccggcgtgggcaagtgagcgccgcgcgaaacgaaaccgcgcaatcgcaaagcaaaacagcggaaggaagacgaggagacgatatgagccaggtcatcgacatcgtgtcgctgtatccgaaggatatgaacatctacggcgattccggcaacgtgctcaccatccagcgccggctcgcgctgtacggctacgagccgcgcgtacacgcctacaaccagggctgcgactggcccgagcacgtggacatgattctgggtggcggcggccaggacaccggccagaagaagatcatcgacgacttcttccaacgcgccgacctgctgcgttcgctcgcggcggacggcgtgccgatgctgatgatctgcggcctgtaccagctgttcggcgagtatttcgaaacggtcgacggctcccgactcgacggcatcggcgtgatcggcgcgtacacggtcggccaggaaacacgcatgatcggcaatcttacggaaacctccgccgatttcggcaagatcatcggctacgaaaaccattccggacagacgttcctgcgtgacggcgtgcagccgctcggcaccgtcgaacaggacggcaccggcaacaacggcgaggaccatacggaaggcgcgcgcgtccacaacgtgatcggcacgtacatgcacggctcgctgctgccgaagaatcccgcgatcgccgatttcctgatccgcaccgccgtcgaacgccgttacggcacgttcgatccggccgccgccggacagacggacgcgcaacgggccgccctgcatcgcatcgacgaaatcgccgaccgtgctcgtcgcgtggccatgtcccgtccgcgctgacggctgccatgccggttcgccggcaatcgcaccgcctgcgctgaacgccggatatccgccactttttatgcgattgaccggtttcgctcggcgcagatgtgaagaaaatgcgatagagtggtaccaccatcacctaaaggaggacatcatggctgattttaattttggtgacggcctgcgcaaggtctttctcgccggcgtcggtgccttggcgaccactgttgagaagagccaggaaatcgttgacgatctcgtcaagaagggcgagctgaccgtcgagcagggcaaggtcctcaacgccgaactcaagcacaaggtcgaagaggctaaggaagcccctgaggccaaggatgcagccccggccgaaaccgaagacaaggccgagtagctccagtctttcgtatcgccgtctgccgcgcatgtgagcgcccggacggcgatttgctatgcccgcgcgacgccggcgaaacgttcgtctggcatcgcgggctttccagccgatttcccaactgtttgcgagcagtgacatgtctttgaaacacccatccgacaagccggacgcggcacgccccgaaagcgtggagcccgtcacgctgtccgacagggtcaacgcggtcatcgaccccacggccgacccttcgccggacgccgcctcccaagcaaacggactgacggatgagcttgcccacgaatccgcggacgatgccggcgaaacggacgataccggcaaagcggccggtgccaacgcgcaatcgtccgaaaccatcggcatcttcggagcgcgcaaagacacgttctccgcgcgctaccatctgacccgccgcggcaaactccggcgtcttgcgcaaatcgcgcagatcgccaacaaattcgacgtggttcacggactcacgcccgtcaaaatgcgtctcatgctcgaagcgctcggccccacgttcgtcaaggtcggacagatcctgtccatgcgctccgaaatcctgccgcaatcgttctgcgacgaactgtccaaactgcgcgccggcgccgaccccatgccatacagcacggtgctgcaggtgcttgaggacgaatacggccggcccgtggacgagatcttcgaccatatcgaccccaccccgctcggctcggccagccttgcgcaggtgcatcgtgcgaaactgctcaccggcgaggacgtggccatcaaagtgcaacgtccgggcgtgcgcgaaaccatggcgcaggacgtgtccatcatgcgcaccatcgcgggaatcgccaccaaaaccatgcgcagcgcgcaggtggtggacctgtccggcgtggtcgaggaactgtgggacaccttcgaatcggaaaccgacttcctcatcgaaacgcgcaatctggcggaattcaaacgattctgcgaacgctacaaatacatggactgcccgaagccgtacccggaactatgcaccgaacacgtggtggtcatggactacgtggaaggcatctccgtctcccatccggacgagctgcttgcagccggctacgacctgaaggaaatcggcaccaaactcgtggacaactacgccacgcaggtactcgacgaaggcttcttccacgcggacccgcaccccggcaacatcatggtgcgcggtgggcagatcgtgctgctcgacctgggcatgactggccggctcaacgccaaaacccgttccgtgctgaaggacatgatcttcgccgtggccgagcaggattcccccaagcttgccgacggtctgctgcgtttcgccggagctgaggccgatccggaggattatccggcattgctggccgatctggacgtgatcgtcaaggaattcggcacagtggacctggccgaactggacatcgccgccatgctgacggccctgacgcagatggcgcaacgccacggcatcgaagtgccgagcaccgtcaccacggtcggccgcgcgctggtcacgttggagggattgcttgacgaattcattcccgacgtgaacatgatccagatcatctccgaccacatcgcgtcgagcacgtcgaagaaggatttcgccaaggacgagacgaaatcgctggctctcgaaagccatcaggcgctgcacagtctgcttgccgccgccaacgagctgaaagtggcgtcccgcatgctcacgcgcggccagctgcgcgtcaatatggagatggtcggttcgcaggagccgatccacctgctcgccaacatggtgaacaggcttacgatggcgcttatcgtggtcggcctgttcatcggctcgtcgattgtgtattacgcgggcatcaagccggtgattttcggcattccgattgtcggtttcctcggctatgtgatcgcgttcatcctgtccgtctggattgtgttcgacatctacttcaagggacgcgattcgaagaagcggtagccgggcgtcttgcgttgcgggtggcttgtgttgcggcgcgctcgcattcgtgttggtgattgcgttcatatctgcgtttgcgattgcatttgcgttcccggattattcgataggacacggctttttgctgaataatcagacaggttgtcaatgatttcactccccctaatatggacccattgacggggtactgttttggtggcataatgctcaatgtcgacgatgacatcaccacccggttcccatggaggagaggacatgcaggccgggaaatcccagcgaagcgtgctcgcgctcgtgatcacctgtgccctgattcttggatttggtatcccccttattccccttgtcggagtggattccgccgaagggacggaggtttccgccgcttccgacgttgccaccgtctccgccgaaaacagcctgcagaacggcagtttcgaacagccggacgcgtaccagtaccgtgaaaccagcgatgttccgtattggaaatccaccacgacttcaggcaacatcgaaatcggcagtgtcttcaaaaacggcaacggagacaatgactccctgcacatgcgcaccggcgagaaagtggccgcggccgaaggcagccaattcggcaagccggccacgtcgaacggcaacgaccagtacgccgaactgaactccaaccaggcgagctcgctgtaccaggtggtcaacaccgtgcctgaatcgaaatacgattggggcctgtaccaccgcggcaggcagggcaaggacgccatggcgctggtggtcggcccgaaacagaacgtggcccccatgaagacgtccgccaccagcaacgaccagctgccagtccaaaaccgtgaacgagaccaaggattggcaatacgacgtgaccatccaggacacccgcacctccgccctgccgaccaccggtagcgttggcacggtgctgttcgccgtgctcggcatcgcgctgatggccggagcggtgtggctgtacgcccgtagcaagcgccagtccgccaagtaaacggctgataacggagaatcgcaaggaagggtccacggtatgaatcgcaagacggtgcaaagcatcgccatcatcgcgatcttcataacgggggcccttctgctgttctatccgcttgtcggcaactggtggaacgaacgccgctacgacatgctcgtatccggctacacacaacgtgtgcaggtcaatccgtccggcgaggactacgcagaattcaaacggatcgacgcgtacaacgccactgtgcccggcaaaggcgttcccgacgcgttcgccgtcaccacgcccgaagaggacgccgaatacgccagcttcctcaacgaggaccccaacggcgtgatggcatacatcaacatcccccgactcaaatccaccttgccgatctgccactacaccacaccggaatcgctgcagaaaggcgtcggccatctacgtggctccgccctgcccgtcggcggcaaaaacacgcacgccgtgctctccgcacaccgcggcctgccgacctcacgcctgttcaccgaccttgacaaggtgaggaaaggcgaccacttctacatcaccgtgctcaaccgcacgctcgcctacgaggtcgatcgaatcagcgtggtcaaacccgaccaaacgaaggaactcagcgtccagcccggcaagaacctcgtcacgctcgtcacctgcacgccgtacggcgtgaacacgcaacggctgctggtgcgcggccatcgcgtgccatacaacgcggcgcaagccaaacacgaggctgcggattccgcggtctcgtcattcaccgtctacggtttcgtcgcaacctacggcacgctcgccatcgcgcttgccggcatcgccgtgctccgccgcaacgcagcggcccgcacctcgcatcacgccgccgattggccgcatagcctcaccgtctcagtccgctaataaaaggcgattagccagtcttaccggctcggtaatcgcccttccgtattttgtcccgcgaaagtccgttcctggtaacaaaatgcgaaagggaaacgatcggcgatacccccttttgctcacgacttacgattttgcgtatctttggcgggatgtgcgtcaaaaaagacggaaaaacaggcgatttataccccctaccatgctttgccgcaccctctttcgctcacgactgtgccaaaccggcctaaatcgcaagtcgtgagcaacagggcgcaacctgccaggccccaccaccgactcggcaatcgcccttccatattttgtcccgcgaaagcctttcgaggccgacgtgggtgccgttagagcgtgggaatcgccatatgcaacgacgaaactgaataatcggtgaaatcgtgagcgaaaaccggcaaactgggctacgctcgtaacaagtggctcattgcgcgcgcaaatgcggtgagcagggtcaatcgcaagggaggatgcccatgtcaaagtcgtttctcaagaaagcgctgctcggtggtgcggtggcggcgggagccgcggtgtgggcgatcgccccgcgttccttctccgacaagcggcgcaactatgtgccggccgttccggatgtgtggtacgcgcaccgcggtctgcatgacgccggttccggcctgaccgcgcaatacgccaacgaaagcggcgaatacgtggcgctcgcccgccgcatggccatgaaagccgggtacggcagccctgatacacccggcgtgattgcccctgaaaactcgcttgccgcgttcgcagccgcctgtgaagccgggtacggtatcgaactggacctgcagatgacgcgcgatggcgaggtcgtggtggtgcatgacggcgacctgatgcgtgttgccggagatccgcgccgtatcgccgatctcacgtatgacgagctgactcgtattccgctgttcccgaccgacgctccgggcgcatgcaaggccgcgccgctgccgttggcattggaggaaccgccgctggtcaccacgccggacaacgcgccggaaggctactatcagcatgtgccgctattcgccgacgtgctcaaagtggtggctggtcgtgtgccgctgattgtggaatataagttcgatgacaactccaagtgggatccgcgcgacgtggagcttatggagaagggcgacgcgttgctgcaggcatactccggcaagtacgtaatcgaatcgttcaacccggccgccgtgaactggtacaaggaaaaccgtccggaagtgtgccgcggccagctgtcttggtggccgtacggcgaggacaagcccaccgatccggtggcgctcggcaaggaatacgcggccggcgcgctgttgtccgactggatttcccgtcctgatttcgtcgcctacgattggaagggcggcaacagcccgcaggtgaagctggcccgattcatgggtgcggtgccggtgtcgtggaccgtgcgcagccgcgacgaatacgcgcagtgctgcgaccagttcgaccgccacatcttcgaagcgttcgtgcccgacgaacagtagccgactgatagttgcccggcgagcgacagcagccgggcgctagtcgacggactatgatcgacaggcgacagccggttttatatggtttcggcctgccatcgcatgattggtgcggtagcaggccgaatttttattcgattgatttattccgattggcagctcagtcgatcacgccgtacagacggtcgccggcgtcacccaagcccggcacgatgtagcacttgtcgttgagcttctcatcgacggcgcacagcaccagcttgaacttgatggacgggtcgaggttttcctcaacgaacttcagaccttccggagcgcccagaatgcacactgcggtgatgtccttcgcaccgcgctcggccagatagtgggtggccgcaacgagcgtgccgccggtggcgagcatcgggtcgatcaggaagcactgacggccggtgagatcctccggcagacggttcgcgtacgtgatctgctgggtcgggttctcctcgtcgcgcttcatgccgaggaaaccgacttcagcggacggaatcatcttggtcatgccgtcgagcatgcccagacctgcgcgcagcaccggcacgataatcggagccggggcggcgatgtgcttgccgatcatcggagccaccggggtttcgatgggcttgtccacgacttcgatgtcgcgggtggcttcgtaggcctcgagcatcacgagttcggaaacgagctcgcggaacgtggaggacggagtgttcttgtcgcgaagaacggtgagcttgtggtccaccagcgggtggttcaaaacatgaatatccatggtttctaagcgtagtccatgtatcggctgttcggcaacgcgccggtaggtcggtcaaatgaaacccagatgagcgccgatcggatggcaatcgaaaatcgcaagaaagccagagaaaaatcaggaaaacatcaaaagaggagaaaagcgccgaaccacgaaagcgcctgtcggcgcaaaggccgctcgcagcggcaaaaaatggagcccggggctatgcatggcccggcgcgaattcctattgtacagtcgcgctcgacgcttcgcagcgccgtgtcgcgtggggtatgaaacgggggaaaattacggaaagcggcggtggaaagcagtagtggaaaacgacagtggaacggcctattccaatcgtccgcgccgccacagattcgccccgtggcggaaatccttggccgtggcgaacaggttgccggctgtgtgcatcagtttcgcagccttcgcgcgcgcccgcttctcaacggccgacgggcggctgccggccgcagcagacgtagcggaaccgtcggaaacatcagatgatccagcctcgctggaaccgctcagcgaagccagtttgcgcgcttcgatacgcaatcccaacgcaaccacgtcggtgaaggcggcggcccgctcaagtgccacggcgaaatcgcctgtaaacgcgccggccaaaatcgaatcggcggtacgtgcgatgtcgttttccgtcggtgcttggtccacgccggcaatcgcggaagcggtggtggcgacgggctcgccgacgcgccacagtcgcgcgatcgattcgcggttcttccgcatccacgtacgcagcagatacagtcgccacagaatgcccggcagcgagtcggggtcggcatggctccacagttcggcgatcacgtccacgccttcgcggtccaccagcgtcagcacgcgttccaccagttcggcgtcctgcgtgtggtgcacgcggtcaagcagcgccgcggccgacgcatggcacatttcgttgatttccgccggatcggcgtcgccggcgatattgtcggccatcatctggtcgagctggccggggcgtgccggacgcggcgaaccggtgttcgtgaaaccggcggaacggctgggaacgactgaaccggaaccgtagtgcatgttagtagacaatgggggagaccttctgaatgtcgatgatgctggggccttgcggtgtgtcgatgatgaacagcgacatggcggtgccggtaggcatgtatggcgattttgcgatgagctgcttggcaagctgcttacgcgcacacaggccgcgcaaatggtcgtacatgccgccgatgaccggccggtgcatgcagatggccgtggtttcgcggctgttgagcgtctgcgtgatctgctcgcggaacgccagccatgagaccgccggatgctcggcgaacgcgtcctccgtcaacgtgttgatgtgttccatcggccgttcggtctgccagctcagcacctgcaacgtctcctggcagcgcagccacggcgaggtggccagtcgcgtcgggttgaaacaggcgagctcgcggttgagggcaaacgccatcgccgcgcctttcggcgtgattggacggttcgcgtcggtgcccttccacgacttgcgcgattcagccttcgcatggcgtacgatcagcagattctgcgcggtcgcggcaccctcctgcacgcggtccacgaacactgccaacgtgtccttatcggtcgaatgggacagtattttgcgcgcctcacgtacggaaacccagacgatatcgttgatttcgcccacgtccgcgcggtgcaccgggccgaacgcgtccagcagatgttcggcgtcgtcggcggaaatcggctgcgccatccaatacaacgtgtgcttggtgtcggccgtgcaatcgtgcgaatgccgggtcttcttgccctcttcggacaacgggtattcgacttcgcacagatacggtccgagtttgaccggcgaccccgtctcttcgccgatttcacgcaccgccgcatgccgatgcgtctcgttctgctcgagtttgcctttcggccagctccaatcgtcatacttcggacggtgcacgatacatacttcaatgctgtcgagctgttcctgcgcggatttgctactggcgatcgcaggatcgttcgcgatatcgctgcccgccttccatcgccatacgatgccgccggcggcttccacgatgcgtctcatcttttcgctcatattgtcctattctaggctgggccgggctggcggcggcgcgtgacgtccgaacatacagaaaatggccgggcccgcaaggtgcggaaccggccattcgcctcgatcgatcagtgccttaccggtcgacgcgtgtgtttcttgatgaggtattcctggctgtcgaccagcggtcgaccttcctcatccttgcaatggcgcacataggtgccatcggcctgcatatgccaagacgcggtggaatcggccatctgcagatcgacgtacttgatgagctcgtcgatctgctccggagccacgatgcggaccagcgcttcgactcgacggtcgaggttgcggtgcatcagatcggcggaaccaatccacacttccggaccggccgcagggccttcgccgatctgcgggccatcggagttggcgaacgcgtaaatacggctgtgctcaaggaaacggccgaggatcgaacgcacgcggatgttctcggaaagtcccggaacgcccggcttgagcgcgcagatgccacgttcgacgatgtcgatcttcacgccggcctggcttgcacggtacagcgcgtcgatggtcttttcgtcaacgatggagttgaccttgatcttgatccacgcttccttgccggcgcgtgcggcgtcctcctcgcggcggatgcgctgaatcaagccggaacgcacggtgcgcggcgccaccagcagacggtggaagctcgacttcggcgcgtagccggacagctggttgaacaggcgggtcatatcctggccgaccaccggatcgcaggtcagcaggcccaggtcggtgtagatacgtgcggtcttcggattgtaattaccggtgcccacgtggcagtaacgacgcaggccgtcggcttcctgacgcaccacaaggctcagcttgcagtgggtcttcaggccgacgatgccgtacaccacgtgcacgcccgcgcgttccagcttgcgggcccacgcgatgttggcgtcctcgtcgaaacgcgccttgatctcgaccagcgccagcacctgcttgccggcatgcgcggcgtcgatcagcgcgtcgatgatcggcgaattgctggacgtacggtacagcgtctgcttgatggccagcaccttcggatcggccgcggcctgcgccaggaacgcctgcacggacgtcgagaaggaatcgtacgggtggtgcagcaggatgtcgcgctcgcggatggcggcgaaaatgtcctgcgcacgggacgattcgacttcggcgatctgacgattggtggtcggaatgaacggacggtacttgagatccggacggtcgatgccgccgagctcgaacagcacggtcgcgtcaagcggcgccggcaggcggtagacctcgtcggcgctcacgcgcagctggtcggcgagcagctgggacaggaacgggctggtctcgtcggagatctccaaacggatcggcggtccgaaacgacggcgcagcagctccttctccatggcgttgagcaggttctcggcgtcatcctcttccacgtcgatgtcctcgttacgggtgacgcggaaggagcgtgcctccttgatgatcatgcccgggaacagggattccaggtgggcgatgatcaggttctccatggtgatgaagccatagcgcacgttggtgttctcgtcttcggtcaggtcgtcgaccggcacgagacggttcaggttgtcaggaaccttcacgcgggcgaagtgcgacttgccggatgccggattctccaccagcacggcgaggttgagggaaccgccggaaatgtacgggaacgggtgggccggatccacggcaagcggagtcagaaccgggaacacctgctggcggtagtagcgcgacaggcgctcctgctcggccgcggtgagcttgtcccagctcagcagcacgatctgttccttcgccaggtcggggaggatgtggtcgatgatgtagtgcgcgtgctcgtcctgcaggcggtgggcctgctcgctgatggcgcgcagctgctgcctcgggctcagtccggaagcggccgtcacggcgatgccggtgtcgatgcggcgcttcaggccggccacgcggaccatgaagaactcgtcgaggttgttcgcgaagatcgcggcgaagctcgcgcgttcgatgaccggcaggtcctcatcctgtgcaagctcgaggacgcgcttgttgaacttcaaccagctcagctcacggtcgaagaaacggtcattcggcagcggttcctcgcctgcctgaagctcgcgcttatcgttcttatcggtctcagcgatatgctcagctatctggctgcgcaggatcgcctttgagggtgcgtcaaaaatctgtgccatagttatctactttatcctcaagtgcttggaatgtcttgcaaaactcaggaaaattaagcaggagttaacattcgttcgccgagttggtgaaatatgcttccgacacgccgttttttcggggcaaatgaacgtgaatgaacaagcaagcgttgcgattcgcacagcatggagcatttttgcgattcttgcgatcggaaagcaacagttgcgataaatacggaacatcgtcccgtttcggtttgcacttgccgcaatggcgagcataattacgaagtacaagaacaactgaagagcagagccccacaaggtgtgtatgaccgagataggttgttacgttgaacgggcattggatagacttaccgttacgacgatgttgttgtgcagcgattctgctccgaagattcttgcaggaaggcccgcttcggcgggtcttccttttttgttgcgctgcgccgtgctgcgttgcgtaatgtcttgcgatgtgccgaatcgcgttgcgatgtggataagtgtggatgacacgccgagggtgtggataacccacattctccgaccacaggtgccgtttcggcttgaacccatgtgcggtttcgtttttcaatcggcggtatgagcgatgcaatttcttcattacaggtccctccggtcccattgccgtcatacggaggccgtgacgtgcgcgtgacgtgttcgccgaaaatccggtcgcagccagcggccagagtgcggcagccgactcgatcccagcaaaccgttcggcgggaaacggtctcgccgcaacggttctatacgccgcagaacgccgtggacgcgcgaacgtcggcacgatgggccgggcctgccgtggcgggcggtttcatgggttcgccgttggaatcgtcgtccacacggctgaaacccgttgaagcgcaaccggaacctgctccacgcaacgtcgtggtggtcggatccgccgtcgccggagtcggtgccagcacgttggcggcgctgctggcccgcgaactgacggaacgtggatgcaaaagcgtgctggtagacgcagatctcaacggtggcggtcttgacgtgctgctcggtgtggaagacgaagacggttcacgcttcggagacatcagcgccccgctcggcaaagtggacggcaaagcgctgctgcgagaactgcccgtgtgggatggcgtgccgctgctggcctgcaatccctggcgaagcgaaaacccgcaatcctgggagatccaggcatgcatccgcgcgctcgcgcaggtgaaggacgcggtgatcgtggacgccgggcaatggcgtggactcgatgacattccggaactggcccaggccacacacatcaccgtggtcgaaatgacggtgctcggactggcccgagccaaagtggccatgcaatcgcgtggaacggcggaacggcagaaacatggccatatcgtcggcgttgaaccgcgcggcgtggcacgtggacgtggcgtgaccacgctggaagagacggaaaactatcttggccattccctcgcggcggttgtcaaaccggacgccaagctgtgcggcgaactgctggacggcctgggcctgcgcaggccgaaccgccaaaccgtcaaagccttggccgcgctcacggatgaactgcaggaatcgttggaaggcaagcgggtgaagcatggaactcggaccccttagcgccatcgcctcgcagccgggcgtcacggacatcgcggtgacctgcgacggcacggtttgggcggattgcggccaaggcatgcaggaagtatgtctgctgcgccgatgctttccgtcagcgcagtcgattcgtgaattcgcagcgcgattatgctcgcaacttggccgacggcttgatgacgcctgcccgatcgccgacgcctccaccgtggacggtctgcgcgtgcacgccgtcatcgcaccactggtgccgcagggcgcggccatcagcatacgattgcccgatgcggtctcgcccaatctggaatcgttggcgcgcaacggcatgtttccagccgaatggctgcccctgctggccggactggtgtcccgcaaggcaagcgtgctggtgacaggcggcaccggtgccggcaaaaccacgatgctcaaagccatgctgatgcgatgcccgccgaacgagcgcatcgtcaccgtcgaggaagtgcgcgaattgggcatgatccaacatgccaaccacgtgtctctggtcacacgcgaagccaacacggaaggtgccggcggcataggcctttccgaactgatctgcgcgacgctgcgcatgagaccggaccgcgtggtggtcggcgaatgccgtggcggtgaagtcgtggatctgctcagagccttgaattccgggcatcgaggcggcatgaccacattgcacgccaatcaagtggaggcggttccggcgcgattggtctcattgggtttgctggccggattggagccacgcgccacggcggcgctcgccgaggatgcgttcgacgtggtgcttcatgtggaacgtatcgccggcagacggcgcattgcgcaggtcggcagattggaagcggtggaagggcgattgcatgggcgtctgctggccgcctgggatggccgtacggtccgtgccggccaacgttgggatggattcatgagccgatggagcgcatgatgcgtgatgcgtgtggttgggaatattgcgccgcatggctggcgtcgatggccgtctggctgtggctgaatcggaacgtggaatgggcgggattgcggcgattacagcgtgtgctggttcgcttcgggcttcgttcggctgacgatagcggcggggccgatggagatggaacttgtgatgatgaatccgacgggcatggcagaacagtccggaacgatggggaaaaccgggatgcatcgccacggatgccgaccatcggcgctgccgcatgcgtggccgcgctgcgggcgtccgtacgcagcggagccaccttggtccaagcgttcgaggaattacagggcgctcctttcgcagtgcctgaactgacccgtttccgtattgacatggccgtacgaagccgctgctcgcttcaggaacaacacaagcatgtggatcagcttggtgcggaacttcatgcggcctgcacgttgagtctgcagttgggctgcgagatgagccgatgcctggaggccgtcgcggcgtcgttgaagcggcgacggctgctcgacgacttgcgtgccaacgcttttgccatgccgcaggccacggtgaagctgctgatggcattgccgttgctgacggtgatgctaggggaatgcatgggagcccatcccttgcgattccttgtggaagacgtgaaaggatggatgtgcctcggcttcgccggctgctgttatgccgtcggctggtattggattcgcaggctgatgcggcaggagcatgtgcgatgagcttggcatggccgatgctggcagcggtgggcgccgctggcgcgacatggctgtatgaatggtcgccagccagaaatccgcccgattccgacgtgcggtcatgcaatctgccattgcccttgatattggaaatgttgagcgtggcgatacgtcaaggagcgtccattccacgcgcgctgattacggtcggaaacattgtggaaggcgagttcggcggtggattgcgctcggctggagaacggctgaatagtggcatgccatggaatgaggcatggcctgacgatgatgattgcgccgtggtccgtgacgcgttctcctcatcatggtcgagcggctcctcgccggtgaatcggttggcaaccgcaatcgagcagctggattgggatgaacggtcgcggattgaacagtcggcggcgaaactgtcgattcggttgttgctaccgaccggcctgtgcatgctgccggcctttgtcgccattggcgtgattccggcggtgatgtcgtttctgtagcggccgattcgccatggggtagtgcgggttggtgcgaattggctcaaatttgctcgaatcggaccgcggtcggaatgacggatgatgcgcggtccgttccgtcatgccctaatcgcttgtggataagtgtggatgacacgccgagggtgtggataacccacgttcttcgaccacaacccacgaaaaccatgccatcgccgatgccaatacctgacactgagcgtacccggtcaatcggccgggattagccgaatgaaaggagcgtcatgaacgacgcaatgtcaatcaatgtcgatggttcgccgggtctgatgggtcgcgtcggccagaagttatgcgcggccaaggaacgtgccaataaggcggtctgcctattggacgcgcgcatgcgcctgctgaccgccgagccggagaagggcgcggtcaccgccgaatacgcggtggtgctggtggcggccacggcattcgccgcggttctgatcgccatcgtgaaatcggatgtcgtgaaaacgctgctgaccggcctcatcaagaaagcgttgagcgtggggtaaccatgcttgcgcgatggtggagacgccatgcccgtgacgccgattgcggaaccgtcaccgccgaattcgcggtggtgcttccctgcgtggccgcggtggcgattctggtgctgtgtttggggcgtgcctccatagtgtccatgaactgtcaggacgctgcggccgccggtgcgagggccatggcgattgacgccggcggcgaagcgaaagcccgcgccgcggcgcaaaccattgccggtggcggttccacggtgtcgttcgccgccaatgcgaacagcgtcaccgttgtggtgcgttgcccggttgcggcggatccgaccggcgtgctgcccgccagcgtcgtgggcaaggcaactcggtatttctgattgcgatgttcatgacagcgtgctgtccgtaacggtttttgaaaggcttccaatgcgcggcaagaaaggaacgacttccgtgaaacatgacgtgaaacagtatgtgcgacgagtgttgcatgtgctgaaaggcgcggacgaaggttccggaaccatatcgggagtcgcgctgatcgcaatcgtcgcggccatgctcggtgcggtcgccatggcaggcaatctgctgctgtgcgtgcatcgcgcgcagaatacggccgacctggcgtcggtggccgccgcgcagtcgctgcgtgacggtgccgccgacccgtgcgcggccgcatcgcgtacaacgtcgggcaatggaacccggctcgaatcctgtgccattgaaggcgaggatgcggtggtcgccgtgcaggcggccacgcaggtaccgttcgcaccgtgggtcgtccggcagtcacgtgcggggcctattgcctgtgattaggagattgccggacagtcgttgcatgacgacacggaatgttcagctgaaggtaatgggcaatctggcgcttgacgtgaaacatggttatcgtacaagtatgagcaagacgtcacatgcgaatacgaccgttgccgtggtctgcaatccgacatcgaacaaaggcaagggcgcccaagtgggcggtcatgtcattgatctgctgcgcggagccggacgcaagcacggcttcgacgtaatcgatgtgaccggcacaagcttcgacgattccctggccaacgcccgccgccgcggcgacgaatacgattatctggtcgcggtcggaggcgacggcatggtcgcgttaggcgccaacgcagtcggctgctccggcaaaccactcggcatcgtggccatcggctccggcaatgatttcgcacgcggactggatttgccggtcaatcgcgtcgaaaccgccgttgaaggcattgtcggtgcgattgtgcgcggcacgcatatcgacgtggacatgggcttggtgacttcgttgcctgacggtcatgccatcgattcgaccgacggaaccgatgtttcacagtcgcgctcgccgatcgaccgctattatgcgggcatgctgtcgtgcggtttggacgcaagcatcaacgaccgcgccaatcattcgcatctgccgaatggctcgctgcggtatttcgccgcggtcatcgtggagctgacacacatgaaaagctacggataccacatcaaggccacgctggccgacggttcggtggaggagcgggatatcatctcgccactgctcaccgtggccaattcccgccatatcggcggcggcatcgaggtgtccccgtattcacggttcgcggacggactgcttgatctggtgtggcttgaccatgtgccgaatttccgggagtgcgtggacgcggtggcacgcgcctaccacggccgactgctgggcagccatgctttcggatggaagcgggtgcgcgacattgaaatcacccgcgccaccgaaggggatgagccttcggtgttgatggccgatggcgaatacgtgggccatttgccggtgaaggtcttagccaaggacagtgcgctgcgtgtgctggtgccgccggccgtggcggaagcgcaggcggccgacagcgaggaacgggtgttggaaaccatcaaacgtgacggtcgcgaccctcttaccggtagattcctcgcctgacgtcgttttccgtcagccagccggtgccgctcgatgcccctccggacgttgaacggccgttatatgttgcttgccggcggaaatgacgcgtgtgggagcaccgtcacagatattcgtccaaatgcagcgtctgtgccgccacctgcctgacaatgtcatcgtcaatgtcaggatgcagtctgatcagcgagatcaagccgacgatcagcgtgtagaaggtctcatgctcgttgcggatcggcatgccgtgcttttcctcgaattcacgtaccgtggaaccgcacaggtattcggaaatgcggtccgcggcccggtcgatgaacctcagatacagtgcagcgttgccatcctcgatgagacgttggctgaacgggccttcatcggcgatgagcgaacgggtcagccgcaccacatcgtcaagcgccttcgagatgttgccggcctcgcgatgctcgttccactcttccaggcgggcgatgacttcgctgatgacatcgtcgagcacggcatccgcaacctggtctttgtcttggaaatagtggtagaaaagcgatctggtcatgccgacccgttcggcgatatcgctgatcgtgatcttcgaaaaccctttttccaagcagatctcacgtgccgcctgcacgatctgcaagcgacgcgcgtctccaatggtgctggtggacgcttccggtttcccggtcatggctctctcctcccaatcgcgtggcaacgccttgtgcggcatggtggtgacgcacgggttttaggcgcgcaacagtcagcgttcgtgaccgacggtacgccgatcacacggttcatgtctgatttccagagtaccggctgcgccggttgtagatcagacagacacgcgatggacttgcggagatggtcggcctcggcgcttcccgattggcgaacgtgtcgtaattcatcgatactctagaacactacggcggaaggaatttgcgatggcactggcactgtatagaaggtatcgtcccgacacgttcgatggcgtgatcggacaggatcaggtcacggttccgctgatgcgtgcgcttgacgagaacaagctcacgcacgcctatctgttctccggaccgcgcggctgcggtaaaacgagttccgcgcgtattctggcccgttgcgtcaactgcgccaaaggtccgacctcgcatccgtgcggtgaatgcgccagctgccgtgaccttgccaccggcggccccggctccatcgacgtggtggaaatcgacgccgcctcccataacggtgtggacgatgcccgtgaactgcgtgaacgtgccggattcgccccggcccgcgatcgctataaaatcttcatcctcgacgaggcccacatggtcacgccgcagggcttcaacgcgctcctgaaaatcgtggaggagccgccggagcatgtcatgttcatcttcgccaccaccgaaccggacaaggtgatcggcaccattcgctcccgcacccaccactatccgttccgtctggtgccacaggaggtcatgggcccgtatcttgagcagatctgcgccgacgagcatatcgaggccgaagcgggtgtgctgcgcttggccatgcgtgccggcggcggatccgtacgtgacacgctgtccgtgctcgaccagctgatggtcggtgccgtcgacggcaagattccttacgattccgcggtcgcgctgcttggtttcacgccggacgcgcttatcggcgaggcaatcgacgccgtcgccgacaagaacggcgaggcgctgtatggcgtcattcaaaaggtcgtggtcggcggattcgacccccgacgtttcgttgaggacctactggcacgcgtgcgcgacctgctggtgctcaccttgggcggtgagcgtgcggaaagcgtgctgtctgacgacaccgcgaccgagaacatggacgatctgcatcgccaggcggcttcgttgggattggccgcgcttacgcagatggcggatacgatcaacgccacgctggccaacatgaccggtgcgatttcgccgcgcatgcgcctggaactgctcgccgcccgccttcttgccggtcgtgagacaggcgtggtcgcgcaagccgccgcaccatcgtccggcatgccggaagctggacatgcgggcggtgccgcagcgtctgaatcgcagcgtccgtccggttcccgtaggtacgccgcgcaatcggcacgtggaaggcatgccgtggaaccgtccgcggctcccacgaatccagccgatgccgtcgtttccggagcggcctccgtattggcggaagtccagcaggcgatgggtggacctctgtcggaaggcagcgagccggccgcttcagccgagtccaagccggttgaaacgcagtctgcgccatccaaactatccaatgccgaaccatccgctcccacccagtccgtgactcagtccgcgccccagcctgcggcaacggacgatcgcactcccgaccagaagtgggacgcgatcgttgccggcctgcctgaggatgtccgtcgctacgtggaccgcgagaaagtgccccgcgtgctgctggacggggtcaaaggccgactgtggattaaattcgacaagtcgttgagcaaatacgcgttcgccaaggccgtggccaaggaagcggtcgacggcaccaccaatgtggtgcagatcgtgcgcggcgaagtgcataaggtgttcggccctgatgtcactctcgcgccggccaagaagcttgccgacggttccaccgcggtgccgtggagcaagctcagcccggaagagcagagcaagatcaacgcgcagctggtgcaggaacagctgaaggccgccacattgctgaccgcgaacctcggcaaggaggttgccaaggagccggaagacgacgatccgtggaacaccccaattccgcagacgcccatcgccgaaggcaacgccaacgacgtacagccgccggaacaccacgtaaaacatgtggacgtgccggatgtgagcgatgacgtcgatccgtgggccacgccactgcccacgccgcagacggacgatcgggagcaaggccaaccgaatgggccggagcagccgcggcaaaaccagccggaacagcacagcgaacgacatagcgcacggcaaagcgcccgcgaaatgcaatcgcaacaggcccagcagccggcgtcatcgccggcaggattcgcggatgacccatggggagcccccatgccggtgcaggcgggaccgccggagcctgaagtcgccccggaagacgacgaatactccatgagcgacgaatcgatcggcgcatcgaacgctttggacatgaacgacctgaacagggtgttcgaagtgaagaaagtcgaggaattcagctcggacgatccgcataatccgcgcaacatgcaggtgaagaaaacacttgacgactgacaccggccaccgcacgtcgcatgtcgcttatcgtacggcgagtaccgggcgctggccatcagacgtcagttgtccggaacgtggctgcggcaaccagtcaacgaaaggtatgaaccatggctttggcctatgacggcgccatccaacgactcatcgacgcgttcgccaacctgcccggcatcgggccgaaaggcgcgcaacgcatcgccttctacctgctcaacgcgcccgatgaggaatcgcaggcactgatcgacgccatcacggaagtcaaggaaaaagtacggttctgcgatatctgcggcaacgtgtgcgaaaccagcccatgcccggtatgcgccgacccacgccgcgaccacagcgtgatctgcgtggtcgaagagccgaaggacgtgatgagcatcgaacgcacccgcgaataccgaggcatgtaccatgtgctgggcggcgtcatcaacccgatggccaacgtgcagccaagcgacctcaacatcgccaaactcatcgaacggcttaaggacagcgaagtcaaggaggtgatcctcgcgctcaacccgaacgtggaaggcgaggccaccaccagcttcctttcgcagctgctgagccagaccgacatcaaggtgacgcgccttgccagcggcctgccggtgggcggcgacctcgaatacgccgacgagatcaccctgggccgtgcgctcgccggccgtcgcgccgtctgaacgggtcccgaatgttccgtatgttgggcgcgtccggacttgacaaatcaggtttttcctataatgaacttcacttgccgaatcaggcaggtgatacgttgaagaagattggataagttgtggctctcatcgtgcagaagtttggcggctcttccgtagccgacccagaatcgattaagcgcgtggcccgacgcatcatcgaaacgaagaacgccggcaatgacgtggccgtcgtggtctccgccatgggagacaccaccgacgacctgatcgatcaggcgctcagcatcgattccaacccgccggcgcgcgagatggacatgctgatgaccgcaggcgagcgtatttcgatgagtttgctcgctatggcgattcatgcggccggttctcatgcatactcgttcaccggttcccaggctggtttcatgaccgacgcgcagttcggcaccgcgcatatcaaggccgtgaagcccgatcgcgtgcgtcgtgcattggataagggttccgtggcgatcgtggccggcttccaaggcgtgaacgaaggcggcgacgcaaccacgctcggccgtggcggttccgatacttccgcagtcgcgctcgccgtggcgctggacgccgacatctgcgaaatctacaccgacgtcgatggcgtgttcaccgccgatccgcgtatcgtgccgaccgcccgtcgcattcccgtcatcgactacgaatcgatgctggaaatgtcgtcctgcggttccaaggtgctggcattgcgttgcgtggaatacgcgcagcgattcggcatgccgttgcacgtgcgcagctccttctcccaccgtcgcggcacgctgatcgtgccggaaggcgtcgatccgcgcaccctgccgaacatctgaacggcagccgggcagcgtaatcgcaggcaatcgcaaataattgcaagacaacgcgaaaacgaaaataagactttacaaacaaaggtaagaacatgagcgaagacaacaaccagtccatgggcgacctgttccccgacctggggccggaagtgccgatcatctccggcgtcgcgcacgacagcaccgagtcgctggccaccgtgcgccgcgtgccgaacgagccgggcatggcggcgaaggtgttcaccatgctggccgaggccggcgtgaacgtggacatgatcgtgcaggcctccgcctccaccggcaccgccgacatctccttcaccgtgccgggcaccgccgcggccaaggtccaggaagtgctgcaggagaagcagggcgagctgggcttccagtccttcgacgtcgacccgaacgtcggcaaggtggccgtggtcggcgtgggcatgaagacccattccggtctggccgcgaagttcttcaacgcgctgagcgacaagggcgtgaacgtgctgatgatctccacgtccgaaatccgcatcgccgcgcttgtaccgctcgagcagctcaacgacgccgtcaaggcgctgcacaccgcctacggtctggacgccgaccaggtggaagccgtggtgtacggcggcaccggccgctgatagtgctggcttcagtttcccagtatttttaaagggcatggttttgcgaccgtgcccttttcgtttgctttttacgattcacgccgtacgttgcataccgtgccaagcagtccccaaacaagcaaaaggccggctccgaagagtcggccttttgcttggctatggctcgtttatgcggcttacggtttagctacccaagccgcataaacgtcgcatcacttcttggtgatgtaacccaacgccttaagcatttctgcgctttccagcgcgccaccggcggcgccacgcagggtattgtgcgccaatcccacgaacttccaatcgaaaatggaatcctcacgcagacggccgatggaaacacccataccaccctcgtaatccacatccttgagcacctgcggacggtcatcctcggtcaggtactggatgaaatgcttcggagcgtgcggcaggccaagctcggcggccttgctggtgtagttgaccagacggtcgatcagctcgtccttggtcgggttcttaccgaagttgatgaacacggtggcggtgtggccgttgagcacgggcacgcggatgcactgcgaggtgatgcgcagcggaccgtcgaacggcacaatctcgcccttggcctcgtccacatggccgaagaccttcagcggctccttctcggacttcgcttcctcgccggagatgaacggaatgatgttgcccaccatttccggccaatccttgaacgtcttgcccgcgccggaaatggcctggtacgtgctcacgatgacctcgtgcggctcgaattccttccacgcggccaaagccggagtataggcctggatggagcagttcggcttgacggcaatgaaaccgtgcgtggtgcccaggcgcttcttctgatgttcgatgacctcatagtgctccggattgatctccggcaccaccatcggcacgtccggagtccagcggtgggcgctgttgttggacacgaccggggtctcggtcttcgcgtattcctcttcgatggcgcggatctcgtccttcggcatgttcaccgcggagaacacgaagtcgacgtccttgaccacgtcctcgacgtcggccacgttcttgacgaccatgtgcttgacgaactccggcatcggggtttccatcttccagcggctgccgatggcctcctcgtaggtcttgccggcgctgtgcgcggacgcggcaagggtgaccagttcgaaccacggatggttttcgagcagcgtcacgaagcgctgtccgaccatgcccgtagctccgagaatgccaaccttaatcttttcggacataacaacctttcgcttatgctggaacggttttccaagttttgcaagtttgattttgcttacgcttgaggtcgaccagccggcccaaaacgacgtcgcgggcggccacacgcgttgttcaatcttacgaaaacccgccgtcatgtccgccgagctatccgtatgctggtcggtaaacgcgctcgcgtacactggtagacatgtcgaaggcatcagaagaagcgcagaagcagctggatcgtatcgtggcgttggggtatccggatgtggccgatatgtcggcagccgcgttccgctcgcttgcgcgcccgcttatccgcgcgcttgaggattgcgatggttccgccgatttgggtacgcagatcctgttggtgcccacgcgcgaactggtgacgcccgaatcgctgatcgcccgaacctccatcaaccgcatggcggggttcaccaccatgccgccgcgcgatatcgccagcttcctgccgcaggatggtttcgaaccgccggaaggcccgttctatctggtgatcgaaccgcacaccggcacctgctatatcaaccgcgagccggacgtggcacgcaagctgatcgattccgacgagcgattgccgttgactttggaagaggggcttgcgatcgccacacagcatccggaatggctgctggaaaagaacggtttcaacctgctgggctcgcgttccgctgacggccgcgtaccgagtatctggatgagccagaatgctccgcgattgggcgcggtgtggccgaattcccgtcatacgtggctgggtaacgcctactgcatggcccgtcgaggcgtgagcctgttccggtagtctttcggcttaccgcgccggctccctataatcgatttcagagaagaaactgaagcaggggagaagccatgttctgtacgcaatgcggttcgaagaacgctccggagtcgaagttctgcacgaactgcggcaatccgttggtctccgttccggtgcagcctgatgccggacaagcacggatttcggatgatttttccgtcgattccacggtggcggaaacccctgcatcgcagctcgcaccgcagtctgcggagcaacccgaggaacagtctgcggcacagcacgaggaacgccctgcagaacagctcgcttcgcagccggcagacgcgattccgccggtcccgttgccgggcggcggcacgctgcccgtagcgcagtccgcgacttcggctgcatcgcaatccgttccgtcggtgtcggaaactcctgagccaaaaagcgacggaactgtgcgtgacgcttccccgaatcgcaagctcatcatcggcattgcggtggccgcgatgctgctggtcgccgctgtggtggccggcatcgtgacatacaacatggagttgtggggtggcaagtcgttgccggacgtggcggtggcgtctcccaaggactcgtcgaagactccggatgcgaaggtcgtggtcaggcagcttgaaggcaagggtctcaaagtcaagcgcgtcaaggaattctccggcgtgaaaagcggcaagttccttggctatcagggaattcagtccggtgaccgcgtaagagcgggcagtgtggtgacagtgcgcgaatcggccggccctggcgtgccggaaggtacggtcggcaagaaagctgaaagcgtggtgacaacgttctcgcagatgggcgtgccggtgcattacaagcaggtgatcgtgtcggacaccagcaaaaccaccgagggaagcgtgatcagcacgtaccccgcgcaaggccaaggcgtgaaggatgataagaaaggcatctacatcggcgtggctacgaaaagcgacggcggcctgccgtcggacatcgtcggccaggaaatttccgacgtgaaatcaagccttgaatccaaaggctacgacgtgaaagtggagaaacgtctctcatcgaaacagtacatcggcaaggtctccggctccgaacctgggccgggcagccagctgaacgaaggccagaccatcaccctgtatcagggtgtggatgccaagggtgccaagcagacgttcattgaccacagcggaaccggtggagatgggttgctgatgggcacgagtgacgttgcttctggccagtggtgcaataaggccggcgactgcatcacgctaggacaggatgacagttattccagcggagacatcgttttcctgaaagtgaaagatggtgctgcgaacacgaagtacagcatgaccggtgagtctttgatttcctgcgatgcggtgcaacagccgtattgcagcagcaagaaagccgactatctgttgactggaaactctggagcatttgaattgttcccacacaaagcgttcgaaacgtattggtgtggcgattccgccttgggtggggaaggcgatatgcggagttgtgttgccggaaaggtccatgacattgattccgactcttcggatgcgtccgattatgagccggacggcagcggtaaattccatatgatggatttgttcgcggtgttcccagtcggctctgatgtggaatcagtagagaaaattggctattttgacgcgtctgcactcgcggctgcccaaaagcaaaaacctgtcgatacggaccgtccgttcttgatgtatcgtgacgtgaaccagtacaagaacggcgagaaggaatcaacctatacaagggactggttcgatccattcatgccttacaacggctacaacggctccaaggatgacaccgtcaaaatgaagcccgcccccagcgacgaaaccgcctactatctggtggaggacgtccagcccgactgggattccctcgaagacgccaacatcaagggcgtgtccgccaagagtcagaaatctaacggcaaaaatgcaagcaggaacgcagacaccaagaaatctgattcgcaatcggatgccgccactcggtctttgatgaagtccatcgccggaaagtacggtttcgcttccggttccggcggttggagcaccactatgacggtggcgtccgatggcacgttcagcggaacatatcatgattccgacatgggcattacgggagatgactatccgaacggatcggtcaccatttcgaatttcaaaggccgtttcaaggatgccaagaagaacgcggacggcagctatacgatgcaatgcgacaaatcggcgctgaaaatcgatggcaatataggagacacgtatatcaaaaacggtagtaaatatacggttgccgacccctacggcattgccccctgcggtgcattcacggtatatccggcgggatacgacagttcgcagctcagcgaagcgatcgtcggctggagccatgcgtggtatgacagcatgcccgccaagctggaaacgccgattatcgtgaatgccgaggacacgaatctcggtagcgaatcacagcaagacgccttcttccaatcgaaatatcttgagtgatattcgataaggtcgcgttgtcggcggtgctgccgccgagtcgctgtcgattattgcgattgccacgagcatcgcattactgcgatttgcgcaacagcccccgaaccgcgtatccgatcgcgccgcacgtcaccgcgcccgcccctagcagcgtggcgctgacctgcggcctgcgcagctcgttgcgcacgccgatcaggtccgtcacgcaatggtcctcgaagaacacgcgtaattcgttgctggaataacggccgaccagatcgccccacgtcagcatgcgcgtcacgtacgccatcggattgtcttcgcggaattcaaacagccggatgccgcggaaccgcgatttcgggccgtagcattcaaaaccacaggtcggcgcgtaccccaaatcgatgtcgtgcacatgcccgacgaacgaattcttgtggtcatgcccgcagaacagcgcgaaatagccgcccgcctcacgcagcgcgtccacttcgcccacgttcacgtcggcgcagccaatcgcctcgcccagccgcgaaccgggtcggcacacatcgcggtcgagcacatagcaatgtcctgcgaattcgcgcgcgccctccacggcgttcggcgtgtaggcgggcacttcgcgcaggcaatcgtagaattcctgcggcggaatgtgctggaaggcgatcgccggcaccgcctgcccgtcgccattgcgcctgcccaactcgcgttgcacgcgcttcagccattcgacggcttccggcgagggggtgccgtagccgtcggagtcggccaaatcccagccgcgcgaattcgccgcgtatttcgcgtattcggtgaccgactgccgtccgttgccgtcacccgcgtctgccgtgtcggcgtaatcgcccgaattgaccatcatcacgctcattgtgatgcgccccgaaccgtcggacgcttcgatcggcaacgcgaacgtgcccggttcgagcgccaacggcgacgagccggcgacgggattcatacagccggcaaactcgcggtaaagatcgtcctgttcgtcggcgaggatgccgcattggaaatcatggttgccgtacgtcgcagcgaaggggatacgcgattccaacgccggccccaaaaacgcggcgaacgtgtcgcgcactttctgccgtgtctcgtcgagcagcgacgccgcggtggcgcgattgatggcttccgcccacgattccagcttgctggcagaaccgttgcgacctgcgcttttcaccagtttcggcgaatcggtgccgatgccgtcgatcatccaccgttcgtcggagggctgcgatttggtcagtgttttggcgatcggatgacgtttgatgccgcggattttcgcttcgatttcggtgaccgcgcgcacgtgcgtaccgggctgttcgccacggcgacgtagaaacgtatcgatatatgccggatcgtagccgcggatctgatcgccggtgagcacgatgaggtcgggatgtgccttcctgatagcgccttcgatcagccgaatcgtgtcttcgcgcacgtccggaccatcctgaatatcagccatttgcagcacccggaacgtaccgtcgctgttgaatcgcaagctcatgatgcccactgtactgcggcaaatctggatatggggtgaaataagggcgcgaaaatcgcaaaccatgccgtcatatcgcggaataccggcaaaatatgggattggttgtcgctagtatgggcggcagtgcaggtaggtaacatgcacgtaacaatgtggattggcagaaggccgatccgactttacagataaggaggagtgatgggtcaggatcaatcgtcagtgtttgatctcgcggcagtcgccgcggcgtccaacggagggaacaacgacccgctgctgcctccggcgcgttacattggagctccgcaaaagcccagcaagatgccgtacaacaagtacgtcgcatacgataagcaggtgccgtttgatttcccggagcgtacgtggccgggcaagcgactgcagcgtgcaccgcgttggtgctccgtcgatcttcgcgacggcaaccaggccctcgtcaacccgatggattccgagcgcaagctgcgtttctggaatctgctcgtgtcgatgggcttcaaggagatcgaggtcggcttcccgtcggcttccgaaaccgattatgacttcatccgcatgctgatcgagcgtgagctcattcctgacgatgtcaccatcgtcgtgctcacccaggcccgcgagcatctgattcgcaagacctacgagtgcctgaagggcgccaagcgcgccatcgtgcacttctacaattccgtgtccgtgctgcagcgcgaggtcgtgttccgcaaggacaaggccggcatcaagaagcttgccaccgacgccgcggcgctgtgcaaggagcttgagggcgaggccaagggcatcgacctgtactacgagtattctccggaatccttcaccggcaccgagccggagtacgcagtcgaggtgtgcaacgcggtgatcgacgtcatcaagccgacgccggaacatccgatgatcatcaacctgccggcaaccgtggaaatgaccacgccgaacgtcttcgccgacgaggtcgagtatgtgtccaaccacctcgtaccgcgtgacgccgtggtgctctccctgcatccgcacaacgatgagggcatgggcgttgccgccaccgagctggccgtgctggccggtgccgaccgcgttgaaggctgcctgctgggcaacggcgagcgtaccggcaacgtcgatttggtcacccttggcctgaacttcctgacccagggcatcgatccgcagatcgactactccaacgttccggaaatccgcaagaccgtcgaatactgcaaccagatcaagatctccgagcgccacccgtacgccggcaacttcgtgttcaccgcgttctccggctcccatcaggacgccatcaagaagggtcttgaggcccgtcaggtggccgccgaccgtgctggcgccgatctggacagcttcgtgtggctcgtgccgtacctgccgatcgacccgaaggacatcggccgttcctacgaggccatcatccgcgtgaactcccagtctggcaagggcggcatggcctacctgctcaagaccaaccacaaccttgatctgccgaagcgtctgcaggtcgagttcgagaaggtcgtgcagaactacgccgatgagaccaagaaggaagtcaaggacgaggacatctggcgtctgttcaaggacgagtacctgccggtcgaggaatccggcgccaccgcggctggtgtcgtggtcggagacagcaaggacgagaccctcgagcagtggggccgtctgaagctgctgaaggtgtccgtctcctccggcgaggatggttccgacaccgtgctcaaggccaggattctcgaccgcggcgtgaacgttggtgtcgacgagccggtggagcgtgaggtctccggcatcggcaacggtccgatcgccgccttcctcaacgccgtgagcaacttcggcatcgaagcgtccgtcatggattacgtggagcacaccatgtccgtcggcaccgatgccatggccgcttcctatgtggaatgccagatcggcgaggaagacaacacgagcatcgtgtggggcgtcggcatcgatacctctatcgtcaccagctcgctgaaggccatcatctcggccatcaaccgttccgagcgctgattgcgctgattgcacggacgcgttgagcaaacgcgccggatatgattcgaggggcttcccagggtaaccgggaagcccctcgtcgttgtcatgtgccatgcgatgcgcccgctcacaagtgcgacaagcgcgttccatgatgcttcctctccgcggatgaagggtgtcgcaatgccgccacaccaagttgtacaacgatgtaaaacacggtatagtacatcgttgtaaaacctgtatctgcttactgaaggatcttccatgtcggccaattattccctgctgtgctatacacgcgaagccaccggacgcgaagaggcgaacaacgaggacatcgcctacagcatgcatttggcgctacgttccggcgatgacgccgagtggcagccgctgaacgaaaactatggcatcttcttcgcggccggtgtgccgatcgccgccgcgaccgcggaatcccgccacgcgtgcacggccgcggcgcacttcgccgccgaccggttcgacgcgcctcgccccgccaccgacgccgtcgcccatggcgtggtcatgcccggtatggatatcacgctgaaatcgctgaagaatccgttcctgttccgcctcgcggacggacgattcgccatcgccgcgacccgtaccgcccgcggcggtgagccggatggttccgaacggtcggcattcctgctcgccatcagcgatgatctgacggcgttcgaccagcgggggctggtgctgttgcgcaccaccggtggggtcaatcacccgtccgtctctttcgacgccgcggacgcgtgctacgtcgtctcctggaccggtgacgatggcaaggcacgcaccgcgcggacggccgatatcgtagccgccgccggttcgggcaggccgcttgatgtcgtggaatcggcgtcgtcgcagccgttgcgtcagaccggggattgcggcattccgaacgccgtcgtcggcaacagcatcgccatcagtgagccggaggccgagcgcctgatagagcgcttcggccgcatccgcaataccggaacgtccgtgcccgcccagcgaatcgatgcgggcctgcatggtgaggatgcccggaatgcggttctggccttggccgcaacccgtgcggaactgtcatacagcgacggttcgcaggccacgcgcgcagtggattggaacatggcccagcttgaggccatcgcccaggaagcctccgagggaacgctcaaggccggccagacccgtaccgtcgaaggcgtgatccgccagagcgtctatccggtgccgttcgcggtggaacgcgccgacccgtcggtgttgtctttcgtcaaataaatctgcgtgtcgtcaccagttaatctgaacaccatcggcgttcaaaatggacaccgtcaccggcggccgggttggttccgctcttttcgtttatttcatcagggagtggctgttgcggtatgactcgccacggaacctgacgatccttccgtggtgcacgatgcggtcgatgaccgcggcggccatgtcgccgtctccgaacacctcgccccaccgtccgaactccaggttcgtggtgaacaccacgctccgcttctcgtaggaatccgcgacgacctggaacaggagcctggccccgtcgatgtcgatcggcaggtagcccagctcgtcgatgaccagcagcctggcgcggcctatcgcgcgcagttccgcgtcgagccggttctcgtccctcgcccgccgcaaacgcatcaccagcgacgacgcggtgaagaacctcaccggcatgcccctctcgcacgccagcatgcccgtggcgatcgccatgtgcgtcttgccgcatcccacgtcgccgtagagcacgaggtcctcggcccggtccacgaaaccgaggtccatgagctgctcgcgcccccagtcggcggggaacgacgccatgccccagtcgtatccgtcgaagcccttgacgcacgggaatcccgcgttcctgatcagcctggcgcgcctggattccgtccggctggcgttctcggccctgaacaggtcggccagcacgccgagctggccgggcgtggcgcccgcgaccacggaacgcagcacgctcctggtcaacggcagcccgcatgcgagctccatgacctcgtccggggtggacttgctcacggtccgcccgcccctgcgtccgcccgccgcggcgtccgtcgactcactcatcgccgtcctccctcatgaacctgctgtacgtgtcgagcctggccctcgattcgggaccgtcgccctgcgcgatccgcctggccgtctggtcgatcgcggccctgtcgggccttctgcccgcggcgacgatctcgacgacggccatgacggccgcacggaagccactcaccacggccgcgtggcggatgtcgtcgaccagcaggccgcgttcgcgcggctccatccggtcgagcagcacgcgcgtctcctccgggaagtcggagcgtatgggactctcgccccacgaacgcggcttgcgtgcgatgatggcgagcagcgacagcgggtccatcgcggtgtcggggctgcgcccccacctgcgctccaacgtgacgatcggctcgccgtccatggaacgcagctcgacccgcagggcccgcacgccggccatgagacgcatggaatgccatttcgggcccgcgaggtagcggttcgagtcgatcgtgaccgttccggtcctgtcggccttcaccccgcgccagtcgcacgcgtcgaacatggacggcggcagcgggagcatgtggtcgaggtccgtctcgaacaggtcccggatcggcacgtcctcgcggtagtggacgccgcgcgcgatctcgtcgcagcgttccaaccacgcgtccgtgagccggtcccatccctccgcggacggcgtcggcaccatcaggttgcggcgcaggaaaccgaccgcgttctccgtgcttcccttctcccagccggaataggggttgcagaacctcgtctcgaagccgtagtgcgcgcagaacagcgagaacagcctcgtctgggtgacggtcccgtcggccctgcggtggccgaccccggtggcgttgtcgaacactagcacgcgggggaccatgccggcatgggagaacaccttgttcagaccatggcacacgcattccgcggtctctcccggcagcgcggccacgtatctcatgttcgagtacgggaacgagaccaccaggaaatgcacggtccgttccacgccggcgaccacggccagggcctggccgaaatcgacctgcgcgctgcccggcgcccattccagctcactgaacccctcggcctcgccgcggtggcgttggcgccagcgcttgacccatcgctgcaccgacgaataactgccctcgaagccgcattcctccacgagccgctcgtgtacgcgccgggcggtgtgccgctgtttgcgtggcatgcgccggtcggcctcgagccattcgtcggccttgcgcgcgtactcgcccgcgaccagggaacggctcgcagttcccccggtcggcggaacgggcgaataatcgcgggtcgcgtacttgaccacggtcgtccgcgaaacgcccagttccctagctatctgcgtatgcgtcaggcctttcgtctcgagctgcctgatactctgttgaatacgcaccggtgtcgtcattcctttcctcccgaggaccatgtgttggttgttagcactcgggaatctatcaggaaccgtacggcaccggcgcttttcttccgccgatgccatttccgtccgccgtccgtgtccaatatgaacgcttatgccgttcagatttggtggtgacgccgtacacgtttatttgaccataaacacggtgttcgcgtggaagttcaacggcaagccgatgttcatgttcatcgccaccgatgacaccgacggcaattgcgtggatccgaacgacggcaggacccatatgccgctgcgcatcgccgactccatcgaagcgctttccgacgccgcgggcggacaggccaaggagatcgatctgctcgcatgcggcgatctcaatagcgaagatcgtccgatgaccggctgcttctgggctccggaactgcatgtgatcggcggcaagctgtcggtcctgttcatgccctgcttcgatgggccgcgcgtcaatcccgacggcacccccaacgatcgtgccggcaaaccggacatgtggaccggcagctgccacatcatgcagctcaagcagcattccgacggcacggattttgatccgcgcgagccggagaactggacggtgcccgagcctatcctcgacccggatggcgagacgctcaatccaatccagcgcatttcgcttgacatgaccgtgctgtgcgattcgggccgctggtactacgcatggcagcaggtcggcagcatctggatcgccagctttgacccggctcgtccggcgaggctcaccagcaagccgaagcagatcgtcgtgccggaattcgcatgggacaacatgatcgccgaaggaccgaacgccatcgtgcatgacggaacgattttcctgatctactcgggctcgctggtcggcatcgactacacgaccggcctggtcaccgccccggccggacagggagccgatctgaccgacgccagcgtatggacgaagctcgattatccgctgcagaagtccggcatgtacaacgggcgttggcagctcggcaccggccacggcatgtggtcgcatgacgaggacggcaacctcatctacgtgttccacaacgccgaatacgagcacggccgctatggtggccgcgacgcccaagtgcgccgcgtgcattggtccaaggagggcatgcccattctggatatgcaaacggcggaggagcttgaccccgactatgctggtgtaacaatggaggttggtttcttcgatgccgactgagtccgctgaatgacaaaaggggtatatatgccgaagcgaacggggggaaacggcgagcatgtcgtgaccatgcgtgaggtggccaaggcggccggagtgtcgatcaaaaccgtctccaacgtggtcaacgactacgaattcgtctcgcaggccacgcgcgacaaggtcaacaaagccatcgcggaactgggatacacggtgaacgtatcggcgcgcaacctgcgccgagggcagaccggcatcatcggcttggccattcccgatctgcagatgccgtatttcgcgcagctgtcgtcgctggtcatcgaagaggcgaagaaagtcggtttgcgcgtgattgtggagccgacgcaatattcgcgcgatggcgagttggaagcgctgcacgggtcccagcagatgatgatcgacggcctgatctacagcccgttggagcttgggcaggatgacgtcgagcagctgaaggtcgattatccgctcgtgctggtcggcgaacgcatcttcaccgatcaggtggaccacatcgccaccgagaacgtcgaaggcgcgaagcgtgccacgcagtatctgctgacgaccggttgccgccgcgtggccgtggtcggcgttcatccgggggagaaagtcggttccgccgcactgcgctaccaagggtatcttgaggcgctggaggaggccggcgtcgaattcgacgatcggctggtcgtcgaatcaggcatgtggcatcgtagtgacggcgtgagggccatgaacgcgttgttggattccggcgtcgaagtcgatggcgtcgtcgcgctgaacgacatgctggcttccggcgtgatgcacgcgatccagatgcacggcttgcacattcccgacgacatctccgtggttggtttcgacaattccgacgattcacagtacctgtcgccggcgctgacgtcgatcgcgccgggacttgaagcggtcgcccgtctgtcggtgaaagtgctcaaggagcgcatcgacggccgtgacccgaatgccgacaggccgggggagaaggtcttccgcaaggtcgcatcatcgctggtcgtgcgccaatccaccaaactccccatcgattccctcgtcctctgagctttcgcttgccttccggcaagtttctcccagcgtgcgtacccattgagtcggctcttccccaaggtgccgccgccgggcatgggcgctcggccgtaagcttggccgaacggccttgagtgtgtcgagcacccatgaccgacggcggcaccgacattggcatgaatggcgcaaacgatggacgcccatgcccagcggcagcaccgcatccaagcatcttccgacaatgacgcgcccaagttgttacaacgatgtaagaatgatatattcaacgttgtaaatactggaacaacggattgagaaggactaaacatggttgtttacaacaatccgatcgtgcttcagcgcgcagacccctgggtgctcaaggttgacggcgagtattatttcaccgcctccgatccggaatacaactgcatcgccattcgtcacgcgtcgaatatcaacgatctgcagaaggctcccgagacggtggtgtggcgcaagcacgaatccggcccggcgagcatctacatctgggcccctgaactacatcgcatcaatggcgcatggtatatctatttcgcaggcgccgcaacggatttcgaagcatccggcctgccgacgcaccgcatgttcgtgctggagaacaccgacgacgatccgacttccgacaactgggtggagaggggccagatcatcaccccgatcgactccttcgcacttgacgccaccaccgaagtgattgatggcgtgcagtatttggtatgggcgcagaaggatcccgccatcgaaggcaactccaacctgtatatcgccaagatggccaatccgtggacgctgggcagtgatcccgtcatgctgaccaagccggaatacgactgggaatgcatcgacttcctggtcaacgaaggaccggccttcctgttccatgggaacaagatctacatcacgtattccgcctccggcaccggcgttccgtacgccgtgggactgttgaccgccgagtgcggcagcgatctgctggacaaggcctcctggactaagagcccggtgccggtgtttaagacctgcgccgagaacggtcagtatggtccgggccacaattcattcaccaagtccgaggacggcaccgaggacctgatgatctaccactgccgcaactacacggaaattaagggcgatccgctgttcgacccgaatcgccacgcgcgcgtcggtgtggtcaagtggaccgccgacggtccggatttcggcgtgccggaacccgacaatctgtggacccctaccaccacggacgtgctgccggccgatggcggtccgctcgcgggaactccgtgtgtgttaagtgccgcaagtacaggtttgcatggctcttctatcggtgtgtcataaagttgtacaacgatagaaaaagttgtataatcaaaattacaacgttgaaaatattgtttaatccaacgaggtgatgttgccaacaaagaagtcggttaattttattgtggcgttgagggaatctctgaatgccgaaaaaggaggagggtctataactacatgtttttgacttgattgagcattatgtacttccatcgtgccgctaatgaatgattttggcggtcgcgaaggggtgcgggctatgaaaaataagaagctgttacagaggcgtagcggcaaatcggataaaggagaaaaaatatgaataagggaatcagggcagctgcgttagttgtagctgctgcatccgtgatttctcttggagcatgtggtggcggctcaaaggccgcaggctccaatggcggagtgacagagcttagtgtatggagcggttttactgagaatgatgggaaagtagttcaatctattgctgacgatttcaataaatcgcaaagcaatgtgaaggtgacaattgaacagaatccttggaatgtaattaatgataaacttctgtcttcaatttctgctggtaatggtccggatgtggtgacttatcagccagatggtgcaaaaggcttcatcaagcagggggctattgtctctacggatgatttctattccgattcttctaatgagacaagtcattaccgtaagaatgttgtcaaagatggagaagtggacggtaaacattatggagtgccaatgggccatgctccatattccgtctatttcaacaaggctatttttgatgcggctggaatcacggaggatcaatatcctaagacgtgggatgatcttgctgctcttgcgtcaaagttgaccgttgataaggatggagatggtactcctgaccagtatgggattgctcttgctgataaggacgctggatatcttccgatatttttacagggagccggaacagatttagttgttgacgggaaggctaacctgacttctaagaaatctaaggatacacttacttggattcgtgataatttctatgcgaagaagtcctcgccgagcaatctttcgcttgtggatgctcagacgttgttctgctccggtaaggcggcgatgttctggatcgggccttggattgttaatgctgccaaagagaaaggaattgaaaccggcacatttgaaatgccgaaggggccggagaagcaggtcacagaagttgcggctaactattggtatacgacttcacaggtcgacggtaatgatgctaagaagaaggctgcttatgcttggatgaagttctttaataataaaaagaatcagattacttgggcggttaaggcaaactacccacccaatcgtacggatgttactgctgacgatatgaagagcaacaatttcgtttctcaaattagcccttatatggatcattccagtctgcttcttggaagtgttccgtctgggtttgcagatgttcagtctgaactaaatgctcttggcccaaagatttctgaatctacgggtgacttgacggatattctacaaaaatctaacgataaaattcaaggatatattgaggaatgaattaatttaagctgaagagagggtgcgagtatcaattgatttgcagctggggctcgcacccctttttgaagctgggagggaaagtagatgcgtgcatcatcaagtggatacaagccaccacgctcattggtcacaagtgattctcctgtccgtcggaatgaaatgaagcgggctcagacacgaatgggttggttattcagtgctgctgcaattgtgattatcggggcattcgttttttatcctgctttttatgcgctgtggatgagttttaccaatgcgacgggatttaataagcctcaatttattggagtgaaaaactatacggatttattctccaatcaagatgctgtacatgctcttttgaatacgctgatatatacggttatttatatgccgctactaattatcgtagctttggctgttgcgatgcttcttaaccgtgatgatttacctttgagagggtttttccggtccgccatcttcctcccgtttgttatttctatggctgttgccgcaatggcgtggcagttcattcttgacccaaatttaggcttcctgccatattggttatccaagattggcattcatatgggtgatgtactcggtagcactacatgggcccttcctacggttactgtggttggtgtatggaagaattttggttattttatggtcatctttcttgcaggattgcaaggggtttcgcatgagctatatgaagcggcggagcttgatggttgcggtgcgtggagaaagtttacttctgttacgcttccggggcttcgtagcactatgacttatgtcgtcataatggctttgatccagtctttccaggcgtttgatcagatttatgtcatgacgtctggtggtcctgatcatatgactgagacggttgtttatcgaatctatactgaaggcttccgtaatttccatcttggcgcagcttcggctcttagctatgttttgctggttttcaccttcattgtgggggttatccagcttgtccttaataaccgttatgaaaaggagtccatgtgatgaaaaaaggatcagtggtttctgcatctcacaattcatcgcggtacattactccacgagtattattgggccgcgtcggagtatatatacttctaattctaacttcattaattactgtttttccgttctttgtttgcttggttacatcatttgcgccgagcaaagaagtcaatgcctggcctccgaagctgattccgtcttctttaacgctggataattatgtacaattattcaaccgaattcctgtaggaacacagttcagaaattctgtgatttttgccggtttcgttacgctgttttctgtagcgtttgacgcattggccgcatacgcattgtccagactcgatttccgaggacggaatgtgttgttgttcgtgctaattgcgagcatgatggtaccataccaagcgctccttattccaacgtataagatgctctcttccatggggcttatcggtaattacaacatggttgccatgattttgcctcgtgccgctgatgttgcaggtatttttctactccgacaattttttatttcattgcctcgagatcttgacaatgctgctcgcattgacggggcgaatgagtttcgcgtcttttggtcgattgtgttgccgaatgcaaaacaggggctgtttacattagctttattcaattttatgaacaactggaatgatttgctttggccattaattatgacatctaagtctgatgatcgcacattgatcgcgggactttctctgcttaatggctccgttggaggagcgattccgtatggaatcatgatggctggcgcagttattgccgctattccgctggtaatcatattcgcctttgtccaaaagcaatttgtcgaaggcgttgccatgagtggtatgaaaggataatgaaatcatggttaatcaaaaagtctcgcctgtaaaaaagtggtttgagaataaagaaaaactcaatttttcattaggaattgaagatacttttattcctcagactcgtccaggtatgcgtgccttagatgaatatgagctaactaagcattatgaatgctggtacgacgatattggtcttatatcggagactggggcgaatcaaacaagatggggcataccttggtatttggtaaaccctgcgcctggcaaattccgttttgattggcttgaccgggttgtagaccgtttcgaagaaatcggtgttgatgtcatagtcgatcttatgcattatggaacaccgttatggcttgataatggttttttaaatactgattatccaaagtatgttgccgagtatgcggcaacagtggcgcagcgttatcagaaccggctcaatatttggactccgttgaatgagccattgttgaatatgatgtactgcggccaatatggctattggccaccgtatcttgttggtgatgatgggtttgttaagttgttccggcagattactaaagggatgattttaactcagcaagcgattagcgaggtgtcgccagaatctacattcgtgaatgttgaagcatcattccgattcgctggtgatgtggatgcatactctgatgaggtaggtttcctaaaacaacgcaggttccttgtggaagacacaattatgggtcggatgaattcgaatcatcctctctacggttggttatccaagcatggtattcaggatgatgacttccagtggtatctcgataattcaataaaaccggatgtaattggcgttaattactatcctcaggtgtccacagtgaagtatgtggcaggagatccgcatgatggttcgccatatgatccactgccattccaaaatgatggtgtcgaggggctcaaagatgtactgactttgttctcggaaagatacgaattgccagtatatttgactgaaacgtgttctcctggtcctgtcgaggaaagaatccgttggttgcatgaatcggtagcggctgtggatgaattgcgtgcagagggtatgaatcttattggctatacttggtggtctttgttcgatatgatgtattgggtttatcgagatgaggacaaacctgccgaacagtatcttgctcaaatgggattgtgggatctacgagcaaatgatcatctttcgtttgatcgtattcgtactgcagcagttgatgagtaccgtcgtttagtggaagcccatcgtaagtgaaaaggttgtaatttgcgtatgcacttgaagtaatatcgtgcttaaacacgatgaaaagatgccgcaggagttcttcgcagcggcatctttccatatctagtaattgagatatcagaactctgttgcaaactgttaatcgccaaccaccacaacaacggtggcgcggacgacgaatggtacttgttcgtggacgtgattccgtcgatcggataccgtccgatggtcagccgcgatctcgatcagggctgggtgccgttgcaggcggacgattacttcctcaccgcgcatacgaagcacggtggcgtcgcctcgctgacgcgcgccgaatacgaccgtcttgcccagcatgtgcatgcattctgacaaacgacgttgacgaccatgcgcccgcgtgtgcacgcggcaaaaccaagggggcttcccggaataaccgggaagcccccttgcgtatttgctgaccgcgacggcaatcgcagtcagcgactgctattgctgcgatgtatcgccattggcgccgttattaccggaattatcgtcactggttcctccgccattgccaccgttggtgtcgttaccgtcgccgttagcggggataccgccgctattaccgccgtcgccaccgccctgaccggtattctgcgtttcctcggtctgattcggcgtggtctgttgggtgttctcctcggtgcgcggagtcacggtggtctgctgctttctagtccaggtcttctgcgcgccggtgccccacgtaccgtccggtccgccgaccttgccgttatcggtggcgtcggggaacgtttcgttcggagtgtcggcaagggcctgcttcatgtattcggtgaacagatgcacggggtagtcgctgccgccggtccatcggccgaacgaagggatctgctgcggattgccgttggcgtccggataccacatcgccacagaagtcagcatggacggcgtatagccgatgaagctcgctgcgttggaatcgtttgcggtgcctgacttgccggcaatggtgtgcccagtggcacgcgcctcggtggcggtgcctcgctggaccacgccggtaagcgccttcgtcacgagattcgcgttgttcgcttcgaacgtctgctccgccgaggtcggcgcgttgtacaggtcggtgccgttcgccgtctgcacttgggcaacgatatgcagcgtcggcttgttgccttggttggccagtgtggcgtatccctgcgtcatgtccttgagggtcaggccgttgttgccgagcacggtgaacgggttggaaccatccaaagacgaatcgtcaacgccggcctgccgtgcggtttcggcgattttctgcgcgccgagcttggtttgcagatccatgtacacggtgttcgaggattgttccgtcgccgtgtacaggttcacgtatcccagattctcgccgccgtagttgctcaccgtttcggtgatgcccgggaacgtccggtacgagttgccgttgaagtacgtgttgaggctgacgccttcgttgacggcggccagcaatgcgaacggcttcatggtggagccgacttcgtacgttgcctgggtgacgttgttgagctgcttggtcaggtagtcgtctcctgcgtacagcgagatgatggaaccgtccttggggttcaccgacagcgcgccgaactgcatgccgtcgggcacgatgccttgcatgccgttttgggagggactgatggtggagaacatcaggtcctgcttcgatttgtcaatggtggtgacgattttgtagccgccggtttccaggtcctgcttgctgaacgccttggtgttgacgagttcgttctgcaccatcgtcagcaggtatccgttcggtccggacatctggttgttttgttggatttcgatggtttgcgggaatttcgcggctttcttctcgtccggcgtgatgtagccgtcttcgtccatgatgttcagcacgcgcttgtaacgtttttcagcttgcttgggattcacgtcgggggtccatacgctcggcgcgggaatgatgccggcaagcatggccgcttcggagagcgtcatatccttcgcgtccttgccgaagtacgctttggccgctgcctggatgccgtatgcgccacggccgagatagatggtgttcatgtagttgcacaacacctggctcttgtcctgtgcttgggcgattttgaccgccaggaacgcctcacgcagtttgcccacgtacgaggtggtttcgcccagataatagcgttccgcatactgctgggtgatggtggaaccgccctgcctgctaccggtggtcaggttgttgtagaacgcgcgtgcgatgccgattggatcgatgcccttattggtatagaaggagcggtcttccgatgccacgatcgcgttgccgacgtagtcgggcaggtctgcgcagctgatgatttcgcgattctgctccgcatagctgccgatcggcgtggtgccgtcgttgtagtacacggtcgtcttttcggccagcgcgaacttttccggctgtgggatttccgtggtgatgtacatgtaggcgaacaggccgatacctgccgcgatgagcgccgcgaagatgccgagcacccatttgagcacgagatgcttgtgttttctggtctttttgggtgcgcgatgcgaagtgtgcttcggcccctggggcggcttgctcagcacttctccatggaccccgtaggtggtgcccacccgtggcgtcgtggacgttgcgctgccgctgcgggcgctttttgagcgtgagctgacacttcgtgttcgtgaaaccatggtttccaccgtagccgaacgacctgaaaaacaagggtgtagatagtgctgtccgactggaaaaacatgtttttgcgcagcttttttacaaatcgacaatctgttgacgactgccgtaatatggccgtttttcagtgatttttcagtttacaatgcggtttgtgggtatgcttggggattggtatacctgcgaaacgcataacagaggagtcgttttcagatgagcattcgagtggctatcgccggcgtgggcaattgcgcctcgtcgctggtgcagggcgttgagtattacaaggacaccaaggacgaggataagattcccggcctgatgcacaacaatttcggtggctaccgcgtgcgtgacatcgaattcgtcaccgcgttcgacgtcgatgcgctgaaggtgggcaaggacctgtccgaggcgattggcgcttctcagaacaacaccatcaagttcgcggacgtgccgaatctgggcgtggaggtgctgcgtggcccgactaacgacggcttgggcgaatactaccgccagatgatcgaagagtcggacgccgaaccggtggacgtggcccaggtgctgcgtgacaagaaggtcgacgtgctggtttcctacctgccggttggttccgagaaggcggacaaggcttacgctcaggccgctatggacgctggctgcgcgttcgtgaactgcctgccggtgttcatcgcctccgatccggagtgggcgcagaagttccgtgacgctggtgtgccgattgtcggcgacgatatcaagtcgcaggtcggcgccaccatcacgcaccgcgtgctggcccgtctgttcgaggatcgcggcgtgcgtctggatcgtacgtaccagcttaacgtcggcggcaacatggacttcatgaacatgctgcagcgttcccgcctggaatccaagaagatctccaagacccgcgctgtcacttccgtggtgccgcacgagatggatccgcacaacgtgcatatcggcccgtccgattacgtggcttggcttgacgaccgcaagttcgccttcgtgcgtcttgagggcaccacgttcggcgatgtgccgctgaacctcgaatacaagctcgaggtgtgggattccccgaattccgccggtattgtgatcgacgccgtgcgtgcggcgaagatcgcgctcgatcgtcatctggccggtccggttctggctccgagctcctacttcatgaagtctccggccgtgcagcacgaggatggcgaggcccgccgcttggtggaggaattcatcaagggtgaggtcgaaggcaccgaagagcagcttgacgccgatgtggcggccgcgaaggccgccggcaaggatgtgtggcgcgcatagcgtgcgttgctgacggcagacccgcgatggcaatggcaaccatctcgtaggtctcgacccactcgcctgattcgtaggcagaatcagcatataatgaaaatccctatggcctggggtaatgccatagggatttttgttgtcccggaaacgctgcggcggtggcggccaatggtcgtgcgccgtcgcagcgtgaacgggaatcatatattgcgcaatgtatatcgcgtcactttttgaggagtggttcgacctgttcctcgtacgcggtcaacgcggtgtcgatcacgttgtgcatgtcgtaatacttgtacgtgcccaaacggccgccgaacacggtcctcggctcggccttcgcgagctcctcgtacctcgcgtacaacgccttgtcggcctccgtgttgatcggataatacggctcgtccccgcgctcggcgaaacggctgtactcctcccacaccacggtcctgtccgggttctgcgaagccctgcgctccgggttgaagttcttgaactcgatcgcgcgcgtgtacggcacgtccgggtcggagaagttcatcaccgggcatccgaaatggtcgccctcgtcgtaacgcacctccctgaagtccaccgtacgccacttcagctcgcccagcgagtagtcgaagtagcggtccaccggacccgtgtacaccaccggcacgcccgccgcggccagcgccttcctgttgtacggctgggactcgtcgaagaagtcggtcctgagggtcacgtggatgcgcggatcgtcgatcatgcgctccatccaggcggtgtagccgtccgtgggcaggccctcccacgtgtccctgaaataccggttgtcgtagttgaagcgcaccggcaggcggttgatgatgcccgcgggcaggtccttcggatcggtctgccactgcttgcccgtgtagttcttgatgaacgcctcgtacagcgggcggccgatcagcgaaatgcccttgtcgttgaggttcttcgggtccgtgcccgccaattcgccggcctgctcgtcgaccagggccttcgcctcggccggcgtgtagtgcgcgtggaagaactggttgatggtcccgaggttgatcggcaggggatacacctcgccgtcgtgcgtggcgtacacgcggtgcacgtagtccgtgaagcttgtgaaacggttcacatagtcccagaccctcttgttggacgtgtggaacaggtgcgcgccgtacttgtggatctccgcgccggtctcctcgtccatgtagctgtacgcgttgccgccgatatggtcgcgcacgtcgatgatctcgaccctcacgcccaggtgctcgacggcctgctgggccacggtcaggccgaacaggcccgcgcccacgaccaccagatcgggatactccaccgcatcagtcataacaaaacaaccttccaaacgttatcgatgcttatcgcagccacgcaaacgcacaggggcggcgtgcgattccttctcaagtgtacccgtgcgtctagtcggtgcggcgaggtccgggcatggtgtaatatggcaagagcctccgcgtggcggtatgtcacccaactcccccagggcaggaatgcagcaagggtaagtggcctcttccgggtgcgtggaggtttttctatatcttctccgattcgttccccacagtaggggcgatgccgtattctcggtgactatgaccaacgaattcaagccacttgtccgagatccacagcagcctgtgaacatgcttcagcagcccacggcagcaacgcctgcggaaccgttggaatcgttgtcgttccctgatatgcgcgaagtcgaggcggtgctttctccgcaggatgtcaacaaaggcttggctcaggtggatccgctgacccgccatccgcgcgtgtccagcatcgtgctgtgcgtggtgttcggtctgctgatgcttgccgcttccgccggcgtctggtggcttggcgtgcgtaccatggacggccaaagctatgaggatatcgtctggtcgaaattcgatgccgcgttgccgggttggctggcgccggtcgtgcacgtcttcgccatttccgcagtggtcatcaccgtcagcgtcatcatgggggcaatcgcgtttgccgtgctgatcgtgcgcaaacggtggctgtcgatcgcgcagctcgctgtattcggaggcctgtgtttcgccgcggccgaactgttgaagccgctgctgccacgcccgtatcttattaatttggaatcgaatcctaataattccgcgtcttccgggcatgtcatccttgccgctgcggcaagcgtgatgctgctgtgcgccgtgccgcgcgtgctgcgtgcgctggtggcggtgattggttgggcgtatacggtgctggtcggattgtcggtgatcgcggcgcaatggcatcgtccgaccgacgtgattatggcgctgctgatcgtcggcggactggcgttgctggcgcttgccaccacgttcgccagcggcatggatgagccgggcacgcgcgtctcgtcggcaagcgtgcagatcgtcggcagtgtgatgctgacgattggcgtattgggcatcctgtacggcgcgtatatcatctggcagattcagccgggactcgccatgagcgccgaatggacgaatgccggcgcgtacgtttccacggcgctgctgacggccgccgtttccgcgctggtgcttggcataacgctcgccatgcgtcagctgaccgcctcgccgttgacgaaactgggtttggtgggagcgccgcccgcaccgccgaagcgctgaaaacagccggttccgggcatgctgccgtccatacgccacacgggcggtttgccatttctccgtattcagtgagtattattgcgttgcaatcactagtaataaggagtggctatggctaccggcagcaagctcgttattgtggagtctcctaccaaggcgaagaagattggcggatacttgggctccggatacacggtcatggcatcggtcggccatatccgcgaccttgcccagcccagccaggtgccggcggccgagaaagccaaatacggcaagttcggcgtggatatcgaagacgggttcaagccgtattacatcgtggacggcaacaagaagaaaaccgttgccgacctgaaaagcgcgctgaagaaggcagacaccctctacctcgccactgatgaggatcgcgaaggtgaggcgatcgcatggcatcttgtgcagacgctgaagccgaaggtgcccgtcaagcgcatggtgttccacgagatcacgccggaagcgatcaaggcgtcgctgaacaacacgcgtgatgtggacgccgccatggtggacgcccaggaaacccgtcgtattctggaccgtctgtacggctatgagctgtccccggtgctgtggcgcaaggtcggtccgggcctatccgcgggccgcgtgcagtccgtggccacccgtctgatcgtggaacgtgagcgtgagcgcatggcgttcgtgcgtgccccctattgggatgtcaccgccacgctggaagcgcccgacgccgacggcaacaatgttgcgttcgattctcgcatggtgtcgcttggcggccgtcgtttggccggttccaaggatttcggcgatgatggccagctgaccgccgccggcgtcaaagacaacgtcgtgcagctggacgaaacgcacgcgaatgcgatcgcgcgatcgctggaatatgcgacgttcaccgtctcgtcgatggaaaccaagccgtaccgtcgccgtccggtgccgccgttcaccacgtccacgctgcagcagacggccggcaatcgccttggcatgagctcgcgccagaccatgcgtgccgcgcaggggctgtacgaaaacggtttcatcacgtatatgcgtaccgattcggtgacgctgtcgcaggaggcgatcgcggccgcccgtgaagcggtgtcgcggcacttcggcgaaaagtacttgtccgatgcgcccaagcagtacgccacgaagacggcgggcgcgcaggaagcccatgaatgtatccgaccggcgggcgcgcatttccgcgatccggctgaaatcgccaccaaagtgccggccgaccagctcaagctgtacaccctgatctggcagcgcacgctggcctgccagatggccgatgcgaccggttccaccgccaccgtgcgtctgtcctcgccgaccgaagccgacggcgaggccatgttccaggcgtccggcaccgtcatcgaattccccggcttcatgaaggccaccggcgagggccgccgtagcgttgtcgacgcgaagaagagcgccgaggcggcgggcgtgaagattggcgataaggccgaaaagtctgcgaaggcttcgaagaaaaccgatgacaacgtttccctgccgccgatgcagccgggcgacgagcttgccgccgtggacgttgccgcggacggccacgagacccagccgccggcgcgctacaccgaagcgtcgctcgtcaaaacgttagaacagaaggaaatcggccgtccgtccacgtatgcgagcatcatctccacgatcatcgaccgcgggtacgtgtacgagcgtggccgtgcgctgattccgtcctggctggcgttctccgtcaccaaactgcttgaaacgaagttcccgaagtatgtggattacgagttcaccgccgatatggaaaccggcctcgaccagattgctggtggccatgagaccggcaaggcgtggctgacccgcttctacttcggttccggcgatggtgcggcccagtccgccgacgaggcgcatgagggcctgcagcagcaggtggcgcagcttggcgagattgatgcgcgtgagatcaacaccatcgatatcggcgatggcctgcacgtgcgcgtcggccgttatggcccgtatcttgaggacatgaagcatctggatgcggaaggcaatccgaagcgcgcctcgctgccggatacgctcgctccggatgagctgaccgtcgaggtcggccacgatctgattgaaaaccattccggtgggccgcgtgaactgggcaaggacccggtgtccggcggcaccgtcgaggtacgcaatggccggttcggcccgtacgtggcgttggtcatgccgagcgcggaagatgccggcgataccgctgccgagtccgccgcaggcaaggcgggcaagacgaagcgttccggcggtaagaaggcggcttccgaccgtccgaagatggcgtcgctgttcaagacgatgagtcccgaatcgctgacgttggaagacgcgctgaaactgctgagcctgccgcgcgaagtcggctcctacgatgaggcgaacgccgaaaccggcgaaatgcaaacggttacggtcatggccaacaatggccgttacggcccgtacctgaccaagaccggtgccgacggcaagtccgacacgcgttcgctggcttccgaagacgagatcttcaccgtcgacttggagaaggccaaggaactgttcgcgcagccgaagtacggacgcggtcgtggacgtggcgcggccaagccgccgctgcgcgacttgggcaccgatccggaaacccagaagcacgtgaccatcaaggacggcttctacggcgcgtacatcaccgacggcgagacaaaccgtacactgccgaagcagtatgcgcccgaatcgatcgaaccggccgaggcgttccgcctgctggcggagaagcgcgcgcaggggccgtcgaagcgtcgtggccgcaagacggctgcgaagggagccaagaagggcgctgccaaaggagcgaaatccgcgaagaaggtgagcgcgaccgaacaggcgcgtgccgaccgccgtgccaaggtgcgtgaactggccgacaagggttgggcgaatacgcgtatagcgaaggagatcggctccaccgcgtccaccgtgaaggctgacgtcgactggctgaccgccaacgaaggctacgcgcgtcctgaagtcgttcccgcacgctgacgttatgcggcgcgcgaaacgtcgcacgatctgatgttccgcaagacaatcggcatcgtgcgacaccaagccgtgggccgaatggccgggcacggcaggggcgcacggtacagtgaaaggcatgcagggcacttttatctcgtttgaaggcgttgacggcgtgggcaagaccacgcaggtcgaacggttgcgcgcatatgttgaatctcagggccgcgaatgcgtggtcacgcgcgagccgggcggcaccgcattgggcgtggcgattcgcaaaatgctgttgcacggcgtggatacgggggatgagaacgattgtgccgacatcgccccgcgtacggaggcgctgttgttcgccgccgaccgcgcgcagcacgtcgcggaagtgattctgcccgctctgcaacgcggcgcggtggtcatcaccgaccggtatctcgattcctctttggcgtaccaggcgggcggccgcgagctgacggccgcggaaatccgaaacctgagcatgtgggccacgaacggtctgctgccggaacgcacgtatctgctggatatggatccggcgcaatcgcatgcgcggctgcagcatgccgaagaccgcatggaggcggccggcaacgacttccagcgtcgcacacgcgtcgcgttcctcgacttggctgaacgtgagccggaacggttccacgtcattgacgcaagccagtccatcgaagacgtgtgggcgcgtatcaaagccgatttcgacaccgtgagcaccgctgacgggggtatcgcatgagcgtgtggaactccatagtaggccaagcgcaggtggtcgaacagctgaaggccatcgccagcggcgacccgaaggccatcgcgcagtcgtggctgatttgcggccctcccggatcgggccgttccaacgttgcccgcgcgttcgccgccgcgctcgaaagccccgatcatggcctgaacgatgagccgaccaaaaccaccgagcaggtgcttgccggcacccaccccgacgtgagcgtgctggccaccaacaaagtgaccatcggcatcggcgaggtgcgtgacatcatcaccacatccgagcagatgcccggcaccgcgccgtggcgcatcatcatcatcgaagacgtcgaccgcatgatggaacgcaccaccaacgtgctgctgaaggaaatcgaagagccgagcccgcacaccatctggctgctgtgcgcgcccagcgcccaagacgtgctgccgaccatccgctcgcgcacgcgcatcgtcaacttggccgtaccgtccaaccaggcggtggcgaaattcttggaatcgcaaggtttcgagccgaatatcgcggcgcgtgcggcacgattgtcggaggggcacatcggcatcgcgagcctgtatgccaaggacgaacgcgtcatgacggaccgcgacgagctcatcgtcggcgtgctcggcttgcatcgcgcgtcggatgccgtgctattggccggcaacctcatcgacaacgcgaaggcgcaggccgaagcggaagtcaacgtcaaagcgtccgaagcggaagccgatttccgccgcatcaacggactcggacccaaagaccgcatacccccgaaactgcgtggcgcatacaatgcgatcgccaaaaaagacgagctcaaacgacgtgccaccagactcacgcgtgacgtgctcgaccgtgcgctcaattcggtcgccagcatctaccgtgacgtggcggtgctgcagaacaacgccgaggacgcggtggggctcatcaacctcgaaaaccgttccgccatcacggaattgtcggtacggctcgaccgtgccggagccgtgcgccggctggagaacatcgccaccgcgcgccgcaggctcaacggcaacggcaatccggttttggtgttcgaagcgctgttctgcgcgccgattccgtgattttcgtaatttccagtaattaccggcgattcgattcgcgattcaccggcggaacaccgaggaatcccgcacaataagctgcggggcaagcatgactcggggcgcgcgcacgctgccgcctggcgcagcagccgtctccgccgcgcctccggcaggaccggaagccagcaatcgtaagcattccgacacaatacgctcaaacggcgcacgcaccgacgtcagccgaggcatggtggtacgcgcgatggcggaatcatggtagccgaccaccagcacgtcctccggcacgcggattcccaacgcgtcgaacgccaccatcacgccgaacgcgatcgcatcgtcggcgcagaccacggcttccggctgtacgagcggcccgttgaacagccgcatggcgcaatcgaaaccgcgctgcacggtacgttcgccgaactggttccagttttcgctggtgacaagcccgtaagtgcgcatatgcgtgtggaatgtggcgaacagttccgccgattcgaaagacagctcgtcaccggccatatacgcggcggacgcgatgccctgctcggccagatgtttgacaatcgcctccatcgcggcgttttcgtcgatgcctaccacggacacgcgcggcgcggtctgccgtccgcagatctgcacgatcggcagcgtgttcgcgtactggttcaacgttccggcaaggtccgcgccggccgcgggcaccacgatcagcccgtccacatggcggttgaccagcgattcgatgcgttccgcctgcgcttcctgcgtggctccgatgcccagcagcagctgttgcgattcggtgtcgatggtcggctcgatctcgtcgagcagttgcgcggagaacggttccgtggcgctcggaatgaccagaccgatggttttcgttacgtcgctgcgcagcgcgctcgccgcgtagttgacggaatagccgagttgtttggcggcttcgcgcacgcggcgggcgatatcgtcgtccttgccgcgtttgccggacagcacgcgtgagacggtggcgatggacacgccggccgtcgccgcgacgttggtgattgagctgccgctgtcggttctgcctgccatgcgctgtcctttccgtcgtgtccggcttgcgtttgccggctccctaagtgtttttcaaaatgccctaaagggtgccctgaacccctgtgtgcttctcggtcaaaggtctggtctgatgaaccggttcgagccgcgaagagcttattaagaatagaacgaccgcccgtcgaatatggcgggcggtcgaaacgttcgtacgtcagtgcgtcagtgcgttatgcggtgcgtcactcggcgttgacgaggatgttggccaggttgtcggccacggcctcggcgttgtcgccttcgacgttgatgaccacggtgtcgccctgcttgatgcccagacccatgatggacaggatggagccggccggaacggcgttgccgccttccttggcgatggtcacggtctggccggaagcggtgacggcctgtgcgaacatggcggccggacgggcgtgaatgccgaccggatcgttgatgacgagattgcgggttgccataatggtctcctttgttgtggttggtggttggtttgcttacgttgggttgtctcgatatttacacgtcgatgtatatcgatttttgcatatcgattgcattatgcggcttttgccggcatctgcatttcttgcgattatcatagcacagtttttacgaaacacagaaaacgtttaccggttttgttttgcgggaatttcgtgtatactaatcgcaggctgaaaatgatttaccggcaaagacggtggggatcattgcagtaactcacctatgcaaggcaggcataatcctgcaatcgtttgcgtatccatattttttccaaggaaacaggaaaaggagttctcatgaacattaagggtgttggtatcggtcgtggcgtcgcagtcggcccggtcattcgcatggccgctccgctgccggaaccgtcggacgctccgcgcgccgaaaacatctccgcggaaaccgaaatcgcccgcgtcgaaaagtcgctcgccctcgtcaacgccgacctgaaccgtcgcgccgaagaggccgccaacggcgacgaaggcgccaagcaggccgccccgatcctgcaggccatcgccatgttcgcctccgatccgtcccttgcgcagtccatcaaggacctcatcaaccagggcaagaccgccgagcgcgccgtgctggaaggcttcggcgcggtcgaagacatgttccgcgccatcggcggctaccaggccgagcgtgcagccgacctgcatgacgtcggccagcgcgtgatcgccgacctcatgggcgctcccgctccgggactgccggtcagcgaaaccccgttcgtgctcgtcgccgaagacctgtccccggccgacaccgccgcgctcgacatgagcaagaccctggccatcgtcacttcccagggcggtccgacctcccacaccgccattctggcgcgcgcccgtggcatcgtcgcggtcgtctccgccgccgaagccgccgaacttgagaacggcaccaacgtcatcgtcaacgcagccaagggtgagatcgtggtgaacccgagcgaagacgagattgccgccgccgaagccgccaagtcccgtgccgccgcagccaaggaactgcgtggcaagccgggcgccaccaaggacggccatctgattccgctgctcgccaacgtcggcaagccgtccgatgccgcgaaggcgctggaatacggcgccgaaggcgttggcctgttccgtaccgaattcctgttcatcggcaactccgagccgccgagcgtcgaagagcagaccaaggcctacaccgagctgctcagccagttcccgggcaagaaggtcgtgatccgcatgctcgacgccggcgccgacaagccgctgccgttcctgactccggaagacgagccgaacccggccctcggcctgcgtggcctgcgtaccctgcgcgcccacatggacgtgctcgaaggccagctcaaggcgctcgccgccgccgacgccgcaaccgacgcgaacctgtgggtcatggccccgatggtcgccgaccagcatgaggccgactacttcgtcaagctcggcaagagcttcggtctgaagttcgtgggcgcgatggccgaagtgccgtcgatcgccctgatggccgacaaggtggctgacgtggccgacttcgtgtccatcggcactaacgacctgacccagtacacccttgccgccgaccgtaccctcggctccgtggccaactatcagaccgcatggcatccggcggtgctgcgcgccatcaagatgatctgcgacgcgggcaacgccaagggcatgccggtgggcgtgtgcggcgaggccgcggccgatccggatctggcggtcgtgctggccggtctcggcgtcaactcgctgtccatgaccccggtggcgctggacgatgtgcgcgcctccctcgccgaagtcaccttcgaagaggccaaggccaaggcggccgcagccctcaatggcgacttctacaagccggccgagtgatttcccttctttccttcactcggctattccggactttgcggctgcgtcatcgcggccgcagggttccgccactgcaaatgtgcctatgagagcgattcggttctgatgggccctgtttcccggaatgaccccgtttcgtgcgatcgccgcgcggacggggtcgtttcggttgcgggttgtgtcgattgctgcgattgcgtcgattgcgccaccggcgtagacgcgtcatacggccgcgtcgcgtcacgcgcatgcgcgatactggaagcatgaagatttccgcagatttcaccgtcattcccgacgcgttcgccaaggcggcgccgcctgagaactgcatcgacggcactccgattgtttccttccccttctatatcgacgagctcgacccgtccgtgcagtttctgcattgggaattcgtcgatcccgattccattccggtgtgcggtttccagtggaaccattggtcgctcgccaatctgcccgtggacgcgctgatgtacgatttcaacgattcacatgcattggcgattccggccgatttttcccgcacggtttccgcgatgattcccgagacggtgcagggacgcacgtccgccgcatcgccgttgttgaaaggccgtagcgacgatcccgccgtcaccatgcgttacaacggtccgtatccgcctgatcgggatcacgaatactacctgcacgtatggggcaccaccgcgcctctcaatggtctcaatcaaggcttctggctcaacgagatggaacgcgcgttgcgtaattccggtgcgatcgcggaccaaggcgctatcttcctgaccggcaaggcgtgaccggcgaaaccggcgagaacagccggcaaggcgcaaaccgcgtaatcgcaagataataccaaagaataccgcaaacgtaaacaaaacaaacgaaaggaacctacatatatggcatgcaccacgattctggtcggcaaggacgcaagctatgacggatcgaccatcatcgcccgcaatgaggacagcgcgaacggcgaattctgcccgaagcgcttcatcgtcgtcaagccggacgagcagccgcgccactataagagcgtgctgtcccatgtggaagtggatctgccggacgagccgttgcagtacacggccgtgccgaacgcggatctgaaggaaggcatttggggcgaagccggcgtcaatgaggcgaatgtggccatgagcgccaccgaaaccctcaccaccaacgagcgcgtgctcggcgccgacccgttcgtggaactcaccccagccaaaggcaagaaaggcgaagacggctacgagccggaagtgcccggcggtatcggcgaagaggacttccttaccctcgtgctgccgtatgtcaagaccgcccgcgaaggtgtaacccgtctcggcgcgctgctcgaacagtacggcacctacgagatgaacggtgtcgccttctccgatgtggatgagatctggtggcttgaaaccgtcggcggccaccactggattgccaagcgcgtgccggacgaagcatacgtgaccatgccgaaccagctcggcatcgacgaattcgaccttgacgatgccctcggcgaccaggaggagcatatgtgctccgcggacctcggtgaattcatcgaacgcaaccacctcgacctggccgtggagaacgtcaccccgttcaatccgcgtgacgcgttcggctcccactctgattccgaccatgtttacaacaccccgcgcgcttggtacatgcagcgcttcctcaacccgtacgacgagcagtgggacggtcgggacgccgaccaccagccgacttcggacgacattccgtgggctcgccagcccgatcgcaagatcaccatcgaagacgtgaagtacgtgttgagctcccactatcagggcaccccgtacgatccgtacggcaagctcggcgaccagcattcgcgccacatgttccgtccgatcggcatcaaccgtcagagccagctgtccgtcatgcagatccgcccgtaccgcccgcaggtcaaccgtgccgtgcagtggatcgcctacggctccaacccgtttaacacgctcgtgccgttcttcccgaacgtcgactccacgccgaagtaccttgaggacaccaccacgcgcgtcacctccgagaacttctactgggagaaccgcatcatcgcggccctgtgcgacgccagcttcgccgacaccgccaacgcggtggaacgctaccaggagaagaccggcggcatgggccaccgcatggtagccgccaccgacgggcagatcgaccgtctggtggaagacgtcatcgacgaattcgacgcggacgacgagactggcgacgtgcagccgatggaaccggacgaaatcatcgaagccgtccgcaacggcgaggcgcgcgaagtgctcgccaccgccaacgagaccatggccgcgcagcttaaggcggaaaccgacaagctgctcgactccgtgctctacaccaccagcatgaatatgaagaacggcttccacatgtccgacttctgatcgttccctgatgggatggccggtatttttccgcgattgcatatcgttgcataacgccggaaataccgccaagatcaacggctcccgcactgcgctcgccaccgtccgttccgtatgacggccggacggcgtccgctgtatgggagccgttttctattgctgacgctcgttcactagaatgttgcttatctgtgttgttccggccatgttcggcgctcgacgccgcctggcggaaggcttcaagaaaggactccagtgaccagcattgaggatttcatcagccaatacggtctggtgcagaagattgatgcgttcggctatctcgattatctgaagagcaatccggatgcgccgcgcaagcatggcaaggtcgtcctcgtcaccgccgacaccccgttgaaggcgtcccgcggtgagggcaagaccaccaccacgattgcgttgatcgatgcgcttcgtgagcgtggcatcgacgcggcagccgtgctgcgccagccgagcatgggcatcaccgcagccggttccaagggtggcgcgtcgggcggcggcaaggcctccctgacccacccggagctgatcgactggggtctgtgcggtgaaatgggagccatcgaggccgcccagaacctgttggtctcctttgcggagaaggctgttgacgacggcaagctggacaccatcctcgtaccgcgcgtctccgaagtgccgtcccgttccctgcgccagatcgcagtggaccgtggaaagggcgacgtggctgagcgtgtggtgctcaccccgacctgcgagctcatgcagatcgttgtgctgtcgcgttccatggatgagatctccgagcgcgttgccaagatggtcgccggcacgaaggatggcaaggccgtgaccttcggcgaattcgttgacctgtggcgtatcaccggcatcctcggcgacgccgtgaagccagccaagacggagaccgtgaacggctctccggtgtacgtgcacggcggcccgttcgccaacgtgtccatcggcattccgacgctggtttccgtggaaatggcgtgcgcgctgcatgacgtggtcatcgtcgaagccggttatggtaccgacgcaggcgcgcagaagtggcttgacatagcctgccgcgaatacgacgcgcagtggccgtccgcagccatcgtcgtgacccgcgcttccacgtggcgtgacgatccggatctggcatggcgctacccgttccacgtccagcgcctcgaaggtcttgatattcctacgttcccgctcatcaacctgtgggatggcgaggacgaccagattccggcgctcaaggccacggccaaggagctggaattccgcgacccgatcatcggcaacctgtaccgcgacggtggcgacgcgctcgccccgcagctcgatgcgttcgtcgatgccgtgacgaacggttctatgccggccgaaccgcacagccacaagggcatggctctggtggagaacgtgcgttgggtcgccgagaacgcgtatggcgttccggccgaccgtgtgattctgaaggacggtttcgccgagtcgttgcaggccgccgagggtctgtgcgccagcgcgggcatcgatttcggctcgcttgctctggtcgcggtgaagtctccggccaccatgaccgacaacgaccgcgctccggaagccgagcgcaccgtcacgctgaagaaggtcgaagtgcattccggcgcgggcctggtgcacgtgaacctcaccacgtcgctgaccaccccgatgccgaagatcgtctgattttcttgcgattgcgccgcgtggcggtacgtcccgtaccgtcgagggcgctcgctaatcgttgattcggcgtaaatacaaagccgctggtcccgttcgggccggcggcttttttcgtgggtgatacctttacgttgtccgtttgtgggtgcgggcgtgcttgcatgtgcgcccccttttgctcacgagttgcggaatggggcgatttttctctcttatgagcaaaagggggtatgattactgacgattttgctggttttcataccccttttcgctcacgtcccgtagaaaaggcccgtttctcgcttttgtgagcggtcgggggtgctgatattgcgatttccctgccgtagtcaggcgagcttcctagacgtgcttcccgtaggtgaggtgagaggtttgcaatatgggcaaacctcgaaggaacggtggaacttcgttaagaagccgagatcagaagttgccgccgttccaaccccagtcggtcgtggcggtgtagcggatgtaagtgcggtcggccggaatgcccagttccttgcccagcgcggccatgatctgctccgtcagcttctcccaggcggaacccggcacggaacggccgaacacattcacttccacgtatgcggccggcttggaatcgtcaccgccgaaataaatcggcatattgtcttcgaacgggcacatcagccagccttcagacttgccgggaacggcagaaatcgccttgccgtaggccgtcttcagcgcctcgcgctgcccaggggtggtggatacggaaacgtgcgtgtggatgactggcattgctgctccttgcaatcgttgaaatatattgttcttcgttacccaagtttaggtggtctgcgcgcgagtgttaaatatcccgtgtgagaaaactgattgaacagcttatgaaattcggcattgtgggtgtgatcgccttcatcatcgactggggtattctaaacattctcgtcggcgccttccacatgcacaacgtgctcgccgccaccatctcgtttatcatctcgttgatcttcaactatgtcgccagcatgaagatggtgttcaagcaccgtgaggacatggctcgctggatggagatcgtcatcttcgtggtcggcgcggtgatcggcctgtttatgaacgacgccatcatctggatttccacgtacggcatgaaccatgatgcgtatgtctctcaaagcgccgaatatctgatccgtaccaacgtgggcaagcttatcgccaccgccgtggtgatggtgtggaacttcgtgacacgcaagtggttgttggacgatacgcataccaacgccacgaaccgtctgaagaagaaggaaaaccgcctgagcccggaggagctggaggccaagtgggagaacagtttctcgcacaagctgggcgtgtggtcgctggaacatacgccgaagggctggccgaagtagctggcggcgtttcgtatacggcatacgaaaaggcgcgtccgaatcggatttttattgcgattcggacgcgcctttctgcggttggcgtacgtttcctgggattgccggctcggttatacggttcacgcactcacgttggtaagcgtcggctgttcggtggattctttgatctgcttgaatccaagcatggcgatcgccagcgacgtcaacgccaacgccgtcaccacaatgaaaccgccccgcgagcccatgcggtcgatgaactgtccggcgatcgcggaaccgaccgaaccgccgatcgaattcattgcgcccatccaagccataccctccgtgaaacgtgtgggcggaaccaggtgcagcatcagctggttgccgttcacccacgtcggagcctggcagacgccgatgcacaggtagatgatcatgatcacccataaatgcttggcgaacatgaacgaaccgattccaagattcaccaccgcaagacagaagtagaaacgcttccacagtggaatcgtccaatttttcgcaccatacacgagcgcgccgatcagagagctgaacgagaagcaggcgaatacgaaaccggtgaactgcttcatatgcgcctctgtggcgaacgcgacgatcgaaatgcctgcggccgactggaacgcgcccaaaccgaaccacgtcacgcacaccgcaatcaggcccggaccccaaatcgattccttgctgcctgccgcaatatccgtggcggccttctgcatcgcggccttcacctcagcggccgtcttgccttccgcacgagccttgtcgcgcgcgtattctactgccgcttcggtctgcaaagccttggaacgggccgtttcgcgctcacggtactccttacgcgtcataccggcctcgcgtgccagctgcgtctgcgacttcggttcggtggttagctccgtcaggaacatcaacgcgccgaccaccacgcatatgccggtgaatgagaacgccagcagacctgaaattacggccaaggtggatgccagcggattgccgatcacccacatgcattcgtcgaatacgcctgatagggacagcgcgcggttcgttttttccgcatcccctttgagcaatgtggtccaacgttgacggctcatcgcgccccacggcggaatcgccgccatgaacggcacgatgcagaacaggatccatgacggtacgcgggcggtgatgcaggataccagcgaaatcgcggcgaccatccacacgatgattgtcggaatcgacacctgccgttggccgaacttgtctaccagcttgccgagcaccgggctggtcacggccagcgcgatcgcctgcactgcggtcagcgcgccggcaagcgaataattgccgtagtagtgctgcacggaaatcgtgatcgtcatgccgaccatcgggaacggcatgcaggcgatcaccgagccgacggagaatcgtgcggtgtgcggtatgcgaagcagctccgcataccctccgaaaagacgttggccgatgtttttgacgccgacgaggacattgttggtcatgcttgccgctcctttccgctcacggtttcgctcgtgacgtccgcagctttgcgtcgcgtgcggactgatggtggtggttcccctgaattattggttaaccgcttccgataccagctcgctgccccagccgtccgaacacgtcaatcgattgacatgtttgacatgccgcacacggggagaaaggtgggatggtgcgtgttgtttgtgtgtctttgttgaccaaggcaactttatgcgcaggtaccgtcgtgacacgcggtacattagggcaggaaccaatattcgaatcgacgaattttttcacagggccggcgaccggcgaaacgtgctgagccagcacgtggccggcaggtccgaaacgcaagaaaggcggccaatatgccggcgacaaccatccatttcgtgcgccacggcaaagtggagaaccccgggcacctgctgtacgagcggctgcccggtttccacctgtccgacgtgggcgtgcgcatggcgcaggccaccgcgcattacatcgcggtcagcccgcagctgaacaccgtatccgccgtctactcgtcgccgctggaacgcacgcgcgaaacggcgggggagatcctcgaatcgctgaattcggtacgtggactgcgcggcgaggaaccgctggagctgcagacggacgaacgcctcatcgaagcgcgcaacgaatttcgcggcaagcgtatcggcttcggcgaaggcgcgctgtggaagaacggcaactggaagctggtacgcaacctgtggaagccgagctggggcgaaagctaccagtcgatcgcgcatcgcatgcaggacttcgccttggagaaagtggcggaatatcccggcaaacagatcgtggtggtcagccacgaatcgccgatttggagctaccggcacatgctggaaacggggcaccccgaacacaacatgctgttgcgccacaccgcgctcgcttctatcacctccatcacttacgattgcaataccgggaaaataatgtccattacgtacgccgatccggcggcggacgtcgaataatgtgaaccaaaacatgcggtggctcaatcgcggtcggggatgactgcggttcgggccggccgcacgatatacaaggagaaagtatgtcttttgtatacgaccagaaggtcgtcgactcgatgtacggctcgcacgtggtctccatggcagttgactacggtgtcgatctggtcaagatgtggccgttgcaaacgaaccaggaactggaaaacgacgtcaaatatgcggagaacctgcaggtgatgttctccggcatgatgacgcaggtgccgctgaaacgctccgaagaagtcgaccagtcggttgcggaagccgtatacgaaggcatggatgtgcttcccggcgtcgatccggaaatcatccgcacgctgatggacgccaaccacgcctatgacgtgatggcctcctaccacggggtcgacggcatcgaactgttcatggaaaccgccagaatactcggcatcgacgtggagacccgaatcgaaaaggaaatccaagacctcatggagaacctctcacgcactatgcgcagcgcctccggattcgaagtcgacgatgacgtggcggaaaacgtcggcatctgccagtcggccacggtggaccgcaacgaattcgcaagacgctacctcgcctcgatgacggttctcgacgcgctgataaacctcatgtgctatggcaccgacgattcgcaggagcaggccatccgcgtgctgccggtgctgctgttcgtcaacgccatgcgcaaccagctgtcgattccgcccactttcatcaacgccgaacagctcatcaacctgtttggtctgcgtgacaccgcccgccagttcggacggccccagtcggtgttcgacagctcgttcaacccgctgacgttctccaccaccgtcaagtacctcgctttcttcgcggggcaggaatggctgcggcatatgaggttcctggagtgggacccgaagcaggccgaacaggacgccaaagacgaggacgagcgcaaaagcagggaagcgctcgcaaagaaatacaatttgacgagcgatggcgataacgcggcttccgacgcggatttggattcgtctgcagactcgaatttgtctgaggattcggactcgtcggaagaggccggttcggagccgaccgaggaataagtgttgcgggcggtcgtgtgacgtctgacggtgaaggctttgcgtgtacttgcgtggcgtgcgcttgtgcttgcgctcgaattgcgcgtggctgtcgcctatcccacgcgttacatccgcaacgacgtcactacccgtaacgaatgatctgaaacgaataatcccggtatcctgcgattgcacaggataccgggattattcgttattcgttatggtgtgccacgttttgtgtggcgataaggcggggatcagagcgaaatcagagctgctgatcggtgccgttcgccggatcattcggtactgccggagcgtccgaatccgccggagcgtcggtattcggctgctcgtgcggatgctggaactgggccggcacttccggcatcggcggaatggacggtgtcggaggcatggtcggaacagccggcatcggaggcatagacggtacggacggagcctccgccagcggattctgctgaggtgcggcgtattgcggcgcggcgtgctgctgcgcggcgtcatactgcggtgccggagctgtgtacgaatcggtcggagtcgctggtgccgtgtacggcgcggccggtgccgcagccgccggattggtcggcagcgggacgttgccgtacgaggtggcctgcgccgcatacgggtctgccggagcctcgcccgtggcgggagcccatgcgttggaagccgtaggagcgtcgaaacgcgcgccttccggattggaatcgcgggccatcagcacaaagtagaacacaccgctggcaatgaaggccagcacgccgaggatcagcaggacaacgccgccgatgctgacgctgttgcccgcctccaacgacctgaacgaaagactgctgccgatgatgaggatcagaccgatggcgaagaagattccggcggccgcctgtaccgcgtagatgatggccagcacggtgccacgcatgttgatgtcatgcagacgacgtacgccaagcgcgatggtcggcacaagcacgacgagtccccaaatggaggagaacgagtctccgacggtggcgatcacgccggaatcggtgaggttcctcaacgtgcggaatacgagactcaacacgaaagtgacgacggtataggtgaggaaccaccaccagaactcgctacgcgaggcgcggcccttgaacaccgcgtacttcttgaagaaacggacgatcgcctcgcccaggttgcagccatatgcgggcatgtcaagcggcgcggtcaatgcgaagaagctattgcccgactgcggttgcggtgccggctgcccgtaattcgcggctggagcctggccgtactgaggggcctgtccatattgaggggcctgagcgtactgcggagcctggttgtattgcggttgcggtgcttggccgtactgcggagcctgaccatactgaggtgcctggttgtagttcggggcggcgtactggggcgcctgcgcctgcccgtaatccggcgtgccgtactgcggtgccgtctggccgtagtcgggggcaggagcctgaccatactgcgctgccggctgcggcacctgcggattgtattggttggggtccgtcattagagtgccctttcacaaaacggtgactaaagaataaagaaagtcgcttcatacattactcctttgccgatgtgaagatagggaaaaatattgcagtatggaacgctgcggaagaaaaacggcgattgggtcgtggcacgtccggtttgcgcggcacaatggagcctatgactgaagttgaaaataccagaccggaacttcctgaaaacgttcgtgtgcgtttctgcccgtccccgaccggcattccgcacgtcggcatggttcgcaccgcactgttcaactgggctgaggcccgccacaccaagggcacgttcgtgttccgtatcgaggatacggacgcccagcgcgactccgaggaaagctacaaccagatcatcgaggccctgaattggctgggcatcgactgggatgaaggcatcaacgtgggtggcccggacggcccgtaccgccagtccgagcgtggcgacatctataaggacgtcgcagccaagctgctcgaagccggctacgcctacgaatccttctccactcctgaggagatcgaggcccgcaacgtggccgccggccgtccgaaggctttcggctatgacggctacgatcgcaacctcaccgaagagcagaaggccgcgttccgcgcggaaggccgcaagccggccctgcgtatccgcatgcccgacgaggacgtcgctttcgacgaccttatccgtggtcgcatcgaattcaaggccggttccgtgccggattacgtgatcgtgcgtccgaacggcgacccgctgtacacgctgaccaacccggtcgacgacgccatgatgcgcatcaacgtggtgctgcgcggcgaggatctgctgagctccaccccgcgtcagatcgtgctgtaccgttacctgatcgagctgggcgtggccaaggaaatgccgctgttcggccacatgccgtacgtcatgggccagggcaacaagaagctgtccaagcgcgatccggaatccaacctgttcctgcaccgtgacaacggcttcatccgtgagggcctgctgaactacctggcgctgctgggctggtccatcgcccccgaccgcgacgtgttctccatggacgagatgatcgagaagttcgacgtgcgtgatgtcaaggccaacccggcccgcttcgacgtcgacaaggccatctccatcaacgccgagcacatccgcatgctcgaaccgcaggacttcctgaaccgttccgtgccttacctgcaccgcgacggcgtggtctccgccgattcctgggatgcgctgaccgaccgcgagcgtgaggtgctcaccgccgccgctccgctggtccagccgcgcgtgcgcctgctgggcgaagtggccggcatggtcggctccctgctgtccaccgaaggctacatcgagccggacgccgacgccaagaagcagctgaaggattccgctccggccgtgctcgacgctgcgatcgcggcgctggacgccgttgctgagggtgattggaagaccgactccctgcacgagacgctgaacaaggcgctggtcgaagacggcggctacaagccgcgtctggctttcggcccggtgcgcgtggccatgagcggccgccgcgtgtccccgccgctgttcgaatccatggaaatcgtcggcaaggacgttgccatggctcgactcaagggcctgcgcgagcacctgtgagccgttgagctgctgactgttagctgaatgatggaaacccgccggagtgattcggcgggttttcgtttatgcggaaggctggtgcggaatggcggaaaatagcgcgacacgccgtaagttgcgcgactgtgctgtttcgcgtatatttatcactcgttgcggttcacagcctagttgagaatcacagcgataactcaagcccccgtcgtctagcggtctaggactacgccctctcacggcgccaacaccggttcaaatccggtcgggggtacgacggacaacttttcgaagttgccacgcctgccaaattgggatgtggtgtaattggcaacacagctgattctggttcagccattcttggttcgagtccaggcatcccagccaatgagccctcgcagatgcgagggttttttgtttttcgcacctgtctgttcacgccgctttgggcggtgggttgatggattttgccggatgcgatgtggcagcgcaatctgctgacgccctgcgtgaatcgcacatgtaatcgcccaatgttgcattaccctagaagtatgaccgaattgcagcatgccgccaaagccacgcgcccgcgcatccaaccagcggaagagggggaccgtcgaccgctttccgtatccgcacggctcggccgcctgcaattccaccagtccggcaaattccgcgtattgcaattcgccgacatccaagacgggccgaaagtcagcaaagacaccatcagcctcatcgaggcctcgcttgacgccacacgccccgatcttgttattttcaacggcaatcagatcgccggatatgattccgcatacgcgctgacctcccgcaagcgtcgctgggacgcgcgtccggcatccgcatcgtccgaagcgtccggggaacgctatgcggccgcattggaacacacccgcgaattggtgcgagccaccatcgaacaactggtccacccgcttgccgaccgcggcgtgccgtgggctgtgacgttcggcaaccatgacttccagtgcgggctcgacaatgccgagatcgaaagcatctgccgcgaattcccagggtgtatcaatccggaacgcgctgccgacggcacgacgggcatcgccgtgaaacatggtgtgaaacatgatgtcggcgatatggaacaggacttcggattgccggaacagcccgtgatcgcgtgcgcgcccggcacattcgcgttgtcggtgacggacgtcgatcgcacgtatggcgtgttgggcttggtcctgctggattcgggcgattacgcgcgttccggcggctacggaagcccgtcggaagccgcgctgcgcttcctggcggatgcgccggggctgatggcggcgcaatcgcagcagctgcaacaagaccggcaagatgaacaggactcgccgcgcgaaccgcgcaagacgccgtccacgctgccatgcatggtgttccagcatttcccgatcgaacagtattatcgcctgctcaagccggtcgcggccaccgctgcgcgcgcgattgaaggataccgcaacttcgcggggcggcatttcgtgctcaacgaagacaaaacgcagcccggaagctatctgggggagggcgtcagctgcccggatgccgacagcggcgaattcgcaatccttgacaaggcgggatattttgcgatttccgccgggcacgaccaccgcaacgccttcgtcggttccgtgccggtcggaaccgacggtgaccggcagatgatgatggtcgcctcgccgaccagcggttttggctcatacggcccggtgccggccaagcgtgccgctcgactgttcgaattcgacatccgccacccgtacgagccgcgcacgcagctgttggaatacgacgagctggtgggcaaacccagcgcgggcaaggcctacgcctacggcatgaccagcgaatcgaagcccgattcggaaggcatggacctgctccacaggccgacgtggtggagcaagacgtggaacaagctggtctcgctgttccgccggtgactgttctggtttccggcatccaactttggaatgaatacaaaaaagctgacgatgggaactttccatcgtcagctttttacgttaacgtatgcgactggtcgcggacctgtcagcggccggaagacgccttgatcagcgcgtcggtcagatacttgccggcggccatgaccagcggcgcgtaacggcggccggggttggcgcccatacggccattcgggccggaaattgaaatagcggcgatcacctggccggacgcgttgcgaatcggcgcggaaatcgaacacacgccctcatcgcgttcattgatcgactcggcccagccgcgcttgcggacggcggtgagcttggccgcagtgaacttggcgtggcgaagaccctgatgcagacgttcggaatcctcccaagccagcagaatctgggctgcggaaccggcttccatggacagcatcgcaccaaccggaatggaatctcgcaggccggacgcgcgctccacggctgcgatgcagacgcgctgatcgccctgacggcggtaaatctgcgcggattcgccggtgcggtcgagcagggtctgcagaatcggcgcggcggcggtcaacaggcggtcctcgccggctgcggccgcaagttccgcgaatcgcgatccgagcacgaaacgaccgtgctggtcgcgcaaaacgaaacggtgacgttccagcgcgatcgcaagacgatgcgcggtcggacgagccagaccggtcgcggaaaccagctgtccgagtgtggctgggccggattcaagagcgtcgagaatcttgactgtcttgtcgagcacgccgaccccggaatgaatttcgttgctttgcggggtggctgcgtaattgccgtttgcctcgttcgtggcgttcatggcctgcgttttgggcatggcgttgctcgtattcgaagaagaagtcatacgctgaattatgccatctcacatattgaaatgcaaaatgtatgtggttcgcgactggggtaaagcagattatttaccttgcttccaccggctggcgaagctgggaaaatgctgaagtttcaacgattgcgcatatgccgtaagaagacgggaagtaacttttccgcgtttgccgcgctcgtccctcgttcatatctcatataccggcatgaaggacctcgaacccgtttcaagcccataggcttatagcacgaagaatgcggcaaggcaatagccgcgaggaaattagtgaggaaaaatctgaggaggtcccacaatgggaactacattggccgagaaggtctgggccgatcatttggtacgcaagggtagcgatggggctcccgacctgctgtacatcgacctgatgctcatgcacgaagtgaccagcccgcaggcgttcgaaggtctgcgtctggcgggacgcaagccgcgtcacgtcgaccagctgattgccacggaagaccacaacacgccgaccgtcgacatcgaccgtccgaatccggacgagacttcggcgctgcagctgagcacgctggaaaagaactgcaaggatttcggcgtgcgtctgtgcccgctcggcgacgctgaccagggcgtggtccacgcgttcgctccggtgctgggtctgacccagccgggcatgaccatcgtgtgcggcgactcgcacacctccactcacggcgcgttcggtgctatggccatcggcatcggcacctccgaagtggagcacgtcatggccacgcagaccctgagcctgaagccgttcaagaccatggccgtgaacatcgaaggcgacctgccgaagggcgtcaccgccaaggatattattctggccatcatcgcgaagatcggcaccggcggcggccagggccacgttatcgaataccgtggcgaagccatcaagaagctgtcgatggacgcccgcatgaccatctgcaacatgtccatcgaagccggcgctcgcgcaggcatgatcgccccggacgaggtgactttcgaatacctgaagggccgtccgcacgcgccggaaggtgagatgtgggacaaggccgtcgaatattggaagacgctgaagaccgatgacgatgccgtgttcgacaaggaagtgaccatcaacgccgaagacctcgagccgtacgtcacgtggggcaccaacccgggccagggcgtgaagatctccggcgtggtgccggatccagcctccttcaacgacgagactgagcgttccgccgccgagcgtgccatcgcctacatgggactgaagccgggcatgcgcatcaaggacatcgccgtggacaccgtgttcatcggctcctgcaccaacggccgtcttgaggacctgcgcgtggccgcctccatcatgaagggccaccacaaggccgacaacatccaccgcgtgctcgtggtgccggcatcctcccgcgtgcgcctgcaggcggaaaaggaaggcctcgacaagattttcaaggacttcggcgccgaatggcgtaacgccggctgctccatgtgcctgggcatgaacccggacaagatggtggcccgcgaacgttccatctccacctcgaaccgcaacttcgaaggccgtcagggcaagggttcgcgcacgcatctggcgtcgccggccgttgccgccgcgaccgccatccgcggcaccatctgctcgccggccgacctgtgaacctgctgcgagcggaagctgcgaacgcaatcgtaagtaatcgaaatatcgaaatcgaatatcgataggcaatcgaaggatttgttgacatggaaaaactgactacccttaccggcgtggccgtgccgcttcgccgttccaacgttgataccgaccagatcattccggccgtgttcctgaagcgcgtgaagaaaagcggcttcgacgacgccctgttctacgcgtggcgccgcgacccggaattcgtgctgaacaagccggaatacaagcagggcaagattctggtggccggcccggatttcggcattggttcctcccgtgagcacgccgtgtgggcgctgcacgattacggtttccgcgtggtgatttcctcccgtttcgccgacattttctacggcaacaccgccaagaacggcgtgctggccgcaattatgccgcaggaatccattgagctgctgtggaagctgctggacgaggagccgggccgcgaaatgaccgtcagcctggaagaccgtaccgtcacctgcggcgatgtgacgttgccgttcgaagtgaacgactacacccgctggcgtctgatgaacggctacgacgacatcgacctgacgctgcagcacgaagacgacatcatcgcatacgagaagatgcgcgccgaaaagttcccgttcaagccgaagaccctgccggtcaagcgcgagccggaacagccgatcgaatctgcccgagagggtgaataccctgattggcaagggccgttggccgatcgcggcatcatctgacgcgatggctggtcggcagtgcagtgcactgccgacagggccttgcccgagtccgaaacgagggcagcaatgagcctgcgcgcagcgcagtccataattgcaggacagggccgttggctgatcgcgacggtagcccatttcatcattggctgaccgcaaccacatctaacttttcccaagcccggcacccaagccgggctttttgtttaccttccatcacctttccgccaacagcaaattccacaaagcggtggcaaagcgcgcgcaaagcggtggtaaaatcataatacgacggcaaagtggcggcaaagcgagcgtaaaacgcgtggtaggtaaggcggtgatggccaatggacggtagcgagcacgatgatgcctggtggtcccgggaggttcctcggatgcgtgaaggcaaccgtttggaagcgaaacgtgccaagggcggcctgccccacagtttatgggagacgtacagctccttcgccaataccgaaggtgggctgattctgctgggcgtgtccgaacatgaagaccattctttgtatatcaccggagtagatgatgcgcggaacatggcgcaggatttttggaacatggtgcatgatccatcgaaggtcagtgccgttgtgctgagcgacaacgacgtggtgattcgccatacctcgcagggagatgttatttccatcgacattcctcgtgcggcgagggactgtattcccgtgtacgtgggccagaatccgatgacgggctcataccggcgtaatggcgatggcgattatctgtgcgatgaggaaacggttcgtgccatgcttcgggacagtgacctgcttcccttggacagaacgattgttgaaggcatgggtgctgacgcgctcaacgcggatagcgtcgcatcatatcgtcggcagttcaagaacagacggcccggccatccatgggtcggattgtctgatgaggatttcctgcttcgcatcgaagcgttgcggcttgatggttctcaggtgcgtcccacacgagccggattgctgatgttcggtgaggcgtggcgaatcacgtccgaattcccctactatttcctggactatcgcgaggtcatggacgaccaggagcggtggaatgaccgattcacgtcggatgatggcacttggtcgggcaacttgtacgatttttggggcaaggtggtcaatcgtctgcggtcggctgttgcccatccgttccagcttgatgccgatttgcataggattgatgacaatctgatggataaggccgttcgtgaggctgtcaccaacacgctcgttcatgccgattaattcattcgccggggcacggtgatcatccagtattacgacagaatcgtattgtcgaatcccggcagcctgcgtctttcctccgaagaggtgatgcaaggcggcatttcggatacgcggaatcccacgttgatgaaaatgttcaatctgattggcatcggagaaaaggcgggcagtggttttgacgtgatgcgtgaaggctgcctgttcgcaggaaccgccgcgccggaattggaagtgttcgacgatccggggcgtgtgcagcttacgttgtatccgcgcaagatcgccggagattccatgatcgccggagcttctgctgttcccggagtctctgcagatggcgggggccctgttggtgcggagtcgccgacaatgcggaattcggagcatggcactggtacggtccataggattggcgctcgcggggctgaccgtttgaacgacatggtcggcacattcggcaagaacgtggccctacctgccgatttcggcaatgcgatcaggccgcaaagccagttggagaaaatcacctatgcgttgacggtcggcggaccgcaacccacctcgtatctggctgtggtgctggggcttggcctcacccgtacccgggagatattggcctcactggtgaaagacggtgttattgaaccaataggcgtcggacgcggacgcaagtaccgtcttgccgagcataccggctcatgacggcgttccggttctctggacttgacctggatcgagagcccaaactcgtctggggaagtcctagccaaggaggtttccaaggtgagacggggcgtgcaggcgggacgtgtgtcgcgttacagtggacatgacatttcgtgtgttcgcatcgcatatccaaaacatgacacgagaacaatttcggggagcagtatgagccagggtttcgcgccgttttacgacgtcaatcgcacgtatgaagacaactatctgcaggggcccttcggtgcgttcgccgaagtgatgaagggcgattccgctgccggcgcctccgcgcagtctgcacagaccacccagtcgcagtcgtccgaccaggccgaggaattcctcggcttccgcgtgaacctgccgtttggcattcccgctggtccgctgctgaacgagcggttcaccaccgccgccttccgcatgggtttcgatttggcggtgtacaagacggtccgctcccgcgcgtggggttgcaacgccttcccgaacgtgctcgccgtgcatccgaagaacgcagacgggtctctggttcccggcagcgccgaactggatgaaggcgtgcttgccgacacccgatatgagcttccgatttcgatctccaacagtttcggcgtgccgtcgcgtgaccccgacgaatggcagccggacatgaagaaggcgatcgccgccgccggcgacgggcagctgctcgtgcccagcttccaaggttcccgcgtggacggcatggaccgcaaggcgtacatcgccgaccatgtcaccaccgcgcatctggttacggaaaccggagccggactgatggaaatgaacaccagctgccccaacgaaggtcacaatcgcctgctgtgccacgacccgcatctggtgggggaaatcacggaagccgtgaaaaacgaaatcggcgatcgcccgctcatcgtgaaactcgcctacattcccaacgacaccgacctggaaaccatggtcagggaaaccgtcggacatggcaccgtgcaaggcttctccaccatcaacacgatttccgcgcgcctagtggacgcgaacggcaaccaggcgctgccgggagccggacgtgaccgttccggcgtgtgcggcaacgccatccgcggcgccggtctcgacatggtcggcaggctcgccgccatccgtgaaaaactcggcttcgacttcgccatcgtgggcgtgggcggcgtgatccgtcctgacgactacaaggcgtaccgtgaggctggcgcgaacgccgtgatgagcgccaccggagccatgtgggacgcgaatctcgcgcgcgaaattaaggagacactgcgctgaattccgtttttcgcgaacatgctacatgccttatggcaaactaagcagcagtgttttttgagcttgatccaaaagggaatcgaaagaggttgagcgtgtctgacaataagaacgacattctgcacgtcgaaggcggcaagccgctgaacggcaccatcaaggtgcgcggcgcgaagaacttcgtaagcaaggccatggtcgccgcattgctggccccgggcacatccgtgctgaagaacgttccggaaatccgcgacgtgcacgtggtgtccgacctgctgcgcctgcacggcgtggacgtgaccgtggacggcgcgaacggcgtggtgacgatcgacgccaccaacgtgcaactcgccgacgtggccgacgtggacacgctgtccggctcgtcccgcattccgattctgttctccggcccgctgctgcaccgtctgggcgaagcgttcattccggcgctcggcggctgcaacatcggcggtcgtccgattgacttccatctggaaaccctgcgcaagctcggcgcgaacgtcgacaaggaacacaaggacggcattcacatcaccgctccgaacggtctgcatggcgcgaagatccacctgccgtacccgtccgtgggcgccaccgagcagacactgctcgccgccgtgctcgccgaaggcaagaccgagctttccggcgccgccatcgaacctgagatcatggatctggtgagcgtgctgcagaagatgggcgccatcatctccgtggacgtggaccgcacgttccgcatcgaaggtgtcaaggagctcaagggctacacgcacacgtctctgaccgaccgcatcgaggccgcctcctgggcgtccgccgcgctcgccacccatggcgacatcttcgtcaagggcgccacccagccggaaatgatgaccttcctgaacgtgttccgcaagatcggcggcgaattcgacatcaccgacaagggcatccgattctggcatccgggcggagatctgaagccggtggccatcgaaaccgacgtgcacccgggcttcatgaccgactggcagcagccgctcgtggtggcgctgacccaggccaacggcctttccatcgtgcatgagaccgtgtatgagaaccgtttcggcttcaccaagccgctggtgcagatgggcgccacgattcagctgtaccgcgaatgcctcggctccctgccgtgccgcttccaacagcgcaactacaagcattccgcggtcatcttcggaccgaccccgctgaccggccgtgacatcgacgtgccggatctgcgcggcggcttcagccacctgatcgcggcgctcgccgccaaggggccgtccaacgtgcagggcatctccctgattgaccgtggctacgccgacttccgtggcaagttggaggctctcggcgcagatttcgactgattcgctgcgattggttcgatgaatcggctgcggctgatttattgcgattggccaatcgtgattgatgattcgcaattgaacagttgcgattgacagtcgcgtcgaacgcccatgttgctttcaccggtactcgccttacgcgggtgccggttttgttttatccgcgattgccgctgccgcaatcgcaaacctgctttccataccttccacatcttccgcatattccttttactgccttatcgcccgtcttttctgcatcatttgacggccaaatgatgcagaaaacgatggcatgaggcagtaaaaagcaagataacgcggaaaacatcgatgacgaacgtatcggcggccggtggcacaatggaagccatggcatccaaaggaaaaccgtcgccgcgctccgcagtgaagccgctgagcgacgagcaagtcgcaaaactcgcgcagaagcatcatcttgtagacccgacccacgatttcccgaccggtccgcgcaaagccaacaccacggaaatcgaagcgcagaaccccaaagccacgcatcgcctgctgaccggctgcgacgtggtgctgcgcaatcacagcaaagtgaaggcctggggcttggaacacgtgccggaaaccggcccgttcatcaccgccgccacgcatgtgaccatgtacgacgtgttcgtgccgatggtctcgatgttccatcagggccgccgcccgcgctacatggccaaggcggaaatggccaaatggccgctgatcggcaaatggttccagctggtcggcatgcagccggtgcagcgccgcgcgggcaaggccaaagccatcgaggaaacgtccgtggaaatcctcacttccggccgcccgctgaccgtatggccggaaggcaccgtgacgcgcgatccgcagaaatggccgatgagcatgaaaaacggcgtgggcgtgatcgccctcgaatcctcacgccgactcggctaccaggtgccgctgtactgtgccgtgacctggggcgcggccagcatcaaccactggtggccgtggccgcgcaagaacgtggtgatgtgctacgacgaagcgctcgactacgcggacctgcttgacggctgcgattcctggggagacgaagtgccgacggaccgcgccgacgaactcacccgacgcatccgcgtgcgcatgaccgaaatcatggccgaaatccgcggcgaacaggcacctgacggctactgggactaccgcaccatgagtcgcgtgaaagactgattttcccccacacacccgttccggcggcgaacaaaatacgcgtgcgaccggaacacgcggccggtgtgcgtagccggcggtagcataagacaacgtcgattgaaagcggcggccgatgtggcatacgctcggccgcaaaaagcaatccaaataatccaaggagcaaaattcatggcgaatgtgacggtactgggcgctggcgcttggggaacggccttcggtcaagtgcttgccgacgcgggcaacaacgtgaccatgtgggccatcgaaccggaaatcgtggaaggtattcgtgaccatcaccacaacggtgtgcgcctgcccagcgtggaaacgctgcccagcaacatgaccgccaccggagaccgcgccgaagccgtggccaacgccgacatcgtcatcgtggccatcgccgcgcagttcgcacgcgtggcactgaccgaattcaagggactcatccccgagaccgcgctcgtggcctccctgatgaaaggcatcgaacgcaccaccggcaaacgcatggacgaagtcgtcatggaaacgctcgaccttccggcggaacgcttcgccgccatttccggaccgaacctgagcaagcagatcgccgaccgtgagccggccgcgaccgtggtcggatgcgcgaacatcgacaacgcgcgcaccatcgccaccgcctgcaccaccgactacttccgtgcgttcgtgacgcgcgacgtgatcggcttggaaatgtgcggatcgctgaagaatgtggtggcgctcgccgtgggcatggcccgtggcgcaggctacggcgagaacaccgcggccatgatcgaaacccgtggccttgccgaactgaccgcgctgggcgaggcggccggagccgatccgaagaccttcgccggacttgccggcgtgggcgacctcatcgccacctgcggttccccgctgagccgcaactacacgttcggttccaacctcggcaagggcctgagcgtggaagaggccaccaaggtgagcaacggcgtggccgaaggcgtgccgaccaccgacgcggtggtggcgttgggcaagcagtacggtgtgccgaccccgctcgccacggccatgagccacgtgctggacgacggcatctcctgcgcgcagatgctgtccgaactgttcggcgaaggcatcaccgaggagtagcagccggcttgtatgctggatgcttggcaaaaatcctgaaaagtcataaaagttaaggaataaaggctatagatatggcaaaaaagcgcattgtggtgatgtacggcggcaaggccgacgagcattcgatctcctgcatctccgctgcgagtgcgctgcgcgcgctggacacggacaagttcgaagccattccggtgggcatcaccaaggacggcaagtggatcgtcaacggtgagaatccgctcggatggagcctggacgaaggcctgccgaccgtggagaaaaccccaggcgccaaggacgtggtgcttgaagtggctctcggacaggacggcttcttcgcccgcgaggatgacggtacgatgaccccgttcggccatgtggacgcggtgttccccgtgctgcacgggccgtacggcgaggacggtaccatccagggtctgttcgaaatgatgggcgtgccgtacgtggggtgcggcgtgctcgcctccgcggcctgcatggacaagcattacacgaaggtgctgctcgcggccgccggcattcccgtcgcgcccggcatcacgctcgacgcgcgttccttcgacaaggcttccgaattcaagaccgacgccgatgcgatcatggcgcaggttagcgaagccggcttgcagtatccgctgttcgtcaagccgtcccgcgccggttccagcttcggcgtgaccaaggtggagcatgagggcgatgcggccgaacttgcggccgccgtgtacgaggcgtcccgccacgattggcgcatcctcgtggaacagggcatcgacgcgcgcgaaatcgaatgcgcagtattgtgtccgaaggctggcgaagcgccgcaggccagctggccgggcgaaatcgtgctcgacaagcgcgccgaaggcgacgaccagttctacgacttcgacagcaagtacatggacgccgccgcaagccacgtggaagtgcccgccaacctgccggaagagacgctgaacctcgtgcgcgaaaccgccaagaaggcgttcgtcgccgtggacggtgccggtctgagtcgcgtggacaccttcgtgaccaaggacggcaaggtgatggtcaacgaaatcaacaccatgccgggattcacgtccatctccatgtaccccaaggcatgggaggccaccggcgtgcgctacaccgacctgatcaccaagctgatcgaaggcgtgctgcgctgaatcctgaatctcatccgagctgagccgaagccgtgctgcatttcgagctgaaaagcgcaaagaaagcaacacgaaaaaggccagttcatcgtaagtttgccgaagcgaaacgggaatattcctaaaaatcgcttcggctttacttattctttgacactgcgttaggtaacgccattacgtttccatgttgtcgattccaagaacaacaaaacaacaaaggaaacgaaaacgatgaacgctttgcgcaagatcgccgtcggctcgctcgccgccgtgctcgcatgctccatggccgcctgcggatcaggtaacgccaattccaccgatagcgcctccaacaccggtaaaaccgtgaaagtggacgaaaagtccgcaaaggccacttcgatctccgatttcggcggcatggacggcctcgtggccgctgccgaaaaggaaggcgcgctcaacgtgatcgcgcttccgcacgactggtccaactacggtgacgtgatcagcggcttcaagaagaagtatccgaagatcaagatcaacgagcagaacccgaacgcctcctccaaggaggaagtggacgccggcaagaccaacaagggcaccgacgccgctccggacgtgtacgacctcggcctggccgtggcctccaccagcaccgacaacttcgcctcgtacaaggtgcaggcctgggacaagatcccggattccgtcaaggataaggacggcaagtactacgccgactacaccggcatcatgtccatcggctggaacgccgacaagtacggcgacatcaagtccatcaacgacctgaccgacccgaagttcgccggaaccgtggcgctcaacggcaagccggccgaagccggcgccgcgttcaacggctacctgatgatcaaccagctggccggcggcgacatcaagaacctgcagccgggcctcgacttcttcaagaagctcaaggactgcggcaacctcaccaccgtcgacgtgaccgacggcaccatcgactccggccagaccggcgtggtgatggactggacctacaaccaggcctcctaccagaagagcctcaaggccaagggcgtgaactggaagttcaagaccttcaagaacgcccaggtggtcagctactacaaccaggccatcaacgtggacgccccgcacccggccgcagcccgcctgtgggaggaatacctgtacagcgccgacgcccagaacgactggttcaagggcggcgcgaacccggtactgctcgactccatgaagaaggacggcaccgtcgaccagaccaccctcaagaacgccatcaccatcgacggcgatccggtgagctacaccaacgaggattccacccgcatcaccacatggctccaggacaactgggacaagaccatcggcaactgacatgaccgcagtgcttacctcaggagctcacgccaagcgcgcgggctcctccgccatctcgtttgccgcgcataggcgtgaactcggcaccatcgccgtgtccatcccgttcttcgcctacaccgcgtgcttcctgctcgccccgacggtcatcgtcatcgtgggcgccttccaatccgccgacggcagcttcaccgtggcgaacttcaacaaacttttcgaagcgaacaccatcgccgcattcggcacatcgatactcgtatcggtcgcatccgcggtcatcggcgccatcgtgggcgcgctcgccagctacgccctcgtcatcggctccaagccgaacggcctgctgcgccgcatgatttcggccatctcgtcggtactcgcccaattcggcggcgtgatgctggcgttcgcgttcatcgccaccatcggcatcaacggcgtgggcaccatgctcatcaaacagctgaccggctacgtggtgaatccgaactggctcagctcgctgccgggcctgatcaccatctactgctacttccagattccgctgatgatcatcatcttcctgcccgcggtcgattccatccgcccgcagtggcgcgaagccacggaaagcctcggcggcaacaccttccaatactggacgcgcgtggccggcccgattctggcgccgcgattcatctccgcgttcctgctgctgttcgcgtccgcgttctccgcatacgccacggccgccgcgctgttctcccagcgttcgatcctcgtgccgctgatgatccaaggcgcgatgcgcaacgaaatggacccgaaccagcaaggcttcgcgcaggtgctcgccttcgccatgatcgtcgtcgtggcggtggtcatgatgatcagccacgccgtggaaaagagggccggacgatggcagtgaacgcaaatacgcaaaccgtaagcgcgcaatcggaggaaaagcagaacatgcaggaatcgcaaaccatgccgccgcagctgcgtgcggccagactcggcaagcaacgcatcgtcaaaaccatcattctcacggtgacgctgctgttcctgttcgtgccgctggtgtccatgttcctgttcaccatccgacacccgttgtccggaaaatggagcttcgacccgtggatcgccatcttcaccggcgacggcagcgcgctcggcgccgacctgagcaccctgtggagcggcctcggcgcttcgctcgcgctgtgcgtggtgaccgtgctgatcatgctcgtgctgctcgtgcccaccatggtgatcgtgcacatccgctcgcgcagactggaacgcgccatcgaatgggtggccacgctgccgctgaccattccggccatcgtgctggtggttggcctgggaccgatctaccgctggctgtccgccgacgtgctgagcaccaacccgatctggctgtgcttcgcctacgtggtgctggtcatgccgtttgccttccgcgcgcttgcggtgggactcaattccatcgacgtgaagacgttatgcgaggcctcacggtccctcggcgcttcatggccgcgcgtattcttccgcgtactcattccgaacctgtggcagtcgatcctgtccgcatcgttcatctccatagccgtggtgctgggcgaatacaccgtcgcctcactgctcggccgtatgaacctacaggtcgcgctgtaccagctcggccaatccaattcgcaaatctccaccgcaatgtcgctgctggcactgctattcggcgtgattctgctggtggctctcgatctgatttccggcgcgatgcgtcggaacaaggaaggtgacaactcatgactctcgccgaacagaaggcggtggttgcccatacctcggaagcgttctccgataccgaacccaacgtggtgaccgaagcggcgaaggccgtgctcaaggattccgaagcgcgcggcggcggtgtgcagatgcttggtgtagacaagatctaccccggttcgaccgtcaaggcgttggacgatttcaacctggaaatcaatccgggcgaaatggtggtgctgctgggcggctccggctgcggcaaatccaccgcgctgcgctccctggccgggctggaagacattcaggccggacgcatcctcgtcggcggccaggacgtgaccggcgtgcccgtcaacaagcgtgacatggccatggtgttccaggcctactcgctgttcccgcacatgaccgcgttgcagaacgtggaattcggccttgaaatccgaggcgtggaccgtgcggaacgccgccgccaggccatggagaagctggaactggtcggacttgccgaccaggcgaaaaagtacacgcagcagatgtccggcggccagcagcagcgcgtggccctggcccgtgcgctggccgtgaacccgcgcgtgctgctgctcgacgagccgctgtccgcattggacgccaaagtgcgcgtgcagctgcgcgacgaaatccgccgcatccaactcgaagccggcaccaccaccgtgttcgtgacccacgaccaggaagaagcccttgccgtggccgaccgcatcggcgtgatgaaccacggccgcatcgagcagatcgccgacccgcagacgctgtaccgccgccccggcacggaatacgtggccaccttcatcggcctgaccaaccgtctgccgggaatcgccaacggtgaggaggccgtggtgttcggccagcgcgtcccgctgctggacggttccgccaccgacgcctccacggtgctggtacgccccgagaacatgacgatcgaactgaccgacgatgccgatgccgtccacggagccggcgaacttggccgcgtggagatggtgcatttcctcggcgcgctggcccgcgtggacgtgcgcgtagcctgcgcaggcatgggtggcacgattcgcgtcaccgtgcagctgccggccaacgagctgcccgcaggacttgcgatcggagcgcaggtcgtggtcgcgcctcggccgattccggcgctcgccgtctgacgattggttgctgcgcgcgatcgttgcgtaccgtcattgcgtgcgatcgccgtgcgtgattattgcgtacggtcgcccatcgcgtgagccgagccattcgcagggctgagattccaagctgatattcagagaactggtagtacagtgctggatatcagcttttttatttgcttgccgtaagttcgtaaggtgaccatgacgtttccgcaacaaccgcaacagccgcagtacccccagtatccgcagggaccggcaccgcaatatccgcaatcgcaattcccgcagcagctccagcagccgaatcgcaatccgttcttcgaatggcttcagcgggcgaaacgcgacttttcgcgcatcggcgcaagcctgtgcctgatggtgatcatctggtacgcgggcgtcttcctgctcaaaggcgtggtgcgcgcggtcgcgggcggtgtaggcgccggcggcgatatgccgaattggatgacgttcctcatttccgacgtgccgctgtatctgatcgccatgccggtcgcggtggtgctcatgggcaaatcgaccgtcatcgaaacccgcaaattcaacatgaaaccgggcatgttcttcaagctgctgctcatgtgcctgccgatgatgtgggtcggcagcatggtcggcagtatgctgtcgctggcgctttccgacggtgaagccacgaaccgcgtagccgatcttgccatgcagacgaacatctggaatgtcgtgttcttggtgattcttggcccgattttcgaagaatggatgttccgcaagcagctcatcgaccacactcgcaaatacggagagaaaacggcgattctgctgtccggccttgcgttcggactgttccacatgaacctgttccagttcttctatgcgttcctgctgggagtcatgttcggctacatctacatgcgcaccagcaaactgcgctattcgacggccatgcacatgatcatcaacttcaacggcggcgtgctcgcgccgtggattctgacgcgcgtcgacctggaccagctggacaaggtgtctcaggccgcggaaaacggcaatgtggcggcgatggaacagtgggcgtcgcagaacgccaccgggctggcgatcatgctcgtctatttcctgctgtacggtgccgtgattctcgccggattcgtgctgctgatccgtaacttcaggaaagccgaattctacatcgcgccggaggagctgccgcgtgggaccggcgccagaaccgtgtacggcaacgtcggcatgatcacgttcatcgtgctcacggtgctgctgacggcgatcagtctgttcctatagccgcagtcgcgcggattatgaaggccggccggggatacgttcccggtcggcctttctgttgcctgcatagcttgtgttgcgtgcgttgcgttgcgcacgccgctgccgctattcgccgctgccgaccgcgcggtgctcaagataatcggcatgcgcgatcgactgcgccaccgcatccgccatcgtggacagcagcaggtcgtttttcgcgaacgcgtagatcgtgccgtcgatgccgtacggggtgaagccgttgagcttcaccaccggcttgtattgcgggttggcaagccccacggtcgcatgttccacggtgctgacgatgtcggccttcatacgctccacatccacgcccgccttcgcggtgaacggcaccgacaccaggcactcgttcgacgggtcaagcttctccagcgaggcggtgttcagaatggaattcggaatgaccatctcgttgccgttgcgctcgcgcacgatggtctgacgccaattgatgtccttgacggtgccggtgatgccggccaccttgacgtaatcgcccggctggatgacgcggccaagcataagcccgaagccgccgatcacattggcgatcgtatccttcaaacccagcgaaaccgcaagaccgccgatgccaagcgccgtgaacagggtggtcggattgatgccgaacaccggttgcagcagcgtgccgatggcgaacacccacaccaccacgcgcaggatgttgacgaagatggatgcgttcggcacctgcgatttgtcgagcatgcggcgcaccaccttggtgagcgccttgtcgataagcgcggcgacgatgagcacgacggcgagcaggatgagcttgctgtagtttttggcaagccagtgcatgagaatttcaactggatccatggctgcctagtctacacaggggacgttgcacaacgcttgcgattgactggatgattcctgatccgccggctggccgcagcggagcataatggattccgtaggatgcgttggccagcgaaaaggggtgcgacatgggcaatgtcgtggattatgtgcggcgcgagtttcatggattcgcggagctgccgttcggcgatgttgattcgctggtgctggctgagctctcatatatgcggctttccggcttggttccggcgttcggcgaggcgaggtcggtggcgacggtgccgattcgagagctgctgcgtgcggaaagctatgacgacatgttcgtttcgaattcctccgatatgaacgagtatcggctcgcgttgctgcgtgccgtctgcgaatcgccgcgtttccgcgcgttgcgtgtcggcgagtacgcggagcgtctgagcgagcgcgaacagcagcagttcgccgcgatgacgttcgacgtgggttgcggacccgtcgattcgctgtatgtagccttccgtggcaccgatggcacgcttgtcggatggaaggaggatttcaatatggcagtgcgctgtccggtaccgtcacaggaatccgcgtatcggtatgtgaactcgattctggacaggtcggaaggtttcctttcgtcgggcgattcgcccgcggtcatgctcggcgggcattcgaaaggcggcaatatggccgtgtatgcggccatgcgtatcgcgcacgatgacatcgaagtggctggcgagcgcgcgcggcggctcggattgctgccctcattgggtgggccagtgcggggtcgcaacagacggatctcccgcatcttttcccatgacgggccgggccttccgaaatcgacggtgcgcggtcaggcgtaccgtgcaatcgaatcgcgtatccgcaaaaccgtgcccgaatcgtccgtcgtgggcatgctgctgcaatcgaatgcgccagtgcgcatcgtcaaagcggatgccatcggcatcatgcagcatatgggaaacagctggcaagtggcggaaaatggcgatttcgaacaggtggacgagctgacggccggcgcgcagctcatcaaacgaaccctcgacgggtggcttgacaccgtaagccaggagcagcgcgagcgcgccattgaccagatctacgggatcttcgcggcggcgggatacggcaatatcgccgatttggtggagcattggacggattcgctgccgaagattgtggaggcggcgcgcaataccgatcgggagacgcgcggactcatcagggcggtgatcaaggcgattccggtcagcgcggcgaaggcggtgcgcgagggctgaagcgggttgagtgccgaggcgggctgaagcgcgtgccgaggcggggctatgggcggatgcagcggctggtcgggatggttgccgagccgcatttcggccgattcatgtgtcacgatcctcgaaaaggcgtgaaaaatggaattgtgacacataagtgccgcgcaagtgacacacgagtgccgcacaaatgacacataagaagggcaatggagggcattggggcgccgatgatccggatgcatccccgttcgctgacgtaggatggtgcggtgcggacgcataattgtggaagcataatggaatgcggaatgtcgacggctgcgaaaggggtgtgcaatgggcaacatcatcgattacgcgcgtacggagacgcgcgatttcggcgagcttcccttccgtgaggccgacgcgctcgtgctcgcgcagctttcgtacgacgacgtgccggaatgcgtgccgcggcttgacgacatcgaatcgcgatacggcacgttgcatgaccgtgtgaagcaattcgacccgcgccatcccatacgctccgtgcggatgctgcggaaacctccattcgacggtgtgacgatcgcgcgcgccgacgacgagctgcaccatggaagcgcggtgcccgaccataatgtcgagaacgtgggcttggttgatccgcaggtgacgcacgatttctaccatgccatcgccgcgaatccgcgtttttccgacattgaaatgggggcgtttctcgagcagttcgacggcgatgagcagacgcagttcgccgccgtgacctatcgcctgccgtccggcatgctggttgtggcgttccgcggtaccgacgattcgctcgtgggttggaaggaggacttcaacatggccttccaatacccggtgccggcgcaggtgaccgccgccgactatctcgccagggtggccgagttgtggaaggatgttccgatcgtgctcaccggccattccaaaggcggcaatctggccgtttatgcggcgatgaacgctgaggacggggtgaaggaccgcatcgaacgcatctattcgttggatgggccgggcttccctgaggcggtggtgaatagcttcgaatatgcgagcgtgagcgatcgaatcgtcaaaatcgtgccggactcatcggtagtgggcatggtgctggaaactcccgaacgctgcatcgtggtgaaatccgacgtggaaggaataatgcagcatttcgtgttctcctggcagatgcacggcggtgaattcgacaaagtcgaggatgtggccagcagttcggtgaccttcaacaaagcgctgaacaagtggcttgccaacctgtccaaggagcagcgcgagcgtgcggtggacgcgttgtttgccgtgctcgaagcgtccggtgcgggcagtatttccgccatgatggcggccgggccgaaagtcattcccgaaatgcttggcacgtacgttgggttgagcggtgaggatcgacgcaatctcaaccaggcgctggcgattatgttgcaggccgctcttgcccgcaatccgaaagtgcggcgcaagtagacgtagcgcggaggtcgtgacgcagtggtgtgaggtgaggcgttgcggtggatggcaatcgctattaatgcgacatgctgtgcagtttgttctagacaacttgtatagtaattcgcgttgcgcttttaaatcgaaggtacaaaatagggggagccatgccacgtccacgccgagattcggagattctgccagccaaagaacggctcgaaaacgcattctgggaactgctttccgaacgcgagtatcgcaaaatcaccgtcaccgacatcgtgcgcacggcggacgtgaatcgcaattccttctactatcatttcacgggactgccggaacttgccgattccgccattctgcacgccgtggaaaacacgccgcttcccagcgcgcccaacgcgaatttcaatcccgacaacgaatggcgcaagcatgtcaccgcgctgctacgcgagcccgagcagcgtcagcgtcttgaccggctcgcgctgcttgccgggccgcacagctcgccggaactcgttgaatccctgcaggacttcggcaggctcacgttgatctccgtgctggggcttgacgccgaccatcttgacctcaaaactgacctgatgctcgacttcaccgtcggaggcatgttggcggtgctgcgccgctggccgaagctccatgagcagctgccgatggacgccgtgttcaacgaggatgtggcggtgctggccacgggcatattcatgtccatgtccaaaaccgacatgctgggttattggaagcgcatcttcagcagcggtttcgtggcggggcagggcgtgcagagcgaagccgaacagaaagccgaacagtgaacgatgcgccgcatgtcgtgacttttcggtggtagaaacgtctgtagcggcgctctttcagggtgcgtcagacgtatgcaacagcacgacagggaggttgttccatgatcaacgaagcctacaaggccatgctcggcggaaaatccgtaatccgcgagctgagcgaatacgcgaccgcgcgtggcgccgaaattggctacgagaacgtgttcgactattcgctgggcaacccgagcgtgccgtgcccgcaggactataccgacgccgtgatcgacatgtataaaacggccgaaccggtggcgttgcacggctattctccgtccttgggcatttcgtcggtgcgcaaggcgatcgccgaaagcctcaaccgccgcttcgacatggactacaccgccgactacatcttcccgaccacgggtgcggccggcgcgttgacgcatgcgctgcgcgtggtgaccaagccgggcgacgaagtgatcaccttcgccccgtacttcccggaataccagccgtatgtgaacggcaccggcgcgcacctgaccgtcgttccggccgacaccgagaacttccagatcaacttcgacgcgttcgagaaggcgctcaaccccggaaccgcggccgtgctcatcaacaccccgaacaatccgtccggcgcggtctattccgctgaaacgctgacccgcctggccgaggtgctcaacgccaagcagactgaatacggccacgacatcttcctgatcgccgacgagccgtaccgcgagatcgtgttcgacggcggcgagcagccgtatccgagcaaattctacgacaacacgctttcgtgctactcgtactccaagtcgctgtcactgccgggcgagcgcatcggctatgtggcggtgaatccgcgtgccaccgacgccaagctcatcgtgccgatgtgcggccagatcagccgtggcaccggccacaactgcccgtcctccaccgcgcagctggccgtggccaaggtggttgacgagacaagcgacctgtccgtctacgaaaccaacatgaacctgctgtatgacgcgctgacccgtctgggcttcgacgtggtgcgccccggcggcacgttctacatcttcccgaaggcgcttgaggaggatgcgaacgcgttctgcatgaaggccaaggattacgacctgattctcgtgccgtccgacagcttcggcgtgcccggctacttccgcatggcctactgcatcgacacggagaaggtggagcgttccatcgcggcgcttgagaaattcgtgcacgaggtgtacggccgctgagccgctcgcgtatttcgcctatattccgcttatagatggcggattcgctctcgtgcctgatgccatctcgcttatggatggcggatgatgcggggaaaagccggttggagggtatggatattgccccctaacctttttgctgtaggaccccgccatctataagcgagatagtgcaggattgtggggcggcaagccgactgtctgacgggaccgtgtgcgttgatacaggttcgcccggagctggtggggtccagctccgggcgaagtctgttatggggaaggaaggaatctgaatcggttaatgcgtgaatccgtcagtgggtggcgatctcgtcgatcttggtgacgtggccgccgaactgggcgcgcatggtggacacgacgcgcaggatgttgtcggcgccgccgcgcgaggtctgacgtgcgtacagtgcggccgcggtggccggggtcggcacgccgagttcgagagccgcctcgatcatccacttcgcctcgccggactcgttggcgaccggcggcatggacttgagcgtcgggtcggacttgaaggcgatggccagcaggtcgagcagccaggactgcaccacggaaccgtccctccaggagctcatcacggccgccggatcctcaacgagatcggacttcaccatggtggcgaagccttcgccgaaggcctgcatcatgccgtattcgatgccgttgtgcaccatcttggcgaagtggccgccgcccaccgggccggccagcaccaagccggaatcgccttccggcttaagtgcctcgaaaatcgggcgcgcgctctcgaagtccccctggctgccgccaaccataagcgcgtagccgcggtcgatgccccacacgccgccggagacgccgcaatccatgaaatggatgcccttcggctccagttcggccgcgtggcgtgcgtcgtcggtgtaacgggagttgccgccgtcgatgatcatatcgcccggctgaagaagctcggcaagctcgttgatggtgctgtcggtcgcttcaccggccggcaccatgacccacaccagacgcggggccttcagcgcggccaccagttccttcaggcttgccacggtgcggtccgactcgggggagtggtcgtagccgaccacctcatgccctgccgccgcgatgcgcttcgccatgttgccgcccatacgtcccaggccgatcattcccaactgcatgatgtgcttctttctctaaaaatggttgaaaagtttttgcgattttgaataaggattgatgccgcccgttggcttcccgcgccttccgcaacgcagaaaagaaggttgcggcaagctttgcgggcggcaagttttggttatgttttgggttatgtgagtgtggttgcgattgctgcgttcagtgcgtcaaagcaccagcgagagcagcatcacgcagcccagaccgaccaccgacagaatggtttccatcagcgaccaggtcttcagcgtctggcccacgctcatgccgaagtattccttgaccagccagaagccggcgtcgttgaggtgggagaagaacacggagcctgcgccgatggccagcaccagcagtgccagatgggtcgggctcatgccggcggcgagcggcaccatgatgccggaggcggtgacggtcgccacggttgccgaaccggtggcgagacggatgagcacggccaccagccagcctgcgatcagcgggttcatggcggattcggtgatggagttggcgatcacgtcgccgatgccggagtcgaccagcgtctgcttgaagccgccgcctgcggcgacgatcaggatgatgccggccacggagccgaaggactgtccgaccatgccgttgacggcgtcacgggagaacttctgcatgtagccaagggcgaccatggcgaagacggtggtgatgagcagtgccacgagcggggtgccgaggaacgcgatcacacggccccaggcggtggtgttctgaccggtcagatccacgatggacgcggcgagcatcagcacgaccggcagcaggatcacggacagggcggtgccgaaggacgggcggttttccgcggacttcggagcttcggcctcagcctcgttctccggagctgcgatcggaacccacttggcggcgagcctgccgaacagcgggccggagatgatgacggtcgggatggccacgatcaggccgagggccagggtgatgccgaggttcgcgttcagcgcgccgatggcggtcagcggaccggggtgcggcggcacgaaggcgtgcagcgtggacaggccggcgagggccgggatgccgagcagcaccacaggggacttggaacgacgggcggcgaacagcaccaccgggatgaggatgaccacgccgacctcgaagaacatcgggatgcccacgatgaacgcgatcagtgccatggcccacggcagacgctgcaacggtgtcttggccatgatggtgtcgacgatggtgtccgcaccgcccgacttgaacaggatggtgccgatgatcgagccgaacgcgataagcaggcccacgttggaaatcgtgccgccgacgccggaagtgaagctatcgaacgccttgtcgaacggcacgcccgcgcacacggccatgacgaatgagccggcgagcagggacaggaacggatgcaccttgcatgccgcgatgagaagaacgatgacggcgatgccgatgatcgccgctgcgatgagattcatgaatcctccttgactcgttgaatttctctttcgatttttagttatgtgcgattattttgcgctgtgttgcggcttgcgccgttcactcggcttgctgcgattgcgaggccaccttcgccgcgtactcgttcactgcggcgacggcacgttcgaccatttcctcgacgctgccttcgatggagacttccacgccgttctcgtctggctggagcggctcaagaatggcgaactggctcggcagcagtgccggcggcatgaagtggcccttgcgctcgttgagacgctgctggatgagttcctgcgagccggtcagatgcacgaagaaggtgggaacgttctgggcgagcacctcacggtagctgcgcttcagggcggagctggagaccacggtgttctcgtccagcgcctcgcgagccaccatccaggtgttgatgaccttgagccacggccaacggtcctcgtctgtcagcggaatgcctgcgctcatcttgtcgatgttggcctgcggatggaagtcgtcgccctccgcgtacacgtatccgagacgttcgtgaatggcttctgccacggtggatttgccgcatcctgcaacacccatcaccactacgtgaatgctcatgttgtcctccttgaactctgctgtattgccagtgccacttcgcatcggcgatgacatcaatatagctatgaaaggtagtactagtcaagttaaaagtactacgaataaaaataatcatgcgacttgctatgctgtaggtagtacaaatcggcggcaaatcgcgcgaatcgtgcgggggtaattattcggacgtcacgcgaacggcaatcgtatacggcgtgtcgcaaaaacctgaaaaaagatttgcacgcacaacgagaggaattgtggatggcaggaaacgaaaacggcggcgaactgctgcaggatgcagtgtgccgcacgctggccatcgaaatgctggacggcaaatggccggccggtgaaagcttgacgttggaagacgtgcagaaccgtttcggcatctcccgtaccgtggcgcgcgaagtcgccaaaacgttggaatccatgggtgcggtgacggtgcgccgacgcgtcggattggtggcgcggccgttctccgactggcaggcgctcaaccatcaggtcatcgaatggcgactccactccacgcagcgcgagcggcagctgtcgtcattgaccgaattgcgattggcggtcgaaccggctgcggcggcctcggcggcacgcctcgcctccatcgacgtcaaggcgaaattccccgtctacgcggcgcagatgcgccaaatcgccgaatcaaacgaagagggggctgccggcctgaccaaattccacgatctggacgtggaattccatactttgatactgcgcgaaagcggcaacgaactgttcgccgcgcttgccgacaccatcgccaccgtgctgcgcggccgtgtggaactcggcaaatacccgatgaagccgaagccggccgcgctcgacgcgcacgatgcggtcgctgacgcgatagcgaagggcgatccggaacgtgcgcgcaaggccatgttcgacatcgtcgacgaagtggcccgcgcgctcaacttcttctaaaaccaatcgctaccggcgtcgaaccgccggattcgcggtcaaatcacaggttcgcgtcgaccgtctgacgcaggtcgtcaacgatttcgcccaaagtctcgctgaacaccgcctgatcggcgtacatcgaatcgaacagcgtatcgatgtttttgcggaaatccttcggcagaatggcgcagtcgcgttcggcgagcttgtcgagacgcttctcgccgggatgcgtgcggcggttcagcgcgaatagcacatcgaaatacgattccatgaacgcggccatgcgatggttgaccgcgattttgtcgcctcggctcgcggccttgcggatctgtgcgtcgtacgacggcaggttgccggtaagtagacgcatgttgcgattgatgatgttgcggcgcagttcctcggggaacggcacgtcgaaccgctgtcgggtcgcggcgtactggccgtcgcggtcgaacagcaccttgctggtgagcatgttgtgccacatgcacgtcgtatagccgttgctggcctgaaaccgttccaccacgtcggcgacattggctgcgaactggtccagatcgcggtacagcacgtcgatattggtgccgtcgttcagcgtgcagtcgtcttcggtctcccaaaaatcgttgtcgatttccatatggctgcaatagttgcgcagcagcctgcggcggcgttcggcagacacgggtgcggtgacgtacacgtagacgtcgtaatcggatttttcatcgttatcgccggtggcgcgtgacccacccaacgtgatggcctcgacttccggccatgcggacactgcttcgactagttcatttgccaatgacatcgtttacctctctctgcgtcattgctggagcggcgctacgttgcgccacggtgtgcaaacgatgccagtataacataccagatggtaactgtcgaagttgtgccggcctacgcggtttcccgcaggccggcacagcgcattccgccgaacgacgattgtcaggcggaatgctatcgagcgattgctgtcgagcggaacgctgtcggacggcagctgtcagtcgacggttgcggcttccgtcgaacccttggtcggatccttctgcagaagcaggaagacgagcgcgacggccagcagaatggctatcgacaacacgccgatcgacgcgttgccagtcagcgacgtcgtggtagcgacgaggaacgtgccgataatcgacgccgtcttgccgaaaatatcgtagaagccgtagtactcgttggcatggtccttcggaatgatcttgccgtaatacgaacgggacagcgcctggatgccaccttggaacatgccgaccagaatcgccagaatccagaattcaagtgcggcgcgcaggaagaacgcggcgaagaagacgatgcacatgtacgccaccacggccgcggtgatcatggttttcgagccgaaccggcctgccagcttgccgtagatgatggagcaggggaacgccacgaactgcgtgacgagcagcgccacgaccagctgcgtggagtcgatgcccagctgcgtgccatacgacgtgctcatggaaatgacggtgttgacggcgtcgatgtagaagaagaacgcgatcatgaacatccacagcggcttgttcttgcggatggcgcggaacgtggagccgagctcggcgaacgtgccgcggatggcctcgcctgcctgccccgcggtggcgcggtaatgcacctgcttatagctggtgagcagcggaatggtgaacgccacccaccacagcgcggtgatgacgaacgaggcgcgcgtgcaggctgtggtcgaccagccgaacagcgcggggcctccgaaaatcagcgcgatgcagacgatgaacggcacggtcgaaccgatatagccccatgcgtagccgtgtgaggaaatgcggtccatccgttcgttcgaagtcgtgtccaccagcatggagtcgtagaacgtaagcgaaccattaaggccgatggtggacagcacgtacacgatgaggaacgcgagccaaccaagcggcatcgccatcgcgcagcacatgaccacgcccgtcaggaagaagccggtgaagaagcggatcttcatgccctgcacgtcggcgatggagccgagcagcggcataagcacggcgatgacgagcgatgcgatggtctgcgcgtagccccacgtcgacacgatgttcgtctcgccggccgccttgagcagcgaattcgcgtagatcggcacgacggcggtggacagcagcacgaacgcggaattgccgacgtcgtagacgatccacttcttctcgcgtggcgtcatcatatgcttggattgctggctggattgctgcggctgctgggcctgcgcgttctgctgggacggttgggtctgcggctcggctgtgtcggtcaatgttgactcttttcggctaaatgtcaatcttatggctcatcttattccattacttcatcgtacgggcgtggcgggtggtaacagaccattcgacatgaacagcgcatgaacaagcatgttctgcccgtacgggccgcatacgcgtgctgtcgagacatggcaaaaacggcggaatatggggaatgcaagccgattttcgtccacaagtttgcgattggccggggctggttgtatagttgagaagttgtgtgttctgccatgcacttcgttgtgtggtgtcgaacgcgcagacttgcaagtcaatagtaattatagggagtccattatggcagctcgttgcgcagtgtgcggcaagggaccgcagaccggtttcaccgtttcgcactcacatattcgcaataagcgcaccttccgcccgaacctgcagccggttcgcaccaccatcgacggcgagaacgttcgcgttcgcgtttgcgtgaagtgcatcaaggctggcaaggtccagcgcgttgaagcgtgaatcgcgaaataacagcttgaaaccccggtaagccgaatggccgccggggttttgctttatctgaccgtccacaagccgtgttgcggcgaatggcgccgccacgaataatggggaattcagcccgccgcacaatcatccggtcgtgacacaatggagtgttatgagcaccacatggcaaaccccgatttcctcgttcgaaacgaaccgccgcagagtcggcgcgctgaaatcgctgggcgtggtgtccgtgggcgacgcgctgacctactatccgttccgcgtcaccgagccggtgccggcacgcgccctgcgcgaagcgaaaataggggagaacatggccttcgccgcgcacgtgcgtggcgtgcgcgtctttccgatggcccgtcgcggattccggctgatcgccgacgttgatgacggcgatttcgcacgcagccggcacatggacgcttccatggcgtctctcgtgttcttctcctatcgcaagtcgtacgtcgattggatccagcgcaaactgcacgaaggcgcgttgctggtggtcgcgggcgagccaagcgtatacaacgaccgtctgcaattcacccatcccgacatactgacggtcgatccagccggcgagcaattgcgcagccgctcatctgaggaagccgccgaatgggatgacggcttcggcacggaacaaccggcggtcgtcccgcaatcgtcgaccatgccgaatctcaaatacgatgcggcttccgtaccggaggcgatgcgccacgtatgccgcccacgtcccgtctaccacgcgaactcgcgcatctccagcgaacacatccacgagtcgatcgaaaaatgcatggaccggctgtgcggtgacgaatacgctgcggcacaggcagcccgtgcattgcatggcgccgatgccagcgacgcgcaacatggggaattcgacgcgccgcaagccgaccggcaggcacggacggaagcgcttgccgccgccattcccgacatcatgccggaagcgtttcgtatggaacatgggctgatgcaccgagccgaagcgttcagggcgattcacgatccgcaaaaccgcgacggtttcaacaaggcgttgcgtacactgcgctacgaggaagcgctcatctgccaaaccgcgctggtgcagtctcgtgattcgtcgcgtaaggccacggccacagcctgcgccgacacgcggctgaaagacgatttcgtcgagtcgctgccgttctcgctgacggacgggcaacagcaggtgatcgccgatatttccgacgatatggcacgtgattaccccatgcaacgcctgctgcagggcgaggtcggctccggcaaaaccgtggtcgcggtggcggctatgatgcaggccgtcggctccggcaaacaagcggtgctcgtcgcgccgacgcaagtgttggcggaacaacattacagcagcatccgcggcatggtggatcggatgtgtggtaccggcgaagaggctgacgaaaacgcgaaatcaggggaatcgcagacaaaatcaacgcaccgtgcggttgtggatgaaagtggacaagtcacgtcgggaaacgcgccggaaccgcaaaacggtggacaatcggatggcggccaggtggagaaactgctggacggccaatcgaacagcctgccggacattcccgtgctgctgctcaccggcggcatgaaactcgccgcccgccgacgcgtcctcgcgcaagcggcctccggcaaaccatgcatcgtggtggccacgcacgccgcgttctccaaaaccttccaagcgcccaacctcgcgctggcggtcatcgacgaacagcaccgtttcggcgtggaacagcgcgaatcgctgaacgccaaaggctccacggcaccgcatctgctggtcatgacggccacgccgattccgcgcaccgcggccatgacctggttcggcgacctcgacatctcctggctcaccgaactgcccggcggccgcaagccgatccgcacattcgtcgtgcccgaagcgaacggcccgctgatggcggaaatgttcggtctgattcgcaagcgtatcgacgcgggggaacgtgcctacgtggtctgcccgcgcatcgacgccgacgcgaaggatgccgacgatgcgggcggttcaggcgatgcggaagtcggttccgcattcgacgccacatacgatttgggcgaggatgacgaacagcgcgaacagcggccgccgttgcattccgtcgcggaaatcgcggaacgcttgcgatcgctgccgcaattcgctggcatccgtatcgccacgctgaccggccgcgacgatgacgaaacgaaatcgcagattatggccgatttcgaagcgggcgtgacgccgattctggtggccaccaccgtcatcgaagtgggcgtggacgtggcgcaggccagctgcatggtgattttcgatgccgaccggtatggcctgtcccagttgcaccagctgcgtggacgcgtgggccgtggaggcaccgaatcgggcgcgttccttatttcacgtgcgccggaaggcagcgatgcggccaaacgccttgacgtgattgccggcacgttggacggcgccgaaatcgcacaggccgaccttgaattccgcggcgcgggcgacgtgctgggcgacgcgcaatccggcggcaaatccggactgaaactgctgcgcgtggtcaaagacgtgaagatcatcgaggaagccagagcggaagccgcgaaactggtggccgaagaccccacgttgcaagggtacgtgcagcttgccggcgcggtgctcgacttcacgcgcggcaacgagacgttcctgaccagcaactaggctcgatggttatgcgcgtaatttcaggacgattcaaaggcatggcgttgaccacgccgaaaccgggcaccaggccaaccaccgaccgtaccaaggaagcgatattctcgcacctcgattcgtggggcgtgctggatgacgcacgcgtgctcgacctgttcgccggaaccggcgcgttgggcatcgaagcgctgagccgtggcgcgcgcgaactggtggcggtggaatcggccgcaccggccgccgcgctgatcgcaaagacgttgacggcgttgaagcacaaccgttcctgggagccgggcatgagcgcccgcgtggtcaaggcgcgtgcggaaaagtacgcggcggccgcatcggcgattgcaccattcggcgtgatcttcatcgacccgccgtacgcgttcgaaaccgaggcgtgcaaccggctgctggccgatttggcgggccgtgagtccggcgaactgactggcgagggcacggtgatcgtgctggaacgctccactcgttccgacgagccgaccgcgcccgaaggctgggatatcaccgaccggcgtgattacggcgaaaccgccgtgtattacatcgaacctgccgaaaccgccgagccggcagagccggttgaatccgcggactgacgtccgggctttccaactaaaaacgtcgacggtggacctgcatgccctccgtcgacgtgaacaatcgtgcgtaatcagcgctgccgtgggtgcgcgccggaaacctcccagcccaacgccatcagcgttttgcgatcggccttgtcaagcttggaacaatccaacgcctcgatgagatccggacgcagctcgttggtcttcgccagcgcctcatcgcggcggaaacggtcgaccttcgcgtggtcgccggacaacaggacgtccggaaccttgataccgcgccaatcggccggcttcgtatactggcggtgctccagcagggcgttctctcccgtatacgattcctccacgatcgaggccgcattgcccatgaaaccgggcagcagacgggtgatggcctccaacatgaccgacacggccacctcgccgccgttcagcacataatcgccgatcgaatattcacgcacgtcgacgccctgcgcacggtaatactgcggaatacgcgcgtcgtagccttcgtaacggccgcagccgaacagcagatggttggcgtggctcagctccgtcgcgtcctgctgggtgaacaggggggcggacggattcgggaaaatcagcaccggacggtcggtcgccggaacggtatcggcatttgcggcgatttctgtcgccgattccgccggttcggccgcgtccgcggaagccgtgtcgtctgcgtctgccgtggaatcgcaagtaaccatggaatcgcaagtaaccgtggtcggctcaagatgcagcagctcgtcgagacattcgctccacacttccggcttcatcaccatgcccgcgccgccgccgacgggagtatcatccacggaatggtgcacgtcgtgcgtccagtcgcgcaggttgtgcgcggtgacttcgaccaggcccttctcctgcgccttgccgagcaggctcaggttgagcacttcgaaatattccgggaatacggacacgatatcgatcttcataatgttccacaataccggtacgcctgccaagcgcggcgcgtacgaacaaggcgccggcataatcgccagcgccttgttgaaaaagcagcggatcagagccccggaatgagtccgcccggcgggtcgagggtcagatatccgccctcgaggtcgatgtccggcacgagctcgtccacgaacggcacgagcgcgctgttctcgaccaccacgccatcggcgtccttgacgggattggccagacggatcttgagcagccactgggccacttcaatcacatccaccaccttgcctaccacagtgccgggcgcaagccccagcgtattgccctcggcaaggcgcgcctcaagactgatcaggtccttcgggtaccactcgtctgcttcaagcatctcctccggatcgtccgcttcgccatatagcaccacgccattggcggcttcggacgcatcacggtcgtcgatgccttcgaatttgatgatccaacggttcttgaaggtgcgggagctttccaccacgtactcttcctcgccgtccttcgtatacaacacagcaccgggagcgaaccggtattccggttcgtccgtaaagatctgcacggtgacctcgcccttgagcccctgcgcacgcccgatacgacagaccctcagcagctcaagctgttgagggtcgtcggaatgcatatcacgcaccacgctaggatctcacctgcgcacgtccatgatgtcgacgcgcaccttgtggtcggacagtgcctgcaccacggtgcgaatcgcatttgccgtgcgtccgctgcgtccaatgacgcgaccgatatcctcagggttcacgcgcacgcgaatgagttcaccgcgcggattctcatgggacttcaccgagacatcatcgggaaaatcgacgatgttcttgatcagatgttccacagcctgggcgagcatgatcactcggcttccgcagccggctcttcagccggagcttcctcggtggcggcggcttcggcctcagccttggccttggcgtcagcttcggacttggcggccttcagcttctgggcctgggcttcgacagcctcgacgcgagcggcggcatccgggccagcctcaacggtcttcagggtgccttcagcaccgtcaagacccttgaacttctgccagtcaccggtgatcttcagcaggttcagcacctgctcggtcggctgagcgccaacgccgagccagtactgagcgcgctcagagttgatgttgatggtcgaaggctgggtgttcgggttgtaggtaccgatctcttcgatggcgcggccatcacgcttggtacgggaatccatgatcaccacgcggtagaacgcgtagaacttcttacccatgcgcttcagacgaatcttggttgccaaaatggctctccttgtaactaggggtgtgtgtttcgtgttctgtgtggggcacggaatccgaaacccacgtgttcctcacgtcacgcgattggtagagggcctcgcgcgcgcgaataactgagcaattataaccgtggggtatggacgcgttcccgtatgcgttcccgagcgtccgtttctgttgactcggacgctcggcttgcgttttgcgcattctgaatggccgtttctccagaatcggacattggtgaggtgttgtggcggtctcgggcgtccgaatcacccgaatcggacgaactcgctatgctggatatgttcattggcggttttcgtgcgcctgattatggccatttcaaggggatttgcatgagtgttgcgttgtggatcgtactgctggtatgcgtgttgtggatcgctctgagcgaaatgccggccggttgggacggccacttgccgttgccgtatctgattgcgctgacaccgctgttgtggattccaacattggcgattgcgattgccggtgccgtacggcatgacaccgccctcgccgtcgtcgcggcgatcgcgtgcatcgcctcgctgctacgcaaaatcgcgtattggaacaacaatctcacgtccatcaacacggcgcagatggtggccgacaacatcgcaaaaaagcgtgaaacatcccgtggaacacatacgtcgactgccgcggaagccgcgaaacacggccgtttccgcgtgatgacgctcaactgccggtacggtcgtgccaatgcggccgcaatcgtcagcgccgtcaaggaacacgacgtcgccgtgctcgcgctgcaggaattgacggacgatctggtcgcggccttggacgaggccggcctgtccgatttgctgccgtaccgccagttaggggagaacaaagatacggacaacggcggcttcaacggtatttggattcgcatcgagccaagcgacacgtcgccgatcaccgccgtgattcccgccgccgacgtgcctggcgtgtgcttcccgattgatgcgatgcgcggcatcactttcgtttccgcccatccgaaatcgccgatgcgcggctgccgcgactggtccgccggcatcatcggcttgggtgagctggccacatcgcagaagcagggcgatatcaccgtcgtattgggcgacctcaactccggtaccgaccatccgagcttccgcaagctgcttgacgccggcttccaggacgccgcgttgaccgaggcgaagggccgccgcgccacgttcccatcgtggctgccgtggccgcgtctcatcctcgaccacatcttgttcaccgccggtctgaccgcatccgacgtgcgctccttcacggtcaacggtaccgatcatcttgctctggctgccacgctgacgttgaaataaaccgaaaataagctggcataacgaaactgccgacgctggaaaacgttccaacgtcggcagtttcgttatatatgccgtattgcgattgccggttgtcgtaatcgccggcaatcgcacatatcgcggcttagtgcagcagacgcttagtgcagcagaccggacagaccgccacctaagttcggcggcagctcgccggaatcgcccagcatatcctgcaatccggcaggaagcgccggattctgcggcttcttggcgaacgcggagccacctgacgaagcgccgtcggaagccttgccggcgagcttgtcgcgcaatgccttctcctcggcttcacgcttcatcggattgccggacttgcccgacttcttcttgttcttcttgcctttgcccttgcctttgccgccgcccatcgcggggcctccgaagccgggcacgccggcgccgaccttgttgctcatgcggcgcatcatcttcgcggcctggtcgaagcgctgcagcagcgcgttgacctgcgaaaccgtcacgccggaaccgtaggcgatgcgggcgcggcgggaaccgtcgatgatcgagggatcgcgacgctcggccggagtcatcgaacggatgatggcctcggtgcggtcgatttccctctcgtcgaactgctcaagttccttacgatgcgcggccatgcccggaatcatgccaagcaggtttttcatcgggccgagtttgcgcacctgctgaagttggtcgaggaaatcgtcaaggccgaaggaaccgtcggagatcttgacggcggccttgcgggcctcttcctcgtcgaactgcttctgcgcctgctcgatcagggtgagaatatcgcccatgtcgaggatgcgggacgccatgcggtccggatggaagacctcgaaatccttcaatccttcgccggtggaggcgaacaggatcggcttgccggtcacggatgccacggacagcgcggcgccaccacgggcgtcgccatcgagcttggacagcaccacgccggtgaaatccacgccctcgtcgaacgccttggccgtctgcacggcgtcctggccgatcatcgcgtcgatgacgaacagaatctcgttcggctgcacggcatcgcggatgtcgcgagcctgcttcatcagctcctcatccacgccgagacggcctgcggtatcgatgatcaccgtgtcgtaaagcttctgcttggcgagctccacggcgtcacgggccaccttcaccgggtcgccggtggtctggccgggggagacgaccgcttcgccgccatcggactgcacgcccttctccggcgcgtacaccggcacgccggcgcgttcgccgaccacctgcagctgcgtcaccgcgttcggacgctgcagatcggccgccacgagcagcggggtgtggccggaatccttcagccagtagcccagcttgccggcgagcgtcgtcttaccggcgccctgaaggccggcgagcatgatgatcgtcggcggattctttgcgaagttcaacgggcggtccacaccggcgccaagcaccgcggtgagttcctcgttgacgatcttcaccacttgctgcgccgggttgagcgcttcggaaacctcggtgccgagcgcgcgttcgcggatgcggctggtgaaggaacgcaccacgtcgagcgccacatcggcgtcgagcagcgcgcggcggatctcgcggatggtaccgtcgatatcagcctcggaaagcttgcccttgctcttcagatgcttgaacgcattcgagagccggtctgtcaaagaactaaatgctgccataatgttcctcagtctagcgtttcacgcggatagcggatgaaatgggtgcgattgcctacttcagcgaccaagtggagccttgcggaccgtcctcgatggcgatgccggccgcgcccagcgcgtcacggatcgcgtcggcacgtgcgaaatccttggccttgcgcgcttcggcacgttccgcaagctgttcggaaaccagcttgtcgagcgcgtcatgctcggcggaatcggctccggcaccagccgcaccacctgcggcaccgtcggaaacccacggctccgccagcggatccaagcccaacgtgtcgagcatcgcacgcacgttcaccagcgcctcgcgaacctcggccttcgccacgtccgaatcggcgcggtcggccagcttcgacagcaacgtgttgccggaacggatcgccgtgaaaatcgcggcggaagcgcccgaaacgttgatgtcgtcgttcatcgcggcaacgaaatcggcgggaagcgcgtcggcggaaatcgccataatctcttctcgtgacggctgttcgccgacggcagcgcccgcgcgctcgatgaagttcgccacgcggtcgtacgcggactgcgcctcggcaagcgtctggtcggaccattccagcatggaacggtactgcacggaaccgagggcgtaacgcaccacccaagcggaatgctcggccagcaccgccggcacggacaggccgttgccgagcgacttcgacatcttctcgcccttcgcggtgacccaggcggaatgcatccagcgcgcggccgaatcgtaaccggcggcgcgcgtctgcgccatctcgttctcgtggtgcgggaatcgcagatcaagaccgccgccgtgaatgtcgaacatgtccttcagatagcggtggctcatcgcggagcattcgatatgccagcccggacggcccgtgccgaacggggtattccagcgcgcgtcgagcggatcggaatccttcggcgccttccacagcgcgaaatcgcgcggatcatgcttgtcgggggacatgtcggcagggtcgaccggattgtacttgtcgttgcccgcgttgtccacggacggtcccatcgcgtcggtcacttcggaagccgcgtcggaaaccgcggtctgcttctggtgcgtcagctcgccgtaatgcggccagctcgccacgtcgaagtagacgttgccggtcgggttgccgtccgcgtcacgcaccacataagcgtggccgttgtcgatgatcttcttgatgaggtcgatcatgtcgatcatgtggccggtggcgcgcggctcgtacgtcggcggctccacgccaagcttgctgtacgcctcggtgaactcgcgttcgtagatatacgcgcgctcccaccactgctggcccgcggcggcggccttgtcgaggatcttgtcgtcgatgtcggtgacattgcgcacgaacgtgaccttgtagcccagacgctcgaaccagcggcgcaccacgtcgaacgcgacggcggcgcggatgtggccgatatgcggtgagctttgcacggtggcgccacacgcgtagataccgacctgacctggtttgatcggcgtgaaggacgacacggcgtgcgatgcggtgtcgtacagcttcagccccgcggcggccttcgccaccgcaagagcgccggaagtgttggtattctgcggttcttgcgtgtttgtcatagtcacgagaatattgccagaatcggacatgacgcttggttttcccggcatatgcacggcatcgtattgcgaacgtatgcagacacagagccgaatcgcgagcgtcatttacgcagatgatgtaaaaatagtggcatgacgcaatcgcatgtgctgattcttcaacacgtcccgtgggagaaaccggggcgcattttggatagtctcgacgacttgggcatgtcgtatgaagtgatgaacatcgccaaagagaaaaagcccgatcttcccgatttcagtgacgtctccggcatcgtgattatgggcggccccatgggcgcgctcgacatcgacaagtatcccggtctcaaagcggaatccaaactcgtacgcgccgccgtcagcgtcggcaaaccgttgctgggcgtgtgcctcggacatcagatcattgccaccgcgctgggcgcgaaactcaagaagggcagcgagccggaaatcggattcgcgccgattaaacgcatcgacaagcacgactacttctccatgtggaacaagacgttggacgtgctgcactggcacaacgacgtggtgaccctgccggaaggcgcacagccgttggccaaaagcgcgaagacgaagaaccaggcgttccggttcggttcggcgcttggcctgcaattccacctggaggtcacccccacgttgttggacgagtggctggacgagccgtgcatggtgaaggatttgaaggccgccggcggttcgaaatcgcagctacgtgacgccttcgccgaatacaatccgcagctgcagccgatggccgatcaggttttctccggattcgcggcccggtgcaacacctatgccgcaacgctggagcgctgataagcgttctgcccgctacacgccccactgaatcgccagctgagtgccttccgtaggtggttcctgagttccgtaggtggttgggtgatggaccagtgtttcggaaaggctgaatttaaggcttttcttcgtgcggtatccgaagacaaccacctacggaagcggaaaaccacctacggaatcttctagggcgttttcgttgcctacattccaaggtctcctgtctacgtttcgcatcatgcagctggtgagcaagccccaaatacgtgtgcgggaggcggtgttccgccgacgcgctacattggtgagttatgccgacttatgatttgggacttgaacacgtttcgctcgctttcgcgaccaagaatattttcaccgatgtgacgcagggcgttttcgaaggcgaccgcatcggcgtcgtcggcaagaacggcgacggcaaatccacgctgctgcacctgttcaaaggcacgcaggaaccggattccggtcgcgtgaccatgcgcaatggactgacgttcggcatgctcgaccagcgtgacccgctcgacgacaacgccaccgtgcgcgaagccgcgttggaagggcgagaagattacgaatgggctgcggaaaccaaatcgcgtgagattgtggaggctctgctgggcggcatcagtctggacgcgaagatcggctccctgtccggcggccagcgtcgccgcgccgaccttgcccgcctgctgctcaaggactgggacattctcgcgcttgacgagcccacgaaccatttggacgtggtgaccatccactggctcgccgagcacttgaagaaccgttggccgtccggccagggcgcgctgctgctcgtcacccacgaccgttggttcctcgacgaggtatgcgaatcgatgtgggaggtccacgacggcgtgatcgacccgttcgaaggcggatattccgcgtatatgctgcagcgcgtggagcgcgaccgccaggccgacgtgcgcgagacgaagcgccgcaacctggctcgcaaggagcttgcctggctcacccgtggcgcccgcgcccgttccaccaagcagaagttccatgtcaaggcggcgcgcgagctcatcgccgacgtgccaccggtgcgcaacacgttggagctgaagcagatggccacgtcgcgtctcggcaaacaggtggtcgatctcatcgatgtgacgcagatcttcgaacatgcgcagggagaggccgatatcgatccggatgtggcggaaatggaagcttcggcctcgcgcgtggacgtggtgccggccatgtatgccgagccgcaggcgcacggcagcgtggaggtcgccgtcgacgatctgaccgatccgcggttggtggacgccggcgtgcccgaggcgcgacaggcggcgcaggccgcccggcaggccgaggaggagtcgcacgagtcgggtgacgacgccgacgagtccacgccggaagtcacgtccgcggcgcagaaggtcaccgtgaccggccgcaagatcctcgacgacgtgacgtggctgatcggcccgggcgaccgcttcggcatcgtcggcgcgaacggtgccggcaaatcgaccctgctgaagatcctcgacggcacgatcaccccgaccgccggccatgtgaacatcggcaagaccgtgaagttcgcggtgctttcgcagcgtctcgacgagctggagaagctcggcaagtacaagatcaaggaagtgctgagccgctacaagccgagctacatcgtggacggcaaggagaccacgccggggcagatgatggagcgtctcggcttcgaatccgcacagctcatgacgccgatcaaggacctctcgggcgggcagaagcgccgcatgcagctgctgctcatcctgctcgacgagccgaacgtgctcatcatggacgagccgggcaacgacctcgacaccgacatgctcgccgtgatggaggatctgctcgacacttggccgggcacgctgatcgtcgtctcccacgaccgctacctgctcgaacgcgtcaccgaccagcagttcgcgctgatcggcggcaagatccgccatctgcccggtggtgtgcaggattatctcgacatgaccgaggccatcaagaacggtaaggacccgtttgtggacgagaaggccggcaaggctagcaagggcggtaatgccgctgcgtccacgggtgctgccggcgactcctcatccgtgtctgccgatggcgactcgactgcttccgcgccgaagcttaccggcaaggcgttccacgaggcgtccaagcgcgtcgctgcgatcgaacgcaagctggccaagctggaggaacagaaggccgatctggaagcgcagatggccgcgcatgacccaagcgattacgaaggtctgggcaagctcaacgagcagttgcagtccgtcacggacgagtctgaatccctcgaaatggaatggatggagctctccgaacagctcgagtagtcccagtcgggcaaactgatggtgagaggcttgtaggcgtcggtttggcggtacggaatgtgcaaaaccgacgctggcgattcgctcagcgtcggtttaccggaataattcgtcgtggctgccagtacgctcgaagaacgcgaccgaatcgttcgatgaccagatcaccagccagtccccggcattggcgacatggcattcgtaccgtccacgccaattgccggacagggtgtgcatgttgtggcggcggtgcagctcctccagcgttttcgggtgtgtagccattcgtgcgacagcaaggtgtagcgcttgagatatcagtgtcatattcttgttcttacgggggtggagctgttctccgcaagaacaaccaatgggggtgtctcatgaatcaagtgatgcgaagaagcgtctgttgtttgttgtcggctttgttgctgtgctcatgcgccggttgcgcgaattccgtgcacgaaacctccgatggtgacgctgctcggagcagcagcaagaatgatgatgctgcggagcaagcgtataaagcatttactgtggacgctttggaccgtgttgccgccgatgatctcaataactcggacaaattggttctggtgaacaagctgggcgcgaaatccgtgcacggcgatggtgctattccatttgccaaaaaggtcgacgaaaaccatatgtattatgtcgtctccatgtgcaaacagaaggagcaggctccttactcacttgtcctctacaaagatggacagccgcacactttaaccactagggaatcctgtacgtctaatggagtggaaacagtctctcttccggcgaagaatttccttggcgccacctcattgtccattatcaatatcggcaatacggatcttgttgtttccgtatatgaagtaaaggaaagccaccgtgaataaatgctggtggctggtttaatgtgtttgatgagttagcggaatcgctagggacaatgaccattcttcattttctgaatttatggtcattgtcccattatgttgttgcgcaaaatcttgtatgagggctgtcccgtagtgattttctggagcactatttattgcggcgttatatagatttgatgcgaagatgcggaccgcatctggtcctacagagaggataaaagcaaaagccccgggtttcccgtgtttggcaatgttattgagaatttcggtacaaaccgtttgcaacgatggtagtagtgacttgtccattgcgtttagattcccgcggattattggtgtcccggtaaaacccagtattctcagtcttttgcattgagcttctatatgttgttgaaagagctcgtccgcgtcttcctctttgtctgttttaagctcatcggtcatcgggctgatgatttgagtgcgaagctcatgtaatgcctgcatgaggacctgttcaatctgtggcaaagtgtcgctgctctctgaggactcttttttgcggcacagcagaatcgcatatgtcatagctcctgcgatggaatcgtgcagtatgtgaatttctttgagtcttttctgctggcgtcgaacttgttcttgtgcaatcgccaagtccatttttcgttgtgctgtttgcgctttccatctcacggcaaaaccaacgcagaatgctccaatgtaggagcatgcaagcacggggatgcttggattgtagtcgatgccgcctgtccaatagcccaaaggaagtgctagtgcgcaaagcagcggtcccatgatggcaaattcaaatcgtttgatttcaaatgcgattatcccgcatgcaagccatgtgccatataacgtcgaagggccatcgcatattgccgggattatcgcgcatgctatgtgtgttacaagaatcgccatgcttgccggtacggggaaccaggccagtagcagcagggcgatgcagtacggagccaaatatagccatgaccaaggtgacatatttggccaagcggtcagctcgagcaggaaaaagcagatgcagataatggatcccgctaagtagggcttgcgcacggcctttgccaatgacattatttgttggggcagcctcatcgttatatccaaccgtttcttacgcacatcgcaacagcttcggcacgactatgagcatggagcttctcgaaagctcgtcgtgcatatgtctttaccgatgcttcgctgatattcagttggtgcgcaatagtggaagtggtgaatcctctcgcatagccggcaatgatctgtaattccttgccggaaagccgcatggagtttatgctcttccccgcccacgacgcaacctcgtcatttccagtggcttttccgatgattcgaaccagttgaatcgtgggaatttcttttggaataatcgcataaaacgcatcggaccattgtgctccgtatcttttttcgttttcgtcatccaaaaaggcgctgataccaatgacggcaatatctggatgttgttccttgatatgatgcgctaattccgagccgttcatcccaggcattgcgatatcggtaagcacggcttgtggcctttgtgcagagtccctcatggcctcaagtgcttgttctgcagaggtgacagtccacagaatccgtattggtgcgcatgtctcgaccaacaagctttgaattgcgcttgcgaccagtggatcattatccacaatccccaaagtcggatcattgacaatcgtgcgcataatgccccccattagtctgcttcttgctccagaatagacattttcccactgctgcaaggaatcatagcgttgccggtagcgtatgtcgtgattgagatcaaagcacgaatatattgtacaaataatttgtatataatgggaggcgatggaaaggagtcttctacgatgaacgatacgaactccaacgaggggcagctgcccgaagacgccgcagtgaccgtgaccagtgccgatactcttcgggccatggcgagtcctattcgcatgaggatccttggaacgttgcgggtgaacggcgaacagaccgtgggaagcatcagcgagcagcttggcgaggctcccggagccatcagctaccacttggggcagcttgcgcatgcgggactagtgaaaaaggtggagtctcctgacggagatcgaagaaagagctggtggaaggcctgtcaaagcgccattcgtctgggaaggcccgaagaaaagaacggtacggacgagtcgaaggccatggatctgttccggcgttccgcggcgctctcctacgagatggcctacgagcgttttctggacaggctgccggaattgcctcgggaatgggctgattcatgcaccagcgatgatcatgttctgaacctgaccgccgaggagacgagctcgatgatcgaggaactcaatgaggtcgtgcgccgctggcagatcaaggccggcatgcacggcgacgatgagctgggcgtcgaacccgtggctctgattctgcaggccttcaggtgggtctcataagacgccggcggggttgacgcatgaatccacgagcaaaccggaaagcgtgggcggaacagtcggaacaagtgggttaattggagcaaagcatgagtgaaacgacgaaatcattctggcattccgcagggtatatcccgtggttcaccgccgatacggcgtcggcggtcggagcggcgctgcgcgcactggcgatcagtttgctcggatatgcggtgtccggctccaccatcgccgccgggtggctcggaacgtcgtcgatgatcgcgcaacaggttgcgagcgtattcggaggtaccttcgtcgacaggcatgaccgcaaacggcttatcgtggcgaacgccgtcgtcggcgttctggcttggggcgcaatcgcggtgctgctgctgtgcggcgcattgtcgttccccgtgttgctgttgatcgcggtgctcgcatccggcatcaacggatttcttgggagcgctacggatgcgatgcttcgctcgatcatcgatatccgctattatcccaaggcgcggagcctcaacgaggggcgcgacgcgaccatcaccatggtaggagggcccatcggaggtttcctgtacagcgtcgctccatggctgccgttcctggcgtcggcttgtatgtacgccgtggccggcgtcgccgccaccggcgtccgcgaatatggttcggatggcgggcgtatcggggaaccggatggcgatgcagcgaagggcggtttctgccacgatttcctggaaggctggtcatggtcgctgcatcggaaaacgctggtgatcgtgctcatcgtggcggcattggtcaatttcggcgtcaatggcatccaatatgccatccagctgcatctggtgtcgtgcggaaccaatgcgaccctcatcggattcatcagtggcggcatatcgttgacgatgcttgtgggatcgttgctggccggcaaactcagcgataaggttccggtcggaccaaccgtgtgcctcgcctacctgttcatctgcctgtgcgcattgccgatggcgttgaccgacaactattgggtcatgctggttgccaattcgttggttggcctgccgttcccgttgatcaacgcgatgctcctcggtttcatcttcgccaagtcgcctacgagcatgcaggggcgtattactgttacattgacggttccggcccaggtgctttcgatgttctgtagtgctgtggctggcaccttgctcccggtttttggattccatggcgcggtgctgttgttcctcgcggttcttgtggcaagtgctgtgctggtgatatgttcccgttccattcgtagcattcccaaggcggcgcaatgggaacatacgatgttgcggtgaatcgaaataaaaagcgccgccccacgaaacgaatcgtggggcggcgctttgtcgtaggcaatgccgctcagcccgttcagcgaccggtgatctcggagccgagcaccttctcgctcagggctttcgggccgcgggtcacggccaccgcgccggagcggaccagctcgatgatgccgtaatgctccagcagaccgagcagcgcatcgatcttgccttctgcgccggtggcctcgatggtcagcgactccggattcacgtccaccacgcgcacgcggaacagacgcacgatctccagcacgtcggagcggttggactcgtcggcggccaccttgatgagcaccaactcgcgctccacggtggtttccggatcgagatccacgatcttcagcacatgcagcagcttgttgagctgtttgatgatctgctcgagcggcacttcctccacgtcggccgtgacggtgacgcgggaaatgtccggacgttcggtgggggagacggacagcgagttgatgttgaacgcgcggcgggcgaacaggccggcgatacgcgccagcacgcccggacggttctcgacgagcacggacagcgtatgacgcttggaacccggctgggatgcaggatagtttgccatgatcgaaatgtccttccttacgctctactcgttcactcgttctcgccggcgcgctgcagaggcttgacaccgggcatgtaggtgacgttgtcgttggagtcgccggctgcgaccatcggccacaccatggcgtccttccacacgcggaagtcgatcagcaccggacggtcgttgatctcgttggccttcttgatgcattcgatggcctcgtccttggtgaacgcgcgcatgcccacgcagccgtacgcttcggcgagcttcacgaagtccggcacgtccacgatgtcagacatgttctcgccgtccagcaggttcgtggcggagtagtggtgattgtagaacagggtctgccactggcggaccatgccgtacacggagttgttgagcagggcgatcttcaccggcgcgtggtcgaggaacgcggccgccagctcttcggaagtcatctggaaggagccgtcgccgtcgatcagccacaccggcttcttgtcatcgaattcgcgggcggatccgacgcgtgcgccgatggccgccggcaggccgaagcccatcgtgcccaggccgccggaggacagccaggagtggggcttgttgaattcgatgatctgggtggcccacatctgatgctggcccacgccggacacccacacggtgttggggtcggccatgtcggacagctgcttgacgacccactgcggagcgaggctgccgtcggtcggctcatcccacgtgatcgggtattcctcacgccacttgttgatgacgtcccaccagtggctggtgtcgggcttgccatgcaccgcctgctcgcgcttgatctccggaatgaggtccttcagcacggtggccacatcgccgacgatcggcacgtccggctgacggttcttgccgatttccgcagggtcgatgtcgatatggatcacgcgtgcgcccggagcgaacgcgtcgagcttgccggtgacgcggtcgtcgaaacgtgcgccgatcgcgaccagcagatcgcaacgctgcacggcgccggtcgccgcgattgtgccgtgcatgccgagcatgccaagcaccttcggatcggaatcgggcacaatgccgcgcgccggaagggtggtgacgatcggagcgccggtcacttccgccagctcctcgaccagctcgcccgcgtcggaacgcaccgcgccgccgccgacgtacagcaccggacggtacgactgctcgaacagcttcgccgcgtcggacagcacgcgaccgtgcgccttggtggtcgggttgtagcccggcagaatcatgcgctgcggccaggaataatacatttcgccggtctgcgcggtcttggtgacgtccaccaccaccggtcccggacgaccggaacgtgcgatgtaatgcgcctcggccagcacgcgcggaatgtcctgcgcgcgggtgacgaggtacgaatgcttgaccaccggataggtggcgccgacgatatcggcttcctggaaagcgtccgtgccgatggcgttcacgccgacctggccggtgatgacgaccataggaatggaatccatgttcgcgtcggcgatcggggtgatcatgttcgtcgcgcccggaccggaagtgacgatgcacacgcccacctgtccggtggtcagcgcgtagccttctgccgcatgtccggcggcctgctcgtgacgcatcagcacgaagcggaacttcgtatcgtccttgatggaatcgtagacgggcagaatcgcaccgcccggaacgccgaagacgtccttgacgcccagatcctccagcgaacgaaccagcgcttcggcgccggtcatcttttcgccgtcgacaatggtctgcttttcagtggtagcggatgcctttggcatgccgctgaatgcctgcagaggcgtaggtaacaccatgttccctctcatgctcgttcgtggaaaatttcctcgtaaggggccgcggccgcgtcgttcatgcgccgttttaccccttaaacggaatgctatgcaaccgcttgtggcggattgcagccgcattcctctctgataatgagtctatgctaacggctgacagcttggttcgccggaaaggcccatattctggcgcgttacgcgccattgtgatatggaccatattttttgcgattgcgacgctgccttgtaatgctgtttcgtgacgccggccgtgccgccgcttgcgttaccgtttgcgcggttacttgccctgcgctgcatcctgcgtgccaccgttggacttgcgatgtgacctgtggtgcgacttatgcgtcttcccgttctgcttgccgcccatttcgcccttgcgactgtcaagcgccttccagcccatttccgcggccgccagctgcgccttgcgtttgctgctgccggtaccgacgccgatgacttcgccgccatcgccgagaatcgcgcgcgcggtgaactccagtgcgtattccggtccggcgaccgacgtctggtagtgcgggtcgggcagacccatctcatgcgccttgacggtcagcgacgtcttccaatcgagcgccggaccttcggtggcgacctccgccagcgtatcgtcgacgagatgatgcaccacgcggcgcgcctcgtcgatgccgtgctggatgaacgtcgcgccgatcagcgattcgacgatgtcgcacagaatcgaacttttgtccgcgccaccctgttccgcctcgccgtggccgagcagaatgtacgggccgacgtgcagcttttcgcgggcgattttgctcagcgattcctcggaaacggctttcgcgcgcattttggccagctggccttcgttcatgtcgggatgcaccttgtacagcgtttccgtggagaccagttcgagcaccgcatcaccgaggaattcgaggcgttcgtagttcttggccccctcatgctcgtgtgagaacgagcggtgggtgagcgcttcgacgagcaggtccggttcgattgtggtgccgagcgcctcgagcaacacattggcggtcatctcgccttcgggggtgatggaggtgccgatgcggccggcgttggtattgttgccgttttcggtttgggtgttgtcctgcgcgttgtcctgattggtctctttggccatggatgttccttaccgttcatgcggcgggccgagcctgccgcggtctgtggttgtggccgttgcgcacatggcaagacgccagctgatctggcggttttgctacgcaagcaacgtatgtcgtacgccgatcgcacgcggaaataaacgcaatgcaatcgccgtatcacttgataataataaaagaaaccctgccacccgtcgatggcagggtttcgatgctttataccgttatccggcaaccactcacttggtgtggatggagcggacagcctcgcggtacacgcggccgcggaaggaaccgcagctcgggcatgccatgtgcggcagcgtcggagcgccgcagttcgggcaggtaacggtctgggcggccttggccttccagtttgcgcggcgagaatgggtattcgcgcgcgaggtcttgtacttaggcagtgccattgtgtttcctctatttcgttcgaacgattgagcttaagcgttcagtatcttaacgtgagctccgtacaaacgatggaccatcccatccgaacggcttattccttgccttccagcttggctttcagcccttccagcgcggcgaaacgaatgtcggtcatgtcatgctgatggtcggggttctcgttgaggtcgatgccgcactgcgagcacaggcccttgcaatccggcttgcacaacggctgcagcggcagttcctcgaccagcgtgtcgcgcagcagcgcctcgaggtcggcccatgcgccgccgtcgagcagcgggtacgtgtcttccgcctcgtcctcgccggcgatgatgtccacttcctcttccttgccgttcttgccggcctttccgcccttgccggcggcggacttgtcctcatacgggaagaaggaggtgacgttcaccgtccaatcgcgctggatcggcttcaggcagcgcgtgcattcggcatgcacgggagcgctgatacgcgcgttcagaatcagaccgtcgacgatcgaatcgaacgagccgaccacgctcacatccgcgccttcgtccacgccgacgatctcatcgccgatgccgctcggcgcggggaaagtggcgtcgatctccttgctttgccccggacgcgaggccacctgcgccacggaaacggcccatggggaatcttcagtacgtgccatagttcagtctttcgctctttcttgctatgcgttccacgcgtgttacgcgtcttgctcagttttccggataatcgtccgcatcgagatggtccagatgcgcgccggcttcgcgttggcgatcgtacagcacgttcaggcccgcctgcacgccggtgccgatcttgtcgacctgctgttgcaacgattccatcatggtgatgcagtatttgtcggcgttctgcgtgagcttgtcggccttggcttgcgcctggtcgagaatgccgcgcgccttctgcctggcgagttccgtcacgttctcctgcccggcaaggaactgcgcctgctcgttggcttcgcgtacggtgtcggcggcacgcgactgcgcggatgcgatgatcacgttggcttgcgtttgcgcgctttccagacggcgttccgattcgcgcatcagcgcggaggcgcgttccagctgcactggcagcatcttcttgagtttgtcgagcttgccggtgaacgattcgcggtccacgcgcaccgagctcggcgcgaacagaatcggcttggcctcgtccaattcctcttcgatgctgtcgatgatgtcgtagacggtggtgaattcgtcgcggctgcgatccgaactgtcgtcgagtggcgcatcgggatcgaacgtggcacgaaggtcgggcaggtccgacatggaaatcgacggtttcgacgatttcgcgggctttgccggctcatccgtagcacggtcggcggcattgccggttgcggagttgttggtcgctgcggtaccggcaacagcgccggtggccggataatcggccgccggcgtgaccggctgctgcgacgtggcgtcatcggcgtcagcaagcggcttgaaatcgttggtctcttcactcatcatgctctcttttcgttcttgagcgcctcgccgagcagtggaatcacgcaatcgggcaccatgcccgtcacatcgcctccgtgccgtgccacgtccttgacgatggagctggagatgtgctccaggtccggggccgcaggcagaaacagcgtttccactccggcgagtttgcggttgaccaatgccatgcccagctcagcctcgtaatcgccgttctgccgaagtcctttgacgatgaccgtcgcaccgattttcgtgcaatagtcggtgatcaggccggtggtagacgccaccttcacattggtgcaaccgcgcttggcgagcgcctggcggatgatctcaacacgggtttcctcggaaaacatcggcgtcttcgccgcgttcacggccaccaccacatgcacttcgtcgaaaaagcgcgcgcaacgctcgatgacgtccaggtggccggcggtcactgggtcgtacgacccggggcaaactgcaattgtcataaccttaagcgtaccgcgattggttgagaacgtgcgcaacatcggcgtatgcccgtgttggcgcggttcgtgcgcacgggtggcggcgcaatgcggctcggctatgatggaaggcagtggggccgcgatcgcggcttgtgtgaggagtcttaattatggtatttgcgattttcgatggcctgttcggatccgacgatccggtttcgccgctgtccaacccggatgcgggtaccggtaccgccgttctggaacgtcctgaagaggaaacgaagcttgatgacggtggcaatggcgatgccgaccgtttcgcgcattatgtgtcgcgtgaccgtatcgccgaatcgaagatgacgggccgtccggttgtggcgttgtgcggcaaggtgtgggtgccgaagcgtgaccccacgcattacccggtgtgcccggattgcaagcgcatctatgacgagatgatgaacagctcgttctgattgccgttcgaccatgttgccgattcatgccgccggttgcggtggctgaacgtggcgattgaatatggcggctgggtgcggcgcaacgtcgtatgttatgcaaaaaccgacgcccggtgaatcaccgggcgtcggtttttgttatgtcgtttgctccgtacagggcggttcacgccatgacggacgtcacagcacggtgacttcggtcgggatgaccggatcgcccttcatcaggctctgtgcgccgatcggcagttcggcgagcgcctgcgcgcggtagttgtgcgcgttgacgatcgcgtcgtggccctggtattcgctgtggttctcgccattggtgacgtagtcgacgagcaggtccttccagccgtcttccggctggtatgcggcgagcttgtcttcggagccggagatgacgtgttcgcagtcggccagcgagtattcgtaggagcggaaggcgagcttgcggcccggaacggtggccttgtccttcgacttcttggcgaccggctgcatttcgccggcggagttctcgcgttcggtgagcttgtagaccatcgcgcaggtcggggcgcccgagccggtgacgagcatggtacccacaccataggaatcgaccggagcggtctgcagagaggccagtgcgtactcgtcgagatcgttggtgacggtgatcttcgtattggtggcaccaagcgcgtccagctggttgcgcacgcgctgcgcgagggaggcgagatcgccggaatcgatgcgcacgccgcccagttcggggcctgccacgtcgacggccgtcttcacggcctcttcgatgttgtacgtgtcgaccagcagcgtggtgttcttgccaagcgcggcgatctgcgattcgaaggcgctccgctcgtcgtcgtgcaccagggtgaagcaatgcgcggcggtgccgatggccttgaggccgtacatttgcgcggccagcagattggcggtgcccttgaatccgcccaccacggcggcgcgggcggctgcgacggcggcccattcgttggtgcggcggcctcccatgtccatgcacgggcggtccttcgccgcgctgaccatgcgggacgcggcggaggcgacggcggaatcgtaattcagaatgctcagcagcagcgtttccagcagcgtgcattcaccgaacgtgccttcgacctgcaggatcggcgagttcgggaagaacatctcgccttcgtggtagcccttgatggagccggagaagtggaagttctccagccatttgatggtttccgggcttaccaccttgcggtcggcgaggaatttcaggtcgttgtcgtcgaggtggaacttctcgagcgcgtcgaggatgcgtccctgtccggcagccacgccatagtggcggcccagcggcagatgccgggtgaagatctcgaatacgcacttgcggttggcggtgccgtccttcaggcatgcgtcaagcatggtgtattcgtacatgtcggtcatgagtgcgggtgaataatccagcatttccaaagcctttcttgacttttggtgaaactgaccataagtgtaggacccacggtggccaatctttggttgcatcccatcatacgtgcaggaggggtctcgaggcgcggcgtgcttggctggtgatagggtcgaatgctgaaaagacgagtaatcggacggcggcaaaagccgaaatcagcggaaagcgaagtgcagaacagcaatggtagcgattaaggatatgttgggcgaccagaccgtggtgcgtgcggacggacgcaaggtcgacgaactgcgcccggtgcgcatcacccgccatttcacggacgttccggaaggctccgtgctcatcgaatgcggcaacacgcgcgtgatgtgcaccgccacgttcaccgccggcgtgccgcgctggcgcaaggactccggcctgggctgggtcaccgcggaatacgcgatgctgccgcgcgccaccgccgaccgcaccgaccgcgagtccgtgcgcggcaagatcggcggccgtacgcacgagatcagccgtctgatcggccgctgcctgcgtggcgtcgtcgatatgaaggcgctcggcgaaaaccaggtgcagatcgactgcgacgtgctgcaggccgacggcggcacccgcaccgcttcgatcaccggcgcgtacgtggcgctcgtcgacgcgatgcattgggccgaggaacacaagcacgtcaagtccgccaaccgcgtgctcaaggactgggtctccgccgtctccgtcggcgtgatcaacggcaagccgatgctggacctgccgtacatcgaagacagccaggccatgaccgacatgaacgtggccatgaccggttccggcgatttcatcgagatccagggcaccgccgagcatcgtccgttcaaccgcgccgaactcaacaccctgctcgacctcgccgaaaaaggcaacagggagctgcaggccgcccaacgcgccgcgctcgcgctcgactgagccgatcgacggcacggcatgcgctgaatgtaggacgttgacggtccgatgccggcgactcggcgcgcatggaacaacgcaaacagatataagtcggaaaacgacggaaggaaccgtaaggcatgaagatcatcgtcgccacgcataacgaaggcaaactggcggaaatccgccgcattctcgaggaacgtctcggcgcggacgccgccgacatcgagctcgtctccgcaggctccctgggattgcccgatccggtcgaggacggcgtgaccttccaggagaacgcgctcatcaaggcgcgcgacgtggccgaacgtaccggctgcccggcagtcgcggacgattccggcctgatcgtggacgtcatgggcaacgcgccgggcatcctgtccgcacgctgggccggcgagcacggcaacgacaaggccaacaacgcgctgctgctcaagcagctggccgacatccccgacagcaagcgcaccgcacggttccgctgcgccgccgcgctggtcctgccaggagagcgcaagacggacggtgcggatgatgataagccgtacacgatcgccagcgaaaccgtcgaagtcggcgaaatgccgggcgtgctgctgcgtgccccgcgcggcgccaacggtttcggctacgatccgctgtttgtgccgaacgatcagccgcagcgtgcggtcgacgccggcgaaaagctcacgtccgccgaaatggagccggccgagaagaacgcggtctcccatcgaggcaaggcgctgcgcgcgctggtcgcatcgatcgaagcgctggtcaaataacatcggatgacggccgcgacgggcgcttgccgtggcgcgcgacactggatggcgtgcgtgcgatttgtgctcgtccggtttttccgctatgctttgtttcttgtgcgcggctagcgtatgcttactgggcattgcgccactttagctcagtcggtagagcggctcactcgtaatgagcaggtcgacagttcgattctgtcaagtggctccactgccctagatgttcggaggttttccgagcatctagggttttgcatatgtgcatccgtgcgtatcggttttcgccgtgcgcggatggtgattgcgcgagtggcggaattggtagacgcgcaggatttaggttcctgtgtctttgacgtgtgggttcaagtcccatctcgcgcacatgtccacgttaattcagccaatcgcgctgctggccatcatcctcaccggctacctgttcaaacgcgccggcaaattcaaaaaccgcgactaccgcatcatgcaggtcgccctgttcaacctggttctgccctgcgccatcatctactcgttcgccacgaacccgcatgattccagcatgctgtggatctccgtcttcggcttcgtggtcgcgttcatcccgcccgtgctcatcttcctcaccacacgtcacacgcctgtgcaggatcgcgcgttcaccatgctcaacggttccggcttcaacatcggctgcttctgcttccccgtggcacaggcgtttctcggcaccgcggcgatcgtgccagcggccatgttcgacatcggcaactgcgtgatggtggcggccggcacgaacgtcatgacgcagaccctcctgcacatccagcccggcaagaccttggacgagcagtaccaggggcatgcgccggtgctgccgtatacgaaacccaaggatcgcgatgcccgccggctggcacgccacgcgctgctacgcaacgtggcgaaaggcttcttcggctccatcccgtttgacacctacctggtcatgatcgtgctcatgcttgccaatgtgaagatccccgccgtcgtggccacgttcgttgagccgctcgccaacgccaactcgttcgtcgccatgctgatggtcggcatgctgatggacctgcccgccggccgtgacgatgtgatgaagctgctgaagatcatcggcctgcgactgccattcggcctgctgtccgccgtctgcgcatggttcgtgctgccgttcggcgccaatgtgcgcgaagccgtggtgatgtgctgcctcgcgccaatcgccgtgttctccaccctgttcaccgacgaagtgctcggcaatgcgaaactcgccggcttctcgctgtccgtgtccgcgatcatcggcctggtcatgatgaccggcgcgcacttcctgctcgccgccatcgcctgacttgcgtaagccgcgtgcgtggtcgtgcgtaagttgcgtacgtaatcgtaatgcgatcgttgcatacgacagccgttttcacgtgcgttgaagctttcccgctgaacgttgcatacgatttcagtaatcgtcgtttatctggcatgtcgccactgaaaagtggtcggaaccgcggtatatcgcgcttccgaccgaatgtgttaactcgggaaacatttttgtgttgttctgtcggcttttgtgagtatcttgtgaggtgaagaaaacggctcgtgccgtggaaaatcgaacgagattccaccgtcacgttccgcttcacagtgatgatgaaaggacctatcaacatggccatcaatcctcccgttgacgccaccaagaccccggagtgggccgcgctgcagaagcactacgacgagctgcagtccgagggcatcagcctcaagcagtggttcgccgatgacgccgagcgcgtcgagaagctgagcttcgatgcaggcgacctgcacttcgatctgtccaagaacctgatcaagccggagaccctgcagctgttcgccgacctggccaaggccgtcaagctcgacgagcgcaccaaggccatgtacaccggcgtgcacatcaacaacaccgaggaccgcgccgtgctgcacaccgcgctgcgccgcccggtcgaggacgagggcaagtacatcgtcgacggccaggacaccgtcaaggacgtgcgtgaggtgctcgaccgcatctacgcgttcgccgacaaggtccgctccggcgagtggaccggcgtgaccggcaagaagatcgagaccgtggtcaacatcggcatcggtggttccgacctgggtcccgtcatggtgtacgaggcgctgaagccgtacgcagacgccggcatctccgcccgctacatctccaacatcgacccgaacgacctggccgagaagaccaagggcctcgatccggagaccaccctgttcatcatcgtttccaagaccttcaccaccttggaaaccctgaccaacgcccgtgaggcccgcacctggctgctcgaagagctcaaggccaagggcgccatcgacggttccgacgccaagaacgccgaagccatcaagaagcacttcgtcgccgtctccaccaacctggagaaggtcgccgagttcggcatcgacccgaacaacgcgttcggcttctggaactgggtcggcggccgttactccgtcgattccgccgtcggcacctccctcgccgtggtcttcggcccggcccgcttcgaggagttcctgcacggcttccacgagatcgacgaatacttcgccaacaccccgttcgagaagaacgtcgtcgtgctgctcggcatgctgaacgtgtggtaccgcaacttcttcaaggtcgcctcccacgccgtgctgccgtacgaccagtatctgcaccgcttcccggcctacctgcagcagctgaccatggagtccaacggcaagtccgtgcgttgggacggcaccccggtcacctccgagaccggcgagatcttctggggcgagccgggcaccaacggccagcacgccttctaccagctgatccaccagggcacccagctcatcccggccgacttcatcgcgttcgtgaacaccccgaacccgaccaaggacggcgaccaggacgtgcacgagctgttcctgggcaactacttcgcccagaccaaggccctggccttcggcaagaccgccgacgaagtgcgcgctgagggcaccccggaagagatcgtcccggcccgcgtgttcaccggcaaccgtccgaccacctccatcttcggcgtggctctgaccccgttcgcgctcggcgagctcatcgccctgtacgagcacatcaccttcgtcgagggcaccgtgtggggtctggactcctacgaccagtggggcgtcgagctcggcaagcagcttgccaagcagatcaccccggccatctccaaggatgacgacgccctggccgcccaggatccgtccacccagtccctgatcaagttctaccgcgccaaccgtgagttctgattccgctgcgttgcatcagaactcacggttgcgcgcgccgcacggtgttgtctggtgaacggtctggcgaccgttcatgccgcgagttctgatcttccatcgaaacgtggcgtctagcgcgtacgtggcataccccatccgtgtcttacggatggggtatttttgattattgctgtgctgaaaggtgggatgccgcataatcccgcttttctttgggtccagccggaacggtcgcaggtaactccggccgtgctttatcgcaatatttccggcggatcggcaacccttcgcaggcagacctgcggagcggaagaacaggccgagacggcaatcgcaagaacgccgtacgaagcccttacctgtgcgccgatatgcggcggcgactcgaggaaacacaatggttaacgctattgaggcatttgacgccaagcacatgaagccggccgaggaaatcccggctttccgtcccggtgacaccgtcgaagtcaacgtgaagatcaaggaaggcaacaactcccgtatccaggccttcaccggcgtggtgatcgctcgtcagggcggcggcgttcgtgagaccttcgtggtccgcaagatcagcttcggcaccggtgtcgagcgccgcttcccgctgcactccccggccatcgattccatcaaggtggtccgcaagggccgcgtgcgtcgcgccaagctgtactacctgcgcaacctgcgcggtaaggccgctcgtatcgtcgagcgccgcgacaactccgagaagtgagttcgaatcgcaaataaagcgtggaatcggctcttcggcaacccgtcgaggagccgattttctatattgggccgctatgataggggccagtgcgtgaaaccggacggtaaggaatcccatgaagcatgccagaagaagagtcgaaagcgaggaaagcttcggcttacgagacaccctgatctggtgcggcatacccatcgtcatcgtgctgctggtgcgcatgttcctgttcggcttctacgtgattccgtccggctccatgctgaacaccatcgaaccgggcgaccgggtcatcaccagcaaactcacccccaaagtcttcaagctccagcgcggcgacgtggtggtcttcaaggaccccgaccattggctgcagcaggagaacagcggccgattcggcggcgactacctcatcaaacgacttatcggcctgcccggtgacaccgtggcctgcgaggggcccggcaagccggtcacggtcaacggtgtggccatcgacgaaacttcgtacatccgctccggcgtggaccccagctccttcgcgttcagtgaaaaagtgactgcgggacatgtgttcgtcatgggcgacaatcgcgccaattccgccgattcccgctaccatcaggacgattcctcgcacggcctcgtgccggtttccgacgtggtcggcgtcggtctggtcaagtattggccgctgaaccacatcagcacgctggacgcgcatcacgacgtgttcaaggacgtgccggaaggatctgccgactgatgtccgtttccatagtgcccacgctggatatggaacgggcgatcgcggcctccggctacgacgtgatcgtcggcttcgacgaggtcggccgcggctcgctcgccggtcccgtcatggtcggcgccgccgcaatccgcacgtgcgacctgtccggtccgtcgccgcttgccgtacccgacggcgtggccgattccaaaatgctgacggaacaccgccgcgaagccatattcgaagagcttaaatcgtggtgcgcgtcctgggcggtcggctcggccagcaacacggaaatcgacgattggggcatctcctacgcgctcggcgtggccgcgttgcgtgcgctgtcggaagcggagacgagactcggcatcgacggcaacggtctgcttgacgggcggccggtgaaggtcggggcgatcctcgacggaccgaacgactacatcaccaaagcgctgaacaccttcgacgcgcctgacgtgccggttcctgcggaagtctctaccaaagtgaagggcgacaggtactgcgccaccgtggccaccgcagccgtcatcgccaaagtcacgcgagaccggctcatggtcgaactgggagcgcaaccccaatatgaaccctatgaatgggcccacaacaagggttacggttcggccgcacaccgtgacgccatcgctgaattcggacccagcgacctgcaccgcctctcctggcatctcgtctgacatacggcatctcatccgcagtccgcgattacgctaatccttgcggatgatgcatgccggaaggaaacctgtaagttcatcccgccgtctgatggccgggaccaatccgtttccgtaccgtaggaaacatggaacacatacttcacgcgaccgatctggtcatggattattcgacccaacaggcgacaccgaacgccacacacatgctggcgctcaatcacgtggatttcggcatccaggcaggcgaaagcatcgcggtcatgggaccgtccggttccggcaaatcgacgttactgcacgcactcgccggcatcatcaccccgacagccggcaatgtgatgtttcgcggtgccaacctggcgcggttgagcgacgctgaccgcaccaaactgcgccgcagcgccttcggcttcgtcttccaatccggacaactgctgccggaactgccggccatcgaaaacatcgcgttgccgatgatgctgggcggcgcaagctaccagcaggccaccgacacggccatgctatggctggaacgattgggattgcgccagctcgcgcaacaacgtcccggcgaaatgagcggcggccagatgcggcgcatcgccatcgcacgtgcgctcgccgcgcagccggcagtcatcttcgccgatgaaccgaccggcgcgctcgaccagaccaccggccacgaaatcatgagcattctcatgcggaccgcacgacagaccggcgcggccgtggtcgtggtgacgcacgattcgaacgtggccgcattctgcgatgccaccgttaccatgcgtgacggcaggctgagctcgccgcagcaatcccaacctaccgccggaggcgcacgatgaacatgttccgattatggcgattgttccaccgctccggcacccgcggcacatccagccgcacctctgcgctggccatcgttgccttcgcatccgccaccgccgtcttcctaaccgtgctcggaggcctgcatggcttcatctggcgggcctccgccgaccacacgttcggttgcatgatcaattccaacaggtgcgcgcccggtacatacgaaacatggtccaaaaccctggcgcacgccgacaagctcgtcgccacggtcggcgacggccattggacggccgaccaggccacagccgtcatgaacacctattccgacggctatgtgctgctcgccgcattcgccagtctgctactcatcgtgccgttcgtggcgctcgccggctcggcggcccgtctcgcggcctcccgcagggacgcacgtctcgccgcactgcgacttgcgggcgccaccaccgcgcaggtcacgaaactcaccgcgctcgatgctggtggccaggctctgcttggcgcgctggtcggcatggccggctacttcgcgctgataccggcgatcatgctgctcgacttccaaaaccagcatttcaccttcgaacagttgtgggtgggactgcctgctctggcggccgtgaccgtcggagtcacgctgcttgccttggtctccgcgctggtcgccctacgccgcgtggccatcaccccgcttggcgtgatgcaacgtaccggacaacccatgccgtccgcatggcgcgcactgattttccttgccgtgttggccgtaggctacctgctgctcaacagcatctccgcattcgcgcacttgggtcagatggtggtctacgccatcatcttcggcgtcttcttcctcggtttcgccatggtgaacgtcgtcggtacctgggtggtggcgatgcgcgccagatcgcgtgcgaaacacccgaaggacgcggccactatgattgccatgcgccgtatcctcgacaatcccaagcgtgcttggcgtaacgtgtccggtgtggcgctcgctgtgttcattgcggggatgacgtcggtgtgcggattgctcgccaccggaatcggaggcaaccacgacccgttcgacccatctatgctgtacatgcgcgatatagcgatgggtggtttcctgacgctcgcctttgccgcggtgctcgccgccgtcagttccggcgtgatgcagacgggcaacgtctacgaccaggccgacgagtaccgcatgcttgcgttggaaggcacggatgaggcgacgctcgacaaggcacgcatgatggaagtgatcaccccgctcaacacggtgatggccgtttcattggggtgctcggtgttgttgctgtttccgattctggcaacgtcgttgctcaatccggcttcgttgcttacgttggccgcgggaatcggcttgtgttatgcgctgatggtgctcggagggtgtgccgcgaatcatgcggcgcacgggctcggtcatgccggctaccgtatggacgattgatggcctcgccgcggcggtcgtggataccgcggcgaggactggcgaggtcagccgagcagcaccgcgataatcgcgatgaaaatcggcgacgacaacgtcgagaacagaatgccgtcgcgtgcgaacgacagacccacgttgtaccgcgccgcgtagttgtagacgttctgcccggtcggcagagcggcgagcaccacgcacgcgtacagcgtggcgccacggaagcccatcacgaaatacgacagcaggaacgcgatgatcggcatcacaatgttcttcaaagcggccaccgtgaacaccgccggaatattcgacttgtcctgcaacggcttcgtgccgtgcaaggacatgccgaacgccatcagaatcatcggcaccgcggaattgccgatcatgtcgatcggatcgtaaatacagtccggcaccacgaaatagccgaccttcgcggaaatcgcggacaccacaatgcccagcagcgagccgatgagcagcggctgatgcaacggctgcttcaaaatctccttcgcggagaccttgcctttggtggtcacgtcgagcacggtcaggccgatcggcgtgaacaccgcctgctgcatgaccagaatcggtgcgacaagcgccggattgcccagaatgtacgtggcgatcggcaggccgatgttgttcgagttcagatacagcgaattcagtgcgccgatggtggcgtccgcggccttcatatggaagaacagccggttgagaatcaggaagaccacgcccaccagcagcgccgaaaaaaacgccacgacgatggaggaatggaaaatctcgaagattttctccttggacaggatggcgaacatcaggcacggactcgacacgaagaagctgaacctgttgagcaccatctgcgcggtcggcccgccgatgcgcatgcgcgcggccacatagccggtcgcgatgacgatgccgatgacgcagaaaccttccatcgcgcttaacagacccggcattgcactctccttttcgttgcggccgttgcctttcgaccgctatctagtgtggcaccaagcgcgcgtcggtcgtatgcacgtctcaaaagcgagcccgatacacgattgacggcacgttttgccggataatggacggcatgaacgaacttacgattggattttccgcttccgccagcaaacaggagcagttgaacgagctgatgaggcagatcatgggctgctattccgtcagcgatgacgaaggcccgttgacggacgccgtcgaggtgttcctgaaaaaacagccgcatctgacggtgcgcaggcacggcgacacattggtggcatccaccgatttcggccgcgagcgccgcgtgattcttgccggccatctcgacacggtgccggtgattgacaatttcccgccgaaatggcttcagccgggcgatccgctgattcgcgaggatgtggcggccggtcatgagcatgagcgtgtgatctggggtcgtggcgccaccgatatgaagggttccgacgcggtcatgctgtatctggcggccacgctgacggatgcgaaatacgatttgacgtacgtgttttacgaccatgaggaagtcgcggccgagaagaacggcctgcgcaaggtggtcgagtcgcatccggattggatcaccggcgatttcgcgatcatcggcgagccgaccgattgcggcatcgagggcggctgcaacggcacgatgcgattcgacgtgatcacgcacggcgttgccgcgcattcggcccgcgcctggatgggcaagaacgcgatccacgcggcggccgagattctgaaccgtttgaacgcacatgagaaccgcgccatcgaagtagatggcctgacctatcaggagggcctgaacgccacgctgatttccggcggcaagggtaccaatgtgattcccgacgagtgccgtgtgcacgtcaactaccggttcgcgccggacaagtcgctcgccgaggcgaaggcgctgatgatcggcgcggatgcgggcgcgaaactcggcaacggcgagcatcaggccactggtggcgtgttcgaaggcttcggcatcgagatgaaggacgaatcgccgagcgcacgtccgggcctcaattcgccgcttgcccaatcgctggtatcgcttgtcaaggaacgtaccggtcgtgacccgcttgccaagctgggttggacggatgtggcgcgtttcgcgattctgggcattccggccgtgaatctcggcgcgggtagcccgctgctggctcacaagcaggacgagcagctgccggagaccgatctgctgctcatggccgacctgctggaggactggctgcgttgaatcgccgttgagtcgttgctgagctgccgttgaatcgccggtaattcgctgccgcgggcttgccgcagaaccactattggtccaccgttgaaccgctgctgaaccactatgccggcgcacgttcattcacggcgtgtcaacgcgaatcattggaaaacggagcgtgtagggggaataaatttcccgtcctgtcacgctccgttgttttttgtgtcatacttatagacggtggttctgcaagaccgccgacgcatccgatggcgttgatcccctcgcgtgaatgttctgtgagtcgcgagcgcaggtgtccgccgtcgcatgatgaagacttttgacggaagttgcttcctacgggcgccatgatgcgcggccacggtgagagcgtggtgtgagaaccgttggggcttgagtgaaggcgatgcgattgcagcgcgttgccgaggagcgttgtgcctactaccaatgagggcctcgatcaggtcgaggctgttgtgtcatccgataattcaaccaataatgcggcaagcagtgcgggttctgtgtctgccgatccggctccgcgccgccgtcgtggaggtcgccgcgtggtgcgtggcgtaggtgccgcgggcgcgtctttggagctgaaggtcgaggagcatgccaaagcccccttgtttgaggaaccgaagcttgagcctgtccagcctgcgcgtgattccgccgatttcaatgatgccgatgacgccgagccgtcgcgtccgcgtcgtcgtcgcgtgacccgttacgatgacgacgatgagatgcgtgacgaacgtccgcgccgtcgccgtcgttcctctgtggacgtgcaggacgaggatgatcgcccgtcgcgtcgccgtcgccgtatcagcgacgagccgcgtgatgaccgtgacgatcgtgacgattacggcaatcgtggcaatcgtgacgaatcatccgaagaccgtgcgctcgacgccgtcagcgcgctgccggaaggccatgagacgcgtcataatccgcgtccgatgacgtcgctgctgttccaggagccgattctgccggccgcccccgcgggccgcggatcgtccgacgatgacgatgctgacgatacgggccgcagaggttcggacgatgcccgtgacagccgtgatgaccgcgacgatgaccgtccgactcgtcgccgccgccgtcgcagccacgacacggccgacacggaccgcacggacgcttcgaatgacggtcgcggccgtgatgatggcaatgaccgcaacaacgacgccgaagacgatgatcatggcgattcccgtcgttcccgtcgttcccgtcgtctgaacgcgcaggaacgtcgtgccgctgccgaagtggagcagatcgaggaggacctggtcctcgatggcatcacgtatgcgccgatcgatgacgagtcccgcaatggaaacgatgatgatgacgagcagccgacgcgcacccgtcgccgccgtcgcggacgcggcaaccatgaggaagccgacgagcagcagacctccgaacgcgaatcccgtcgccgtcatgaggatgacgatgaggaagagggcacggtgacccgtcgccgtcgccgccgccgtggagggtcgaaggccgaggaatcggacgagacgatgtcccgtcgctcccgcaagcagcagtacatcgacgaaatcaccgacgtcgaaggatccacccgtctggaagccaagaagcagcgccgccgcgacaaccgtcgtgaacgcagccgtcagaaccagctcatggagcaggacttcctggcccgtcgcgaacacgtcgagcgtctgatggtggtgcgcgaacgtgagcgccacacccagatctccgtgatcgaagacaatgtgctcgtcgagcattacgtgtccggcatccaggaagtggccaccgtcggcaacatctatcttggccgcgtgcagaacgtgctgccgagcatggaggccgcgttcgtggacatcggacaggcccgcaacggcgtgctgtacgccggcgaggtgaactgggattccgcacgtctggaaggccagccgcgtcgtatcgaactggcgttcaagtcgggcgatccggtgctggtgcaggtaaccaaggatccgatcggccacaagggcgcaaggcttacctcgcaggtcaccttggccggccgtttcctcgtgctggtgccgtccggcggcatgaccggcgtgagccgcaagctgagcgagcgtgagcgcgcccgcctgaagaacatcgtgtcgaagatcgcgccgaaggatatgggcgtgatcatccgaaccgcggccgaaggcgcttccgaagaggccatcaccaaggatctcgagaacctggtgcgccagtgggaacgcatcaccgccaagcgcgacgagttcctgcacggcaagcgtccgaagctgctgcaaggcgagccggacgtggccatccgcgtggtgcgcgacatcttcaacgacgacttctccaagatgatcgtggaaggcgaccgcgtgtacgagcgtatcgaggaatacctcgacacgatggcccccgacctgaaagacaagctcgagaagtgggatccggccgaacatgacggcaaggacgtgttcgacaagtggcagatcgactcccagttgcgtaagggcatggaacgtcaggtctacctgccgtccggcggttcgatcgtcatcgaccgcaccgaggccatgaccaccatcgacgtgaacacgggccgtttcatcggccgcggcaagagcctcgaggaaacggtgacccgttgcaacctcgaagcggccgaagagatcgcgcgacagcttcgtctgcgcgacatcggcggcatggtgatgatcgacttcgtcgacatggtcatgccggccaacagggatttggtgctccgccgactggtggagtgcctggcgcgcgaccgcaccaagcatcaggtggccgaagtcacctcgctgggactggtgcagatgacgcgcaagcgcatcggccagggtctggtggaggcgttctccgaggaatgcccgacctgcaagggccgcggcttcatcctccatgacgaaccgaccgtttcggcggattacgacgatccgtacgccctgaagggcggcgatccgttcgtcaagaccaacaagcatggccatggcacggacgtgcaggtgccgaagggctcctcgccggacgtgaaggccaaactcgcgcagatcgcggcggcagccgtggccgccaacaatgcggacctgggcgaggaagaacaagaagaataaaggaaaatcccggtatgtcaacttgacacgccgggagcagacttgcggttgtacgcgggtatgtgtagattagattgctggtgtctggccgcgaggctcgaacgtgccgggcagtaagctttccaagttaataaaggaacggatatgtacgctattgtgaaggccggcggccatcaggaaaaggtcgaggtcggtgacgtcatcctcgtcaaccgtctcaacgccaagaagggcgacaccgtggagtttccggctgccctcgtggtggacggctccaaggtcatcctcggtgccaaggatctcgccaagctcaccgtcaaggctgaggttgtcaacgatgaggccaagggtccgaagatcagcatcatgaagtacaagaacaagaccggcgttgctcgtcgcaagggccatcgccagcagctgactctcgtcaagatcacggctatcgcctgattcgcgtagggttagagtcaaggaccgaaaggaacagacatggcacataagaagggcgcgtccagctcgcgcaacggtcgcgattcaaacgcgcaatacctcggtgtgaagaagttcggcggcgaagccgtcgtggccggcaacatcatcgttcgccagcgtggcaccaagttccacccgggcgagaacgtcggcatgggcaaggaccacaccctgttcgccctcaaggacggcagcgtgaagttcggcgtgcgtcgtgaccgcaaggtcgtcgacgtgattgccgcctgagacacgcgcaaataacgcttttgatgaaagaccgcgcccatatggacgcggtctttctgttatgtaaggtagatacatgagtgattttgtggatcgagtgaccgtccatgtcaagggcggcgacggcggcaatggttccgccggcatccgtagggagaaatacaagccgttggccggcccgaacggcggcaatggcggcgacggcggttccgtgatcttcatggccgattcgaacgccaacagtctgcttgattaccgtttcatgccccaccgggaggcggaaagcggcacgatgggcctgggcgacacgaaggacggttcgaagggcgctgacctgatcctgcccgtcccggtgggcacggtcgtgttcgaagccaagggaccgcagggcaagccgaagcatccaggcgagcagctcgccgacctgcgtcatgcaggagacaagttcgtcgtggccgcgggcggcaacggtggtcttggcaatgcggcgctggccaatcgcacccgtcgtgcgccgggcttcgcactgctgggcgagccgggcgaggaacgtgacgtcatcctcgagctcaagtccatcgccgacgtggcgctggtgggctttccgtccgcaggcaagtcgagcctgatcgcggcgatgagctccgccaaaccgaagatcgccgactatccgttcaccacgcttgtgccgaacctcggcgtagtggtggccggcgacatgcgctacaccatcgccgacgtgccgggcctgattccgggcgcatcccagggcaagggcctcggcctcgaattcctgcgtcacatcgaacgtactgaaatcatcgcccacgtcatcgattgcgccaccctcgaacccggccgtgacccgatgagcgactaccaggcgctcgaacacgagctcgccgaatacgccggcaagctcgaactgccgctcggcgcgattccgatccccgaacgtccgcgcatcatcatcctcaacaaggtggatgtgccggaagccaaggaactcgccgaattcgtcaagcccgaattcgaaaagctcggcctcaaggtccacatcatctccaccgcctcccacgagggcctgaaggaactcaactgggcgctggccgacctcgtgaccaacatgcgcgcggaagtcgccaaacgcgagcaggccgaggaagaggcccgcgtggtcatcaagccgctcgaggagccgcgcaatcgccgtcgccgtaacgacgaaggcggcaacgcgctcgacttcaccgtggaacgcaaggagaacggcaacggcgaagtctggtacgaggtgctcggcaccaagccggaacgttgggtcatgcagaccaacttcgataatgacgaggccgtcggctaccttgccgaccgtctggccaagctgggcgtcgaagacgagctgcggcacaagggcgccaagccgggcgacgaagtgcgcatcggccgtggcgaccgtgccgtggaattcgattgggatccgaccatcgcggccggcgcggaaatgctcgacggcacccagttgggcgcacgcggcgtcgacctgcgactgcaggaatcggatggtcgtgcgcagcgtcgttccaacacggaacgccgtcgccagtaccacgagatgatggacgcccgtcaggccgtgcgcgaagccatgatggccgaacgcaaggcaggacactgggccgatccttccgtggacgacgaccgtcacgacgaaaccagtctttttggacgtggcgagaccgccgacgacgaggatgtggaacaatagaaccatccaacgaagcccgctgatgtgccgatggcatgtcggcgggctttttcaatagccggtaacggtaccgggaggaactatgaacacgccatcgcaagcgcaagtgcgcagggccatcgccgaagcgcagaccatcgtggtgaaggtgggctccagctcgctgaccgagccgagcggccacttggatccgcaacggttgaacgcgcttgtggcggccatcgcccgcgtgcgattgatgggcggccgcgtggtgctggtctcctccggcgcgatcgcggccggtttcggcacgctcggtttcgacaagcgtccgaccgacgtagccgaccagcaggcgtgcgccgccgtcggccaaggcctgctgatggcccagtatgaggccgctttcgcacggtacgggctgcgtgtcggacagatcctcatcaccgtttccgacacgatcgccccacagcagtaccgcaacgtgcgccgtacgctcgaccgcctgctcgacttgggcgcggtgccgatcatcaacgaaaacgattccctcgcgtccaacgagatccggttcggcgacaacgaccgtctgtccgcgctcatcgccaacatcgtcgtcgccgacgcgctcgtcctgctcaccgacgtggacgcgctgtacaccgcgccgccaagcgagcccggctcgaaacgcatctcctatgtgccgaacgtcgaggacgcgctggcgaaggttcaggtcggcggaaccggctcgaacgtcggcaccggcggcatggtcaccaaaatggaggccgcgcgcgtcgccgcggtgtccggcattcccgcggtgttgacatgcgcgtcgaacgcaggtcccgcgatgatgggcgatccggtcggcaccgcgttcgcgccgatcaacgaccgcggttcgtcacgtaggctgtggattggcttcgcctcccacccgcagggcacgctggtggccgattccggcgcggccaaggcggtgcgcgggggagcggccagcctgcttgcggccggcgtggtggaagtgaagggcgatttcgccgccggcgacgccgtctgggttgacgacgagcagggcaaccatttggccaagggcctggtcggcttcgactccgaggagatcccgcagatgctaggacgcaatacggcccagctcaagcgtttcctcggcgaggaatacgcgcatccgctggtgcaccgcgacaatctcgtactggtctgagccagtgcaaaaggtgtggttaggccatcgatttcgcttcaagcgaagcgttcgcggcgaaatagacgtgtgtcgtggggctgtcgtttttcgcgtggcaggtctagcattacaggcatgactatggctgactggcagactctatccgaccgtatcaatcacgtggctccgagcgctactctggccgtcgattccaaggcgaaggcaatgaaggccgccggaatcgacgtcatcgggttcggcgcgggagaaccgaacttcccaacccccgcaccaatcgtcgcggccgcggccgcggccgtgcaggacccgaaaaactaccgttacacgccgaccgccggcctaccggaactgcgccaggccatcgcggacaagacgttgcgcgactccggctacgaagtcgatccaagccaggtcatcgtgaccaacggcggcaagcaggccgtctacgaatcgttccagattctgctcaacgagggcgacgaggtcatcatccccaccccgtactggaccagctatccggaagccgtgaagctcgccggcggcgtgcccgtgaccgtgttcgccggcgccgaccgcaacttcgagcccagcatcgaagccatcgaagcggcccgcaccgaacacacgaaggccatcatcgtgaacacgccgaacaacccgacgggcgcggtgtggaagccggaaaccgtcaaggccatcgcgcagtgggccatcgaacaccacgtgtgggtcatttccgacgaaatctacgaacacttgaactatgacggcgccaaaaccacgtacatcggcgccgcggtgcccgaagtgcgctcccagctgctcgtgctcaacggcgtggccaaaacctacgccatgccgggctggcgcgtcggctggatgatcgcccccgtggacgtggccaaggccgcatccaaactgcagggtcacatgacctccaacgtgaacaacatctcccagcgtgccgccatcgaagccgtctccggctccctggacgccgtctacgagatgcgcgccgcattcgacaagcgccgccagaccatcgtcgccgcgttgaacgacatcgaaggcgtgaactgcccgactccgaccggcgcgttctacgcgttcgccgacgtgaccgcgctgctgaacaaaccgatcggcaccaacaagaccacgttcgccaacacttccgaactggccgccgcgttgcttgacgaaggccatgtcgccgctgtcccgggcgaggcgttcggcgctcccggctatctgcgcttctcctacgcgcttgccgacgacgatctggtcgaaggcatgcgtcgcatgaagcgttggatcgaggactgagccgaccggccccgcgctcaactgacggaaagttcagttgatagacgatatttttagcgattcgcgcttcggtgacatgccgggcgcgaatcttttttttcgttggaaaatagcggtttcttgcaattcgtcgtgaatcgggttggacgaagtcgcgaaaacccgctattatttcgacttggcggttttgccgtctgcttcttgcgtggttttgcatagaatcctcgccggcaagtggagacggcagagttcacctagggaagtggcgcaattggtagcgcaacggtctccaaaaccgtaggttgtgggttcgagtcccgccttccctgccaagcttcttacaacaagcccagcggaggattattatggcgaaggcgaagaacagcgagaaggccattaagccgaacatcttcatgcgcattggcttgttcatcaaacagattatcgacgaactccgcaaggtcgtcactccgaccagcaaggaactgttcttctggtccctcgccgtgtttatcttcgtgctgctgctgatggcactggtcaccggcatggactacggtctgggcaagctgaccctgtggatattcggctgataaacaacttgaaggtgaaagtgcatgactgacgaagtgttttccgacaacctcgacgaggcttccaaggctgataccgaggctgctgccgctgttgaggcgctgccggccgaaggcgaggccgtccaggccgtcgccgccgatcaggcgaccgatgagcaggcccagtccgagcaggacgctccggaagagcagaccgcggaaaccactgaggatgaagacactgagcaggatgccggtgccaaggccgtcgaggaattctccaagagcctgcgcacgcttgaaggcaagtggtatgtgctgcacacctattccggctatgagaagcgcgtgaagaccaacgtcgaatcccgcgtggccagcttcggtatggaagacaagatcttccaggtcgaagtgccgatggaggaagtcgaaaagcacaccgaaaaaggcaagaaggtcatcacccgcgtgcgtgtccccggctatgtgctgatccgcatgctgccggatgagaacgcccgtcgtatcgtccgcgagaccgaaggcgtcaccggctttgtcggcccgaccaaggatccggcaccgctgacccgcaaggaagtcgtctccatgatggctccgatgatcgcttccgaagctctcaaggccgccggagacaagccggctgcagccaagaagcgcaagcttgaggtctcctacgctcctggcgatcaggtcaccgtcaccgatggaccgttcaccaccatggccgcggttgtctccgaagtggatccgtccacgcagaagctcaccgtgctcgtgtccatcttcggccgtgacacgccggtggagctaggcttcaaccaggttgaaaaattagcctgaacgtgcatgacggagcgttagctgcgttgctccaagcttgacgcaccttggtacgcctgcgcttgggcgccttgctaccgcacgcgtcacacccattcaggaacctgaaatcgtgattcttttgaaccccgcttcggcggggtttctttgtatgtattgccatacgcgcaatgtcgtggcggaatcgcataatagaaaagttgtgtctggagggtctcgtgtgcctggacaaggcggcggcacctgctagcacagcacagcaatatacgttgcggaaggaaccggacgcgggagacctactccggtgccgttaaccaccgcttcacagaaagaagaaccatacaatggctcctaagaagaaagtctcggcgcttctcaagctccagattcaggccggcaaggccaacccggctccgccgctgggcccggctctgggttcccatggcgtgaacatcatggacttctgcaagcagtacaacgctgccacgcaggacaagatgggccaggtcatccctgttgagatcaccgtttacgaagatcgttccttcaccttcatcctgaagaccccgccggcagcagctctgctgaagaaggccgctggcatccagaagggtaccgagaacccgctgacccacaaggtcggctccgtcaccaaggctcaggtccgtgagatcgctgaaatcaagatggctgatctgtccgcacgcgacgtcgaagccggcatgaagatcatcgcgggcaccgcccgttcgatgggtatcacggttaccgactgagaggagaaggactaatggtacagcgttccaagaagtatcgcgaagcggctgagaagatcgatcgcaacaacctttacaccgccaacgaagccatcgctctcctcaagagcatgccggagtacaagttcgaccagaccgttgaggccgtgctgcgcctgaacgtggatccgcgcaaggccgaccagctggtccgcggttccgtgaacctgccgaacggcaccggtaagaccgccaaggtcctcgtcttcgcccgtggcccgaaggccaccgaagctctcgaggctggcgccgacatcgtcggtgacgacgacctcgtgcagaaggtcgccgacggtttccttgacttcgattccgtcgtcgccaccccggacatgatgggcaaggtcggccgcctcggccgcgtgctcggtccgcgtggcctcatgccgaacccgaagaccggcaccgtgaccatggacgtcaccaaggccatcaaggacatcaagggcggcaaggttgacttccgtgtcgacaagaacggcaacctgagcttcctcatcggcaagatgtccttcaccgagcaggctctggacgagaacttcaaggctgtggccgacgaagtcaagcgtctgaagccgtccaccgtgaagggccgctacgtcaccaaggcgaccatcacctccacgatgaacccgggcgtcccggttgatccggcggtcgttgcctgagtgcacagaagctaaacttcaccaaaagacccgtatctgcaatcgcagcatgcgggtcttttcatatgttcggaaagattcatgactttatgaccggatgacaggtgcaacgggcgtacccagacgccacaccacccgggcagcggctcagcggtcgcgcatacggccaatcgccagcgcggtcgtcagcacatacgcgtcacgcggatcggtggcatcccagccggttgtttcggcggcacgcttcaagcggtagcgcacggtgttcggatgcacattcagctccttcgccgtgttctccaacgaactgccatacttcaggaacgtggacaccgtcagataagtgggatcatcgggattctcgccgcgcagcacctgatatacgttccgatacagttcttcacgcgcgtaatcatcacccagcagcgcacgctccggcaacagctcgtcggcacgcagcggacgggaaggagtggacagcgccggagccgcctgcagcgagaacatcgtctcacgcaacgcatgcgaagcccccgccacaccggaacggaccgggctcaaatacagtggctcgtcctcgctgaacgccggcatgaccgcggtacaggtcacctccggcgtgaccgcgcccatctggcaagccaaagccagcaggaaagtgccgtacgtgccgatgaccacatgctcgccacccaaatcgcgcaccgccttgcggatggcgagggatgtcgaggcaagactggccgaaggcaccccgccgatcgcaaaacagttgaaatcgccttgccatccgagaatgttcatcaaggagaccacacgatcgtcggtcatgttcgtcaacaggcattcgaaagccaaccgctcgatggtcgtatcgtcggtatggcctgacaaaaggtcgaggatgtctgcctgctcggagttcataaccgtccattctaatcgtcgtatctgcgaattgccgcacgttcgccgaccgttccggtccccattcgcgcagtggcggtaatatgccgactatgagcgaaaacaagaaagccggaaaagccgacacgttcctcagctggacgttgggcgtgctcgcatgcctgtgggtggcgtggtgctgcggcatcggcccgctgtactggtttggcaccggactcgccgacttcggctgggccaacgtgctgtacatggcgatcgccttcgttgtttcgtttgctatattgtggtcgctggtccgttacggccgtggcgagcgcgtgctgccgacgtatttctcacgtcggtacgtcaagctgtgtcaggaggtgtccggcacgccgacgacggtattgggcatcatgctgcgccatctgagcgacgccgcgcatagccgtccggggcgcgccatccatgcggtgatcgtctggattggtcgcaagctgacacgttgcaccgactgctggtggaagctcatgctgctgttcgtcatcggctggctgtggattccgaccatcctgcttgccgcgtacggcgccgacatccgctcccagatccgcgaattcagctgggcgttgaaccagtggaccggactgaaacagccgtacatcggcttcttctcattcgtgccgatggacatctatccgaccgcgcattacatgtggccggccaatcccacgtatctgaccgaccagcacaacatcgtgctgaccgttttctacggtgcgttcgccgcggtctcccggtatttcaccgattccaacgacgccggcatcgtggcgctggccgcgctgcaatggctgttcgccgcgttctgctgcgccgccaccgccaatcgtttcttcaatctgccgtggcgtaggctgggcgtcggcacgttcgacttctcccatcccgaacggcacgactgctggaacatgcgcgatttcacccatcccgaggcgggtgtggtggcgcgtccgtccagactgcgcgccggcgcgaagacgcgtttcgtgattctgctgttcttcatggtgtgcccgttggcggtgttcgccacgatctcactgaccaaatcgccgttgttcgcgttcgcgttcgtctggtggttcggcgtgtggtatgagctgcatatgacgcatatcaaggcgctgcccaccatcaacggcaagcccatgaaactgcgcaaacgttccttggcggcactgttcatgtcgagctgcgtcatgctgatcagcgccaaatacgcgtggtacatcattctgttcgccgcgctgctggccatcatcaacgaccgtaaacgttggaagacgtacgtggtcgcattgatgctgccgaccgtgctcatccatggcggcctcgtctatctggtgaacagcggtgccgtcatcggcggcgatccgatcgaaagccgtggcatccagctgcagcagatcgctcgcgtggcgaaatacaatccgcagggcattcccgaggacgcggccaagaaactcgctcccgtcttcaacctcgaccagatggccgaatcgtacttccagcaggacgccgacccggtgaaatcgtcgggtatccagtccaagaaggtcagctacaagtggcgtaccgtcaccaaggacgacatgaaggatttcaatgacgcatggtggcagatcgtcaaggcgaatcctcagatcgcgctcgatgcgctcttcgccgaatgcttcggatacttcaacgtgaccgacctgccatacgtgtcgatggactactacgtgaacaacgattacgtgcagtccgacaacgaatggattcacctgtacaaccaccagtggcgcaaccaggtggccggctttgccaagaaatgggggcagattcccgtgcttggctgggtgacgcacggcaacctgtatgtcacgctgacactgctgatcggcgccgccgaagtggtgctgcgtcgatggcggtcgctgtcatggcatctgccgttgctgctgcttatgggtgtgatgatcaccgcaccggccaacaatttcgaacggcatatgcttccgatcgcattcgtgttcggattcctgtgcctggagttctggcgcgagtcgcgtgccgcgcggcttgccgcacgcgaggcgtcgtacgttggcacgtcgacggcgggcaaacggcgtatcggcgggcaccgaatcgacagatagcagtccgacaagcaggacgccgacgaacgatatctcgatggacgacagctcgacggacaggagaaggaatcatgacgaccatattggattccgcattgaccatgccacgcacctgcgtcgcggccgaccaggtgatcgcgctggactcagtgggctccaccaacacgtacgccgccgaattggtgcgcaaaggcgcgctgttcggctcggccagacgagatggcctcgatggctgcgatggacgcgattggaccggccgtgaaatcgtggcgatctgcgccgacgagcagaccgccggccgtggccgtctcgaccatcaatggaccagcgcggtgggggagtcgttcatcgtctccctggtggtcagcgtgcctacggcgattgtgcgggacacgtccgtcaacggctggctgcagatgatcgccggctgcgaggcgcgcaacgcgattatcgcggccatccgcgattgcggcggcccgctcggcaaggacatcgtgctcaaatggccgaacgacattttcgtcgacggcaagaaactgggcggcgtgctcgccgaaatggttccgcttgccgcaactcccatcgcggacggtgcgactggtaccactgatgtggctgccgcaacggaacgcgtcggcatcgtcttcggcatcggcctgaacctgaccgtccccgaagaccatctgccaaccgacaaggccacgtcgctgcagctggtcgcgcatggcctgcccgattccatgacattgcgcgacatgatcgcggcccatctggtggacggtttgcgatcaaggctcgccgatttcgaagccgacccgcatcgcgaggccacgcgtgcgatggaggagatgcgtccggtctgctggacgctcgacaagccatgcgaggcgcatttcgtggacggcaccaccctgcgcggcaccgcgctggaactcaaccccgacgcctccctcaccatcagagacgacaacggcaacctgcacaccgtgcacaccgccgacgtaggcgtcctaccccaataattctctaaccctcatccctcataaagtcgtaaagcgctttttcgaaaatcgcacgtttcaaaaaaacgcaatattcgagaaaaacggcatttcccaaaatcgcaatatccaaaaaccgcgccacccgcaaacgcaacattcccccaaaacgaggtggggccggcggataccaacgtaagaccgtaaaaaactcggcctgagcggcccggagcgtgtcgcacgttggtatccgccggccccaccggacacagcgaaaacgaaaatcacagcgaaaacggaagactgtatcaaaacccggaaatcacgaagaaacccggaaatcacagcggaaattctcagcggaaaaccctcagcagaaaattcccagcaaaaagtcgtagaaaactaccgcagaaaagtcgctgccgataaaagtcactgcagctttgccagtccactcgcgaccaacgaagccacaaccgccttgatgcaatcgcccacaatgaagcccatcgaagcgatggccaccaccggcatcgccacgcccgtaatggcggactgcacgatgaagccgagcagatagtcaagcacgatgcagccggccacgcaggcgaacagataccgtgcggcggtcaacgcagcatgcttcggggaatcgacacgcgccttgcccttgagcagcgaggtgacgacggcggctggcaggaaaccgatgaggaagccggcgctcgggccgaccaaagccatggtggacgcgccgccggcgaacaccggcagaccagccgcgcccgcggccagatacatgagcaccgcggcgcccgcctgcttccacggcagcatcagcgcggccagcatgaccacgaaggtctgcagggtgatcggaaccggagtgcccggaatcggcacggcgcccgccatggaggcggcggcgagcagcacggcgaacagcgtggacttcaaaacggcgccgaatttgccgctggtggccgttttggctgcggatgagatggtcaggattgcgttgcgcatggtggaatcctcccttttttgcggatgctacaggatgctacaaaaagtgacgaaaatgagtctttcgtcaatcaatgctccccatcgtagggttgctaagtttcggtaacgtttgtggagccttacaaaaagattgcgaatcttttgtgggaaacgagttcgtcgaatcacgcctcgaccgccaaacttgacattatgcctaagaatgtcaacaaactactggtggcgaatcgcggcgaaatcgcgcttcgagtcgtgcgcaccgcacgtgagatggggattcccacggtcgcggtctacgccgaacaggaccgtcacgcacagtacgtgcagatggccgatgatgcgtatctgctgtctggcgacacctacaaggacacgtatctcaacgaggatctgctcatcgacatcctgcagcgcagcggtgccgacgcggtgcaccccggctatggcttcctttccgaagtcgcaagcttcgcgcagaaggtcctcgacgccggcgccacgtgggtcggcccgaatccgaaggcgctcgtcgacctgggcgacaagatcacggcccgccgcgtggccactttcgcgaaggtgccgccggttcccggcatttcccagtcgatttccgacatgcgactgctgctcgacttcgcgcacacgcacggctatccgctgatgctcaagcgcaccgacggcggtggcggccgcggcatcacgctcgtgcacaacgacgacgagctgcgtggcttctacatgaaccacgatgcgctgcagggcggcgatttggacgagtatttcgtcgaacggttcatcgacaagggccgtcacgtcgaaacgcagtgcggacgcgattcgcacggcaatttcaccgtgtattccacccgcgactgctccgtgcagcgccgcaaccagaagcttgttgaggaagctccggcgtcgttccttcccgacggcgtgctcgaacagctggaaacctattcccgccgcctgttcgacgcggtcgattacgtaggacttggcacctgcgaattcatggtgaccgagcagggcaaggtctacttcctggaagtcaatccgcgtctgcaggtggaacacaccgtcagcgaagaggtctgcggcctcgatttggtgcgagaacagctcaccatcgccaacggcggcgagctaaccgtcgaccacccgctgcgcggacacagcttcgaactgcgtctgacctgcgaggatccagccaagaacctcgcgccgagctccggcacgctgaccaagctcgcatggccgtccggcccgggcatccgcgtcgattccggcgtggtggaaggcgacaccgtctccccgaagttcgattcgatgatgggcaagctcgtggtcaccgcctccgaccgtgcgacagccgtggcacgtgtgcgccgcgcgttggaagagctcaaggtggaaggcgtgccgaccccggcaagcctgttcgagcagatcttcaacgacgacgagttcaccgccgagcatggcgtggcctacgacgtgagcacgaaatggctggaacgcaagtacctgaacaaggaagcatcctccaccaagggcggccagccggcatccatggccggcgcttcgggtgcgaaggaagccgagcagaaggaatccagcgaaaccttcgtcatcgaagtcaacaaccatcgtgtgtcgctgaccgtgccgaacgacatcgtggccaacctgaccggcggcgccaaggcgcgtgacgccaagcgcgccatccagccgctgcgcggacagggcctgcaccacgtcgaaaagaagcagcagggcaacgacggccagtccggtgtgatcgccagcccgatgcaggcggtcgtcacacgcatcaacgtcgtcgaaggccaggacgtggccaagggcgacctgctcgtcgtgctcgaatccatgaagatggagaactacgtgtacgcgccggtcaagggcaccgtcaccaagatattcgtcggcccggcggcaggcatcgaagcgggcgagacgttgatgaccattgacgtcaacggcgcttccaaggcggctgacggcaagccggcaacggacggtaatacggaaaccaagacggaaggcggcgcgaaatgaccgacatcatcgcaagcccggccgtcaaagaggccgtgaaggtcgtcatggaacagcaggagcgactgggtgacgaagcggctgccgaagcccgcgaatcgcagccgatccgtacgtccgtgctgcgtgccgcgcagctcgccgccgaagccgaagaccatgcccgcggtcgccagcacgtcaaaggcaagctgaccgcgcgcgaacgtctcgatctgctgcttgataccggttccttcgaggaaatcggccgtttccgcggcggcgacatcaacggtggccgcgcaggctccgccgtcatcaccggcttcggcgaggtgttcggccgcaaagtggccgtctacgcgcaggacttctccgtcaaaggcggcacgcttggcgtggccgaaggccgcaagatctgccatctgatggacaaggcgctcgacctcaaggtgccgatcatcgcgctcatcgactccggtggcgcgcgcatccaggagggtgtggccgcgctgaccgaatacggccacctgttccgcaaaacctgcgacgccagcggtttcgtgccgcagctatcgctgatcctcggcccctgcgccggcggtgccgtctactgcccggccctgaccgacctgatcatcatgacccgcgagaattccaacatgttcgtcaccggtcccgacgtggtcaaagcggccaccggcgaagtgatcagcatggacgatctgggcggcggctacgtgcacaacgccacgtccggcgtggcccactatctcggcgaggacgaggcggatgcgatcgactacgcgcgtaccgtgctcgcctatctgccgtccaactctgaccagcagccgccggtctacgcgtacgcggccacccgcgccgaccgtgacgtggccaaacgcctcgccaccctcgtgccggacaacgaccgccagccgtatgacgtgctcgacgtgatccgctgcatcgtggactacggtgaattcgtgcaggtgcacgaactgttcgccgcttcagcggtggtcggcttcgcctgcatcgacggccatcccgtcggcatcgtggccaaccagccgaacgtcaacgccggcattctcgacgtcgactcatccgaaaaagtggcgcgattcgtgcgcttgtgcgacgcgttcaacctgccggtcgtcaccttggtggacaccccgggctacaagccgggcgccgaacaggaacatgcgggcatcatccgccgtggcgcgaaggtcatctacgcctacgccaacgcgcaggtgccgctcgtcaccatcatcctgcgcaaggccttcggtggcgcatacatcgtgatgggctctaaatccattggcgcggacatgaacttcgcctggccatccagccagatcgcggtgctcggcgcggccggcgcggtcaacatcatccaccgcaaggacctgcagaaagccaaagacaacggcaaggacgtcgaagcgctgcgcgccaagtacatcgccgactacgaacgcaccaccgtcaacgcgaacctttcgctggaaatgggcgagatcgacgccatgatcgaccccgaacagacacgcgagaccatcatcgaatcgctccgcctgctcgccagcaagaaacgcgtgcgccgaaccagcaaacaccacggcaaccagccgctgtgacggacgcaacgcgacgtaaccaacgtaagcaaccacaacaatcgcaagaaattttggaacaagtaaggaagattatgaacaccttttttcttgatcgactgaacagcgagccccacgcgctcgccttcgccggccaatccaccccgtggccggtggcgctcgccgaccagagcgcgaatccggcgctcgacgaggtcctgcacacccatgcggccgccgcgcaggcgctgctgtatccggtgtccgccgagctgctcgccaccaccggacgcccggtcgacctgttcggcttcgaaccgaacccggcacgtctgggcgccgcagccgcggcttccgccagcgttcccggcatcgcgctgacccagctgggcgcgctgctcgacgccgccgcactcggctacaatccggcccaggccaagccggtcgtggtgctcggccactcccagggcgtgcttgccgtgcatatggtgcaggcgatctgcgaagccggttccatcgacgcagccgcagccaagatcgacgagattcttgcgatcgcaacgctgatcggcgtcgccggcacccgtcaggcacgccagctcggtctcgccgcacgccacggcgaggcgaccccgatgctgtccgtcaaggacatcacccgcgcccaggtggacgcgctgatcgaacgcgtcgacggcgcacgtggcccgatcgccgtggccgtcaccaattccgccacgcattacgtgttgtccggctatccggaggacctggccgcattcggcgtggaggtcgccaaggaacacaagcgtcaggccaagctgcgcgaggagaaggtgcgtggcggccgcgtgttcgacccgacgctcgaatatctcgacgtgaccctgccgttccacagcccgctgatggccgatgccgtctcccaggccgtcgcatgggccgaggcctgcggcatcaacgccgaccatgcccgtgagctcgccgccgaagtgctgctcaaccatgtggattgggccgcccgcgtgcgcgccctgatgaagtccaccgatccgagcgccctgtgggtgctggacttcggtccgggcaacaccgtcggcaaactgttctccaccgtggcccagggcaccggcgtcggcgtggtggaagcctccaccgtggccgatcgcggcgcgctctccacgctcgagaccctgccggaacgcacccagaactggacgcgtttcgcgccgagcatcatccacacgtccgccggagacaaggtgcgcaccgcgttcaccgaacttaccggcaaggctccggtgctgctggccggcatgaccccgaccaccgtggagccggagatcgtggcggctgccgccaacgccggctactgggccgagctcgcaggcggcggccaggtcaccgccagcgtgttcgaccgtcacgtggccaagctcgaggaggaactcgaggaaggccgcaccgtcgaattcaacgccatgttcatggaccgctacctgtggaacctgcagttcggctcccagcgcatcgtgccgaagaagcgtgccagcggcaccccgatcgacggcgtcgtcgtctccgcaggcattccggaattcgacgaggccgtggaactcatccacaacctcaacgccgacggcttcccgtacgtgagcttcaagccgggcaccgtcgaccagatccgccaggtggtgcgcatcgccaaggccgtcgcgccaaccaaggtgctcatcgaggtcgaaggcggttccgcaggcggccaccactcttgggaatcgcttgacgatctgctgctgagcacctacgccgaagtgcgcgagcaggccaacctcgtgctcgtggtcggcggcggcatcggcacgccggaacgcggcgccgactacatcaccggcgaatgggccgccgaatacggccgtccgctcatgccggtggacggcgtgctcgtcggcaccgccgccatgaccgccaaggaagcgcacaccaaccctgaagtcaagcagatgctcgtcagcactcctggcattccggccaagggcgacgacaatgatccgttcgccccgctgggcgagcagtgggttccgtccggacaggccaagggcggcgtcacctccggtctgagccacctgcacgccgacatctacgagctggagaactcctccgcccgctgcggccgcctgctggtgcgcgtcatgaagcacccggaggagctggaaagccgtcgcgacgagatcatcgcggcgctgaacgccaccgccaagccgtatttcggcgatctgaagaccatgacctaccttgagtgggcccagcgtttcgccgacctctccttcccgtgggtggacgaaacctacgccgatcgcttcctgcacctgctgcagcgcatcgaagcccgcgtcaccacgcaggaaagcggcgaattcgcatcgctgttcgcttcccgcgccgacgtcgaagccgatccgaacgccgcgatcgccaagcttgccgaaacctacccgcaggccggcaaactgaccgtcaccccgatggacgaggcatggttcccggtgctcgtacgcgagtatccgaagccgatgccgttcgtgccggtcatcgacaacgacctgctgcgttggtggggccaggaccagctgtggcagtccgaggactcccgctattccgccgattccgtgcgcatcatccccggcccgatctccgtggccggcatcaccaccgtggacgagccggtggccgacatcctcggccgcttcgaagccgccatggtcaagcgcgtgtccgccgaatcggcgagcgccgacaagaccgccttcgcccagttgggcgcggccgtctccgccgaggaattcatccgcaaatccccgaacatctcctgggtcggccacctcatggccaacccggcgtacggcaccgccaacggcgacgccaactacgagatccgcaaggtggccgttgaaggcagcgtcgaaaagtacgacctcgacatccatctcgacaccttctgggacaacgatccggacggcggcgcctccaagcacgccgtacgcgacatcgtcattccgctgaacgtcgacggcaacgaatccggcctgttcccggtcgtggaccgcgaccgtctgccggagcacgtctaccgcatgctcgccgacaccgcgggcatcggcaacaccgccatcaccggcgacaagctcaccgccatgccgcagatcgaggaagtgtccgacaagaccgccttcccgttcggccaggcgcacaccggctacacgctgtccgccaacctcggtttcgaccatgaggccgccaccggcggcgcgctgccgagcgacctcgtgccgtcccgcatcgccccggacgcgctcgtcggaccggcttggcccgccatctacgcggccctcggctccgtgtacgtcaacggcttcccggtcatcgaaggcctgctcaacgccgtgcatctcgaccacctcatcgaactcgaggtgagcgaggacgagctgctgaagcacaccggcgagcgcatcgagctcaccagctgggccgacgactacttcgaatccgcttccggccgtgtggtgaccatccacgtcacgcacaccgctcaggacggtacgctgcttgccaacgaaaccgagcgtttcgccatccgcggccgcgcgtactccgacgcgctgccgccggaagcgcccgactatggtggaatcgaagccgaaatcgaaagcactccgcgccgtctgctgcgtcgtgtgaaggtcgtcgctccgcacgagatgaccgctttcgcccgtacttccggcgatttcaacccgattcacacctctcatcgcggtgccgccgtctccggtctcgccgcgccgctcgtgcacggcatgtggctgtccgccaccgcccagtacgcggtgcaggcgctcgacgagaagggcgcgcattacgagatcgcaggctggacgtacaacatgtacggcatggtgcagctcgacgacgaggtggagatctccatcgaacgcgtcggccgtgtggcccacgccggcatggtgctggaagtgaccagccgcatcgacggcaatatcgtgtcccgtggcaccgccatcgtgcgtgcgccgaagtccgccttcgtctacccgggccagggcatccagaagcagggcatggtgctcgacgagcgtgccaagtccccggccgcacgcgaggtgtgggagcgcgccgacaaggtgacccgcgagaagctcggcttctccatcctcgccgtcgtgcgtgataatccgaaggaactgaccgccaacggcgtgacctaccgtcatccggaaggcctgctcaacctgacccagttcacgcaggtggcgctcgccaccgtggcgttcgcccagaccgctcgtctgcgcgaagccggcgcggacatctggcccgcctacttcgctggccactcgctgggcgagtacaacgcgctgagctccttcgcaggcgtgattccgctggaaaccgtgctggagctggtgttccaccgtggctccaccatgcaccacctcattccgcgtgacgagaagggccgttccaactaccgtatgggcgcgctgcgtccgaaccagttcggtgtgggcgacgacggcgtgcgcgaatacgtcgaatccgtttcgaaggcttccggcgagttcctggagatcgtcaactacaaccttgccggacagcagtacgccgtggccggcaccatcgccggtctgaaggcgctgaaggccgattccgcccgtcgcgtcgccgaatacggcggcaagccggcgttcatgctggtgccgggcatcgacgtgccgttccattccacgctgctacgcaagggtgtgccggagttccgcgacaagcttgacgcgctgctgccgaagcacatcgactaccgtggccgtctggttggccgttacattccgaatctggtggccgtgccgttcgagatgaccaaggaattcgccgcgaagatcctcgaggtcgtgccgtccgagcgcatcaaggccgcgttggacgatccgaaggtgtgggattcctacgccgaggacgaccagaagctcggccgtctgctgctcaccgaactgctgagctggcagttcgcctccccggtgcgttggatcgaaacccaggcgctgctgttcggttccgccgaacagggtggccttggcgtggaggagtacgtcgaggtgggtctcggcaacgctccgacgctcgccaacctcggcgccaagacgctgcgcctgccgcagttcgccggccgtgacgtgaccgtctacaacgtcggccgcgacgaaggccgcgtctacatgaccgattccgattccctcgttgccgacgacgatgctgacgattccgtcgcagcaccggcagcagcttcggctccggccgctgccgccgcagcgcctgccgcggtcgccgcagcacccgtcgccgcagccccggctgccgctgcaccggtcgcacctgccggcgctccgtccggcgccgcagtcgcggatattccgttcaacgcttccgacgcgatcgccatgctgctggcatattcggcgaaggtgcgtccggaccagatcggcgaatccgacaccaccgacaccctgaccaacggcgtctcctctcgccgtaaccagctgcttatggacatcagctccgagctgggcgtggcttccgtggacggcgccgccgaagcgaccgtcaaggcgctgagcgcgctggtcgacaaggtggccccgaactacaaggcgttcggtccggtgctgtccgacatcgtccgcgaccgtgtgcgcggcctgttcggcgccgccggcgtgaagctcggccagatcaccaagcgcgtgaccgacacctggcagctcggcgaaggctgggcctcccacgtggtcgcagcccttgtgctggaaacccgcgaaggcgccagctcccgcggtggcgacctcgcctcgctgagcaccgaagccgcttccaatgcggccgccgccaacgcgctgatcgacgcggccgtgcagaaggtcgcttccgacaagggcgtggccgtcgccatgccgagcgcaggtggcgcagccggtggcgccgtggtcgattccgcagccttggacgcgttcgcggccaaggtgaccggtgccgacggcgtgctcgcctccaccgccaagttcgtgctgaaccagctgggcgtcaccgcttcggtcgccgacgattccgccgacgagaacgccgccgtggtggccgccgtcgaagccgagctcggctccgactggccgaagcaggtcgagccgcgcttcgacgagcgcaaggccatcctgttcgacgaccgttgggcatccgcacgcgaggacctgtcccgcgcctactacgacaacgacgcctccgcactggacggcagcttcatcggcctgggcaaggccgtcgccgacgaagccgcatggtatgcgggcaagaccgctgacgtcgagcttgccgccgcgttcaagcgcgtggccgacgaggcgctcgagcagacgaacgattccgccgaagcaagccgcttcgcaggcgatatcgccgtcgtgaccggcgttgccccgaactccatcgcagcgcaggtggtcaacggcctgctcgccggaggcgcgaccgtcgtggccacttcgcacagcttcaggcagagcgtgaaggcctgggccaagcagacctaccgcgagcatgcggcaggcgacgccaagctgtggctcgttccggcgaacctgtccagctaccgtgacgtggacgctctcgtggcgtgggtcggcaacgtgcagaagaagacctccggcgcgaccaccacgatcctgaagcccgcctacgagccaagcctgttcttcccgttcgccgctccgccggtgcacggcacgttggccgattccggcgagctgttcgaatcgcaggcgcgcctcatgctgtggggtgtggaacgcgcgatcaccggcttcgcgaagatcggcgccgacaccgacgtgcagcacaagctgcatgtgattctgccgggctccccgaaccgtggcgtcttcggcggcgacggcgcgtacggcgaggtcaagagcgccttcgacgcgatcgtcaaccgcgcccgcgccgaaaaggtgtggtccagccgcgtcaccttcgcccacccgaaaatcggctgggtgcgtggcaccggcctgatgggcggcaacgatccgctggtcgaagtcgtggaacgtcacggactgaagacctactccaccgccgaaatcgcggtcaagctgctcgagctgtccaccaaggaatcccgcgagcaggccgtcaaggccccgctcgacgtggacctgaccggcggcctcggcagcgagccgatcgacatcaaggcactgcgcgccgaagccatggaggacgcggccaaggccgctgccgccgaagccggcgatgaggacaagcagggcgattgtgccgctgcggcaacgctgatcaaggcgctgccgagcccgcgcgccccgcgtcaggcgaaggtcgatctgaaggattggcagcacgtcaccgcccgtccggaagacgagatcgtcatcgtctccatcggagagctgggcccgtggggctccggccgcacccgtttcgaagccgaactcggcatccactccgacggcaaggtcgacctgtccgccggcgcggtgctcgaactggcttggaacatgggcctgctgacctggaacgacagcccgaagccgggctggtacgacaccgacggcaacctggtgcccgaagaggatatcgccgaacgctaccacgacgaggtcgtggcccgctccggcgtgcgtccgttcgaagagggcatgggcaacgattacaaggacggtgccgacgaggaggaggccgaggtgttcctcgaccacgatgtgaccttctccgttccgacccgtgagatcgccgaggaatacgtcaagctcgacgaagcccacaccagctacgcggccgacgccgaatccggcgagtggaacgtcacccgccacgccggctccatgatccgcgtgcctcgccgcgcggccatgacccgcaccgtcggcggtcagttcccgaagggcttcgacccggtcaagtggggcattccggcctccatggtcggcgacgtggacaagatcgccctgtggaacatcgtcaccacggtcgacgcctacctgtccgcgggcttcaccccggccgagatcctcgaagccgtgcacccgtccatggtggcctccacgcagggcaccggcttcggcggcatggcctccatgaggaagctgtacctggaccgcttcctcaaccatgagattccgaccgacatcctgcaggaagccctgccgaacgtcgtcgcggcacacgtgatgcagtcctacatcggcggctacggcaacatgatccagccggtttccgcctgcgccaccgcagccgtctctctggaggaaggcgccgacaagatcgccctcggcaaggccgacttcgtggtcaccggcgcgatcgacgacatcggcgtggaatccgtgatcggcttcggcaacatgaacgccaccgccaactccgaggagatgtatgccaagggcatcgacgcgcgcttcttctcccgtgccaacgatcgtcgccgcggcggcttcgtggaatcccagggtggtggcaccatcctgctgacgcgtggtgacatcgcgctgaagctcggcctgccggtcgccggcgtggtcggattcgtccactcctatgcggacggcgcgcacacctccatcccggctccgggactgggcgcgctcgcagcgggcatgggaggcaaggactccaagctcgtgcatgacctcgccaagctcggcgtcacgccggacgacatcgccgtggtctccaagcacgacacgtccaccaacgccaacgacccgaacgagtccgaactgcacaacacgctggcccacgccatcggccgcaccgacggcaacccgctgttcgtgatctcccagaagtcgctcaccggccatgccaagggcggtgcctgcatcttccaggtcaacggcctgacccagctgttcaagtccggcgtcgttccggcgaacgcggccctcgactgcgtcgacccgaagctcaagcgcgacgaccacatggtctggctgcgcgagccgctgaaggtcggttccgtcaaggccggcctggccacgtcgctcggcttcggccacgtgtccggcttcgccgcgatcgtcaacccgggcgccttcgaggcttccgtggccaacaccgcgggcgaggacgcgctgaacgaatggcgcgaccgtgccaacgcgcgtctcgccgccggccagcgtcgccttgaagagggcatgatggggcgcgccgcgctctacgagccgatcgacaaccgccgcttccacgaggacggccgcggctacgacgcgcacgaggtggagaaggccatgctgctcgatccgaacgcgcgcctcgcgtccaccggctatttcgaagcgtgagacggctacgtcgaaatctgtcctgaatatgggcaaatgatgacggcctgataagaaaagggcgatacttctgcacagatgtgtcgcccttttccatatgacatggtcggggcattcccggggtaaccccgattaataattcctaggaaggcggaggaatgctgggtctagggcatgacgtcgttgacgtgcctgcgttcgccaagcagctgaatgagccggggacgcgtatgcgcaatctgttctccatgcgcgagatatggcagacggcgcaacggtcgcagctcaagcatgatgacgaggcggtgcacctcgccgcccgctgggcaggcaaggaggcgttcctgaaagcgtggtgcgcggccatttcgcggcatgcgaaagacggcgccgaagtcgcatatccgtacacgctcgacaacttcccatgggtgcgcatcgaaattctcgacgattcccacggcgtgccgcgcgtcatactgtcctccgaagtgcaacgcaaggtgcagcagtcgttgggcctgccgttggatccggtgtgccagtcgtacgatatctccatctccataagccatgacgggccgatcgcctccgccgtggtcatgctcgaaatctgaaatgccattcccgcttgcaaaagttggtgggatgtgtataatagctcgagtcgtttcgtgtcggcttcggacgtagcggcaacacgcggatgtagctcaatggtagagcctcagtcttccaaactgattacgcgggttcgattcccgtcatccgctccacaacagcatcagagaagaagaaggcgtgcctcaaggcacgcctttcgtatatccgtatgcccgggcatacgattgcccgggtatgctggaacgggccgcggcgtgcggcggcgcaatcgcaagatatcgcaatatatacggagcggaacatgggtcagaaggaacgcaacaaggcaacggaagtcgtggatggcgtggtcgagaccgtcgacgtctccaaacacccgacggcgtccatcgaaccgtcggacctgtccttggccgacatcgaacgccgcaaatcgcatccggtccgctggattctgttcatggcattggtgctgctggccatgatcgcgccgtactggtgggggcgcgacatcgcggtgcgggacgcctcatggatggtggcgaacctgaatttcctcgatcccaaaggcgtggcgctgatttcatggacggtgaccatcgtggcgctcaccggactcggactgatggtcgcggacgcgaagaaatggctgtgggggaccattttcgtgatcggccttgccgcggagcaattcgtcgccggcatgtgcctgctgagcttcaacttctggaacgccacctatgtgatgtacggtgaggcggccggactggcgaacgccgcgaatctcggcatcatcgccgccggtttcggcgtcgcggtctacgcggtgctctgggtgggcctgctggtgtgcatcaagaaggaatcgaagctcaacgtcctcacacgcagctgggcctcgttcctattgttcttcgcaatcgaactcgtcgcgcttgccgtggtgttgttcggcggtctgctcatgtccatggcgtgacgtgaagaacggccgtcggcgggggcggaaatatcggccggcgattttggtccggccgtcgtgtaagatgttcccttggcgtgtttcgcccgcggatagagagcgcgtcggtattgggccggcagcaccgcgcagcaatataaggaggatgccgtggcacttacggctgaggaaaagcaggaaatcatcaagacctacgcaacccacgagggtgacaccggctccccggaggtccaggttgctctgctcaccaagcgcatcgctgatctgaccgagcacctcaaggagcacaagcacgatcaccactcccgtcgtggtctgctgctgatggtcggcgaccgtcgtcgtatgcttgattacctcaagcgcgttgacatcaaccgttaccgctccctgatcgagcgtctgggtctgcgccgataacattcttccgcccgagcgccatatggcgcccgggcgtttttgcatgacagccgagttcaaggaacagacagtttgaaggcccgaggtttggggcgcacgaggtctagaatctagagatgaggaagcggcggaggcaacgccgcgtcacgcatgtaggaatcggttggagtccgctgaagaggactgccgatagtaggtacacaagaaaagaaaacaaaggaggaaccctatggagggtcccgaaatcaaggctgttgaagccgtaatcgataatggttcattcggcaagcgcacgctgcgcttcgagaccggtcgtctcgcccagcaggcggatggtgccgtcgccgcctatcttgacgatgattcgatgattctgtccacgaccaccgccggttccagcccgaaggagaactacgacttcttcccgctgaccgtggacgtggaagagaagatgtacgcagccggcaagatcccgggctcgttcttccgccgcgaaggccgtccgagctccgaagccatcctggcctgccgcatcatcgaccgtccgttgcgtccgctgttcccgcacaccctgcgcaacgaagtgcaggtcgtcgaaaccgtgctcgccgtcaacccggatgacgcatacgacgtcgtcgcactgaacgccgcctccgcctccaccatgatctccggcctgccgttcgaaggcccggtctccggcgtgcgtctggccctgatcgacggccagtgggtcgccttcccgcgctggagcgagcgcgaacgcgccgtgttcgaaatcgtggtcgccggccgcgttgtcgagaacggcgacgtcgccatcgccatgatcgaagccggtgccggcaagaacgcatggcacctcatctacgacgaaggccagaccaagccggacgaggaagtcgtcgccggcggtcttgaagccgccaagccgttcatcaaggtgatctgcgaggcccaggccgagctcaagaagatcgccgcgaaggaaaccaaggaattccagctcttcccggagtacaccgaggatctgtacaaccgcatcgacgagatcgcccacgccgacctcgacgaagccctgtccatcgccgaaaagctgccgcgccaggaccgcatccacgagatcaaggaaggcgtcaaggccaccctcgccggcgagttcaccgacatggaagacgccgagaaggacaaggaaatcggcaacgcgttcaaggagctgcagcgccagatcgtgcgccgccgcatcctgacccaggactaccgcatcgacggccgtggcctgcgtgacatccgcaccctgtccgccgaagtggacatcgtgccgcgcgtgcacggctccgcactgttccagcgtggcgaaacccagattctgggcgtcaccaccctgaacatgctcaagatggagcagcaaatcgacgcgctgtccggcccgcagtccaagcgctacatgcacaattacgaaatgccgccgtactccaccggtgagaccggccgcgtcggttccccgaagcgccgcgagatcggccatggcgccctcgccgagaaggccctcgtgccggtgctgccgagccgtgaggagttcccgtacgccatccgtcaggtctccgaggcaatcggctccaacggttccacctccatgggttccgtctgcgcctccacgctgtccctgctcgccgctggcgttccgctgaaggctccggtcgcaggcatcgccatgggcctcgtgtccggcgacgtcgacggccagcacatctacaagacgctcaccgacatcctcggcgccgaagacgccttcggcgacatggacttcaaggtggccggcacctccgaattcatcaccgccctgcagctcgacaccaagctcgacggcattccggccgacatcctggcgtccgccctgcagcaggccaaggaagcccgcaccaccatcctcgaagtcatcaacgagtgcatcgacggcccggccgagatgagcccgtacgcgccgcgcatcatcaccaccaccgttccggtggacaagatcggcgaggtcatcggcccgaagggcaagatgatcaaccagatccaggaagacaccggcgccgaaatcgccatcgaggatgacggcaccgtgtacatctcctccgaaggcggcgaggccgccgagaaggccaaggagatcatcgaccagatcgccaacccgcacgtgccggaagccggcgagacctacaacggcaaggtcgtgaagaccacctccttcggcgccttcgtgaacctgaccccgggcaccgacggtctgctgcacatctcccagatccgcaacctcgccaacggcgagcgcatcgacgccgtcgaagacgtgctcaaggaaggcgacaccgttgaggtggtcgtgcagggtgttgacgatcgcggcaagatctcccttgccatcccgggcttcgaggatcaggaatcctccgctccgcgtcgtgaccgtggcgatcgcgatgaccgccgtggcggccgtggccgtcgtgacgaccgccgtcgttccgacgatcgcgatgatcgcgattatgatgatcgtccgcgtcgccgtcgttccgaccgcgatgacgatcgtgattatgatgatcgtccgcgtcgccgtcgttccgaccgtgacgatcgcgactacgatcgtgacgaccgccgttcgtcccgttccgatcgcgatgatcgtgattatgatgatcgtccgcgtcgccgtcgttccgaccgcgatgaccgtgactacgatcgcgatgaccgccgttccgaccgtcgccgtggtagccgtcgtgacgaccgcaacccgcgttacgccgccgacgagaactacgacgagtaccgtgccgatcgcgaagagcgctccgagcgtccgcgtcgccgcgtgcgccgcgactttgatccgttcgaagactgacgtcttctcacggatccttcgcagcgaagctgctcacttcacctacgagaagcccactgggcttctcgcttgacggctcagcattcgaagactgatgacaccttcgcgcggatttcccgcagcataagatgattatctgaaaggcccgcccccgtggggcgggcctttctgcattccgacacgcttggcaaaacatgatgtcaatcgttttacgggtgtatgcgcgccgtggaatggtgcagtcctcatgagaacatgatggcaatagaagcaacgaagcagagaagcagagaggaaatacgatgatcgtagccattattatcgtcgtcatcatcgttcttgtgctgttgtgggcaatgtccgcctacaacgggctggttacgctgcgtaaccgggtgaagaacggctgggcgcagattgacgtgcagctcaagcagcgtgccgacctcattccgaatctggtggaaaccgtcaaaggctatgctgcccatgaatccaacgtgttcacgcaggtgacgcaggctcgtgccggcgtcatccaggctgcgcaaagcggtgatgtgcagcagcgcatccaggccgagaaccagctgagccgtgcgctggtgaacctccaggccaccgccgaggcatatccgcagctgcaggccaaccagaacttcatggatctgcaggggcagctcaaggggctcgaggagaaaatcgcctacgcccgccagttctataacgatgtggtgcagaagtacaacaccaagatcgaggtcgtgccgaccaacatcatcgccggactgttccacttcgagcaggcggcgtacttccaggtcgacgaagcggaccgtcaggctccgcaagtcaagttctgaacgtttccatacaagaaaggggagcgctgacgaggtgtgatgtcttgccagcactccctttcctgtattacggtccgttgacgccgagaccatgcgttggtgcttgaggacccttgagagaaaacagagataccgccgatgaatatcagacgtacgttggtcagtctgctgtccacgattgtggtcacgttgacgatgttgggcatcgtgctcatcaatgcgcagacctccgatgaggaacccgatttaagctaccgcacgcttgactacgacgtggcggtgcagaggaacggcgatctcaaagtcacgcagcatatcgacatgaggctgaaggaccgtggccgtgactggaagcagatgtatcagcggtatacgctgaaatccaagaatctcacggatatcagcgatattggggtcaaggacgtatccaacggcgagacataccgccagggcgacttcgtcttccccgacaatgccgacaactggaacgacgagcatgcgggacggtggtacatcgtggacgtcactgaggatgagaacgatcctcagccgttcaatccgcagaccgatgggttaagtgatgacggtcaggccgacaaaacacttgaaatcggttggaatattccacaaaccgtatccgaggacagtctcaaattcgatgtatccatgacgctgcatggcgtgagcaccgcctatgacgacgtcgtctccttccaatgggagccgttcggcgaggaaaaccagattcccatcggtacggtgacgggcaaagtcacattccccaacggcattaacggcaagaattcgtgggcatggctgcacaccaaaaatacctccaccacgaaccgcggcgataatggttccctgatgttctccgccaatgatgtgcgcgccggcgactatttggatgtcgtggccatgttcgatgcctcgcaagcgcaaggcgtggcacgcaccaagtccggcgcatacaagcaacggcttatcgacgatgaaaccaaacaggaacgggaatggaggtccagtcagcatacgaaggccgtcaaacgggtggccggctggatattcgcggcgttgatcggcatcgcgcttgctgtggcggcgctgtatttcgccatcgtcagcttccgcaaatcgcaatacaagggcgatatcgaatactggcgggacctgcctgacctaagtccagcagccgccgcgaagatggaggatatcatgagcgcatcctcctcgatattcggttccggcaagaccaagaacgccgacaaactggccaacagacagatgtccgccacggtgatgtcgcttgcctcgaaaggcgcgatcgccatctatccggggccggtggacctgtataacggcattgatttgaccacgacgagcgcggcttcggtggctggcatgctcggttccaatgcggcgtccgcgcgcaaactgaagaagaccagcaccatcgctatcatgccggtggtgtgtgacgacatcggttcgttgctgctcagttcctccgaaagagcggtgcttgacatcctgcttaaagcgtcatcgcgtctgcatgatgcgcaggtgtttgatttgaaacagatgagcaaggccttcaaacactattcgagcggttacaagctgttggaaaccttcgacaacgcgtgctccatggaattcgatgacttacatgccgtcaagcctatgggattgctcagctatctgttcagtgggctgggtattgcgttcgccttcttcctggcgttgaaatacgtgcaggacggtgagcttgccgtggcgctggtcgtctgcgttccggtggtcgcgctttgcgctttcgccgcagcatacgggaaacgctatgtgctgaccgatgaggggcaacgctatggtgggcaagtcgccggattgaaacgctatcttacggatttcagcgatttcaccgaccgaggcgtgctcgacatgacgttgtggggccggtacatggtgtatgccaccgcgttcggcatttccaagaaggcgatggcccagctagccagagcatatcccgaagtggccgatccgcagtggttggatgagcatgccggcacctcgtacatgtacatgcccttgcgttccagcagcctgcttggcgcatccgtcggcacgtcgcttggcgcctccacgattgatccggccgcattcagcgcgaatttcggcgatctcggtgcgcagctgagttccagtttcgccgatgtgcgcagcacgatctccgcggcggccccatcctcctcatccggaggttccggaagctccggcggttccggtggttccttctccggcggcggtttcggaggatcgtccggcggctccggcggcggttcgttcggaggccgatgaaacagacgtactggcaaacgcaccatggccgcattggccagtcgtagagagcaggaaggggtgaacaatgaacggtaaacggtacggacgcgggctaatcgccgcgttcagtgcgctggtggcggtggttgccatcatccttgcggtattcgtcatatccggcgacgaggcggacctgagctaccgctccgtcgacttcgatgcacggctccagagcaacggcgacattagattcacagagcatctggactaccagctgaagcgtcgcgaggacggcaacggtgacaccaagccgtggaaacagctgtatctgacgttcaaactgcgcaaccaagatctgacgaacatcaccgacatctccgtgaccaacgcatccacaggcgaggaatatacgcagaccgatccacaattgccatccggcatatccgacggcacatgggactcgacctatgccggccactggtacatcgccgacaccacggccggttccgactcgccgcagccgttcgatcccactaccgacggcatcgacccgaatggttccggcgagcagaagaacatcgagatcggctggaacatccccgccaccgtcaaacagagcagcctcaagttcgatgtgagcatgacgttccatgacatgggcacgcggcatagcgacgtgacgaatctcatgtgggagatgttccctgaaaacaaccaggtgccggccggcaaggtcaccggcaccgtgcgtttccccaaaggcatcgcctccaacaattcgtgggcgtggttgcataccgaagccacctcccagacatcgcgcgatgcggacggcacattgcatttcaccatcagcgacctgcgcaccaaccaatatgtcgacctcgtcgcggccttcgacaacacaggcgctgccggcgtcgaacgtacgcagtccggcgattatctcgacgaactgaaatccacggaggccgccaaggaacggcagtggcgtgaccgacaacggttgaaggcgcagctcaccgtcgcaggctggttgatttgtctgataatcggagtgctatgctgcgtgctggcgattcgtggcgtgctgtcggcgaaccgcgaggcccgttaccaaggcggcatcgaatattggcgcgatccgccgcaggtcagccctgcggccagcgcgtatctgatcgacgtggtggacgaatccgtaggtgaccgatcatcgcgtgccatgacggcgacgatactggcgttggtggtcaagaaggcgcttgccgtctacccggggccatccagcctgtaccaaggcatcgacctgagccaagccaacgcctccgacctcgcccgcatgattgcttccgatcccaatcgagccaaggccacggcttcctccagcactctggtgatcatgccggccgcgctttcccatcgcaacaccctcggtctgagccagtccgaggaagcctgtctggaactgctgatcggcatctccatgcgcgtcggctcgccggtgttcgacttcaaccagatggacacggcctgctccgactgggaggagggctaccagtccctgaatcggttcaagagcgcctgtgacctcgaattcggagcgcttggcgcggtgaagagcgtgaacggacggtggttggtgccgagcctatgtctgatggtcatcggcgctattggtatattcgccaacggtgcgagcaatatcgcgatggcgctgtgcttgggcgtgccgttcatctgtatcggcgtcttctgcatggccgcgggccgatcggaaggcatcaccgaacgcggccagcagtatgccggcgaatgcttgggactcaaacgctatatggaagatttctccaatttctccaatcgcggagcccttgatttgacgctatggaactggtacatggtctacgcggcggcgttcggcatctccgagaaggtagcgagggaattcgcccgcgcctaccccgaagtcaacgacccgcaatggcttgacacctacggttatgactccttgggctattggacctatcgttcccaggcgtggaacggtccgatcaatacgaatggcatgatgccgggtggtatgtatggcggtacgcaattcatgggcggcgtcggtgacatcggttcgcagatcagctctggattcgcttcggtgagttccacgatttccgcggccgcgccttcctcatcctctggctccggcggatccttctccggtggcggcttcggcggcggtggcggaggcggcggcggtggaggcggcggaggccgatagccaaggcgccgccgcggcagcgctgtctgcccgtcatgccgtttcgtcatacgatcattggcataatcaacgtggccccggcatggagaagcctaccgttcgcctatggcgattggtaggcttctccattggaaacacacctgaacgctgacgtcgaccggcttggcatgctttgccggaaagacgcttcgtgcatatgcccgatgcagggcacgtgcctgtttggaaggacaagacatgacgttattccgcgatctcggaccattccataccaccgccatcggccacggcgagatgccgctaaccattgaaaacaaccggggccacgatgtcggtatcgagaccttgcatgcatctttggatgctggctgccgtcatatcgacaccgcgtgggcgtattacacccccggtgaggaggagcagaccggcgaaaagctggtccgcgaagcactggagacctggaagggacctcgtgaggaagtcaccgtggccaccaaggtcggtctgcgccgcgcgtgggatggcgacaagccgatctggccgcgcgacggcaagccggaacacctcatcgaatacggcaagcagtccgcgcaggcgctcggcgtcgactcgatcgacctgctctacctgcatcgccacgatccggaagtgccgtacaacgagtcctgcgaaggtatcaaggcgctgctcgaccagggcgttgcccagtgggcgggtgtgtccaacgtgagcatcgaacagctcaaaatcgcacaggagattctcggcgacaagctcgttgccgtgcagaaccagtattcgccgatccatctggaaacccaggacacgttggaatactgcgcgaaggaaggtctcgccttcgtgtgctggagtccgctcggcggctaccgccacccgtacgacgagcacctgttcgacccgttccgcgaagtggccgccaagcatggcgtgagctaccagcgcgtggtgctggcttgggagctggccaagggcgaccacatgttcgtgattccgggcgcacaccgtcccgaaaccatcctcgactccctgaaggccgacgagctcgaactcactgacgaggagctcgccttcctcggctgaaaaagcactgcccgtccgcattttgttagcccaaccactcagctcgggtagcaaaacacggacgggcatacgtttttgcggaaccggacggctatcggggattacagcacggccatcgcgaaatcagctagtagtttgacgccgtacagcaccaccaccgcgccacacacgcggttcatcgcggtgatgattcgcgggctgaacttgtggctgaacagcgacaccagcagggtgatgccgaagaaccacagtgccgacgcggtttccacgccggtgatgaacggcgtggactgaccgacggtaagcgtcgcgctgaacgcgccgagcatcagcgtgccgtcgatgatggcctgcggattgcaccacgtcaccacaccggcggtgacgatggtgtgcagcagctcgctgtcgccgccgaatttcgaagtgacgcgttgcgcaaggccctgcgattgcgaggtctgcgactgcggcgtttgcgcggcgccatcatcgccacccttgccgggaaacagcagacccgcgccgatacggatgaccaccaagccgccgatcgccagaatggccagcttcagccatgcgtggtcctgcatgagcttgccgatgccgaaaaagcaggacagcgacaacgacacgtcgaagaacagtacgatcagcgcggtcagcagcgcgcggcggcgcggcttggtcagcgccgaatcgatgacgaacagattctgcataccgatcggcgcgacatacgccaatcccaacgtcagcccttggaaaaagaatcccatactcgcctcttatccatccaaacatatttggttggttgtaatcaacccagccaaaaccaaccaaattgctcattttgtaatcgcaggaaaaacctctattctgcgaaaaacaacgtaaccagtgtcatattgtataggtgttgctacaataggcaaccagccaaaagctgaggtttggctcagccaatcgcaggacggtccactgtcagaaagcagatgcgccgaccgcggaaaacgccgaaccataccgacaccaccaatgtgaaggagcgtcatggcacgcatcgcgccgctgaacatcgattggaaaccggaccgtaccaccggcgaacccgtcaccgaacaaatcgtcgggtacatgtgcgaacaggtgcacagcggcaattggccgattggctcgcgtctgccgtcgcaacgcgcgctcgccgaatggttcggcgtgaaccggtccaccgtcatcgcggccatcaacgagctgtccgattatggcatcgtcgaagggcagcatggagcgggcacgcgaatcgtcagcaacacgtggtcgctgatgctgccgggcgcgcccgactgggccgattacgtggattccggcttcttcaaagccaacaacgacaccatccaagccatcaaccggtacgagttcacgccgaacatgacgcgcatcggcaccggcgagctcgacccgcggctctttccgaaagccatgtggcggcaggtgctcggcgaggcggcggacgagatcgaaacgctcggctacccgccgcccgaaggcctgcccgaactgcgcgaggccatcgcggcgcacatgcgcgccaccggcgtcgactgcacggcaagccaggtgctggtcacatccggcgcgttgcaggcgctgcagatgatttcggtgagcctgctgccggccggcaccaccgtatacgcggaatcgccgagctacatcaagtcgctgcaggtgttccagtcggccggcatgcatctggaaggcgtgccgatggacgacgacggcctcaacgtgcaggcattgcgcggcctgctggcggaaggggagcttgacaccggccgtccggcgccgctcaacgcgcgcaaccgcaaaggcaatgcgatcctgtacacgattccgaccaatcacaatccgacaggcgtcactatgagcgacaaacgccggcatgaactggtcgagctttccgtggacagccgactgccgatcatcgaggacggcgcctaccgcgacctgtatttcgaggatgatgccccgctgccgtcgctgaaggccctcgatgagaccggcatggtcatcacgctcggcagcgcgtccaagtcgctggctcccggcttgcgcatcggatggctggtcgccgccgaaccgatcgtgcagcggctcgccgacgtgaaaatgcagatggactacggtgcgagcgtgctgagccagtggacgttcgcgcgattcctcacgaacggcatgtacgacgaatacgtggccggcctgaaacgggagctgcggcaccgccgcgaccgcgcgctcgttacgctgcaggagaaaatggacgggctcgcccactggaacgtgccgtccggcggcttctacatttggatgaccttcgaccggccgatacgcatgaaccgcctgttccagctggccgccgaacgtggcgtgctgctcaaccccggcgacatctacgatttcgccgccgacaactccctgcgcctgagctactcctacaccacgccggaagagttcgccgacgccgtggacgtactcgccgccgtcgcacgcgagctggcgtagcccgagcttgcgtaacggctggacgggctttgcctgtcccgtgaatctacgacaatatctgatggtcttttacgagtaagaggaacatccgtgcaaagaagaaacaagccagaagtgttggcccccgcaggcaatttgaggggactgaaaaccgcggtcgattacggtgcggacgccgtctactgcggcggcaaggcgttcggcatgcgcagcgcgccgaaaaacctgagcctcgaggatttcgaggaaggcgcacgctacgcccacgagcgtggagcccgcgtgtacgtcaccttcaacgtgctgccgcgcaacaacgaggtggaagccatgcgcgaatacctcggcaagctgaaggacaccggcgtggacgcgctgatcgtctccgacatcggcgtgatgctcatggccaagcaggtggctccgaacctcgaactgcatgtgagcacgcaggccggcgtcaccaactaccaggccgccaacgcgttctacgaactgggcgcgcgccgcgtggtgctggcccgcgaaatggacctgcaggccgtgcgcgacatccgcgcccgcattcccgacgacctcgacatcgaatgcttcgtgcatggcgcgatgtgcatggccttctccggacgctgcctgttctccaactatctgaccggccgcgacggcaaccacggcgaatgcgcgcagccgtgccgctggaagtattcgatcgtcgaagagaaacgccccggccagtacttcccgatcgaacagaccgcggaaggcgcgtacctgttcaattcgcaggacatgaacatgctcgcccacatcgacgatctgcttgattcgggcgcgacgagcctcaagatcgaaggccgttccaagagcgcctactacatcgccgccatgacgaacgcctacaagacggccgtcaacgaatacatggtccagcgcggcttcgaagatgccgacggcaatgttctgaagccgttccgcgaccgcgtgatccgtcccggtgacccggaatacggcaagccggacaccgaggatgcgatcatggccaacgccgatggcgcgttcgccggcaagcccgacatcgacgccgttcccgttgggggcgtgccgtccggcaacgtttcggctggcaacgtttcgtccggcaatatcgcgattggcgagccggacaatctgagctaccacgcacgcagcacccgacgcaagtcgaacaccgccgccgaaatactgccggaaggctggcatcacgccggtgtacggccggcaccgcatgtcaccctgccggattggctgctcgacgagcccgacaaagtggcgcaccgcgactactccaccggcttctattatccggaacacaaagtgcggcaaagcaccgaccgttccgcatacttccgcgcatggctcgtcgtcggcgaagtgctgtcatggagtccggaagacggaggacgcgtgaccatcatgagccgcaacaagatcgaagccggccaggaagtcgaattcgtgctgcccggcgcggcccccttcgcctacaccgtgcctgccggcggtttccgtgacgccgacggccactgggtcgaagccatcaacaacccggcgcacgtcttctccatgccgtgcccacaggaggtgcccgtcaacgcggccatccgttcgcgcacgaaaaagccgacgctgaaagccgaatagaagacggcaatcgcaagcaggccttccaatcgcaaaaccaaggaaaaacaagacatgagcagcacacaatacgatgacgcgatcctcgattccaacgccatcgaccccactgacaaaaacggcaacccgattcccgtgaccattccgatcatgctggcccccggcatcaaagtcgtctacaccacgcgactcggcggcaccagcgaaggcgatttcgcgcacttcaacctcggcggcaaatccggcgacaaaccggaacacgtgctcgccaaccgcaaggcgctcgccgacgtgctcggcgcgaaaatcagcctcatcagccaggtgcattccggcgacgcggtggacgtggacgaatcattcgtcatcaaccagccgttcggattcgacgtgtccggcacgaagaagccggaagacgagacggacggcgaaaacaacgcgacggggaatgacggtgagccgaccgtcatcgaagccgacggccaagtgacgtcccggaagaacgtggcgctcggcatgttcgccgccgactgcctgccggtgctcatggccgatcccgaagccggcgtgatcggcgcagcgcactgcggccgtcgcggtctgcagaaaggcgtgatcggcgcgaccatcgagaagatggtgtccaagggcgcccagccggaacgtatcgtcgccacgctcggcccctgcatctgcggcgactgctacgaggtcggtggcgacatcgccgacgaattcgatgcgcagttcccgggaaccttcacgttgagccgatttggccagccgggcatcgacatcgccgcggccgccctgcaggagcttgccaaagcgggcgtgccggccgacaacatcgtctcatcccgtccacgcgtcaacgcggccacgcagtacctgtccgaagacgaggaactggccggcatctgcgccgccgatggcgaaggcgatccgaagctttccgaacggttcaacaagatccgccgcagcctgtgcacgctcgaaaacccgctgtggttctcgcatcgccgcgcgtcgctcgccaaaaaacagcatgaaggacgcatgctggcgctgatcgtacgcgaataatcaccatacgagtcatacaagccacgcgattcgtgcgattcgagtgattcgcgtggccactgttgcggattgcgtgcagaacccgccgtggaacggggtggcatgcggccgcggctttacggtggagcatatgagtaagggagagcagatgcaggaacagaagatgccggtcgtggccgtggtgctggcagcgggattcggcacccgattcgacgagaacaaccccaagcagctggtgtcggtgggcggcaagccaatcgtctgccggagcatcgaggcattcgaaaacaacgaccgcatcagcgacatcatcgtggtggtcaacgaacgcgtcgaagagacggtgaacgagcttatcgacgaagccggctacgccaaagtgcgggccatcgttcccggcggcgccgaacgcgtggacagcacgctcgccgccctggacctgctcaagcaggccggcattccctccggcgcgaagatcctcatccacgacggcgtgcgtccgttcgtcgaggagcggtccatcgacggctgcatcgacagcctggaccagttcaatgccgccaccgtggcctacgcctccaccgacacgattctgctcacagaggatctgggcgaccgcaaggtggtcaaatccgtgccggaacgtccgaacaccttccgcgcgcagaccccgcaggcgttccgtttcggtaccatcgtcaaagcctacgaactggccgccgccgaccccgacttccatccgaccgacgacacgcgcgtggtggtggactacctgcccgacgagccggtcgccatcgtggacggttccgaaacgaacctcaaaatcaccacgccatccgacatgccgatcgccgaaggcatcgcccgcagcctcgaccccgaacacgccaaggaggaagccaaggcgcgcatgcacgccgtgttcgccgaggcgttctcccagatgcacagccgttgattttcatcgaacgttaagtccgtcgacgtgtcggcagacttaacgttcaacacattcaccacgtacactggaaaccatgcagcagatcaacatcgtcatctccggtttcacgccctacgaaggcatcgacgtcaatccggccgtgctcgtgccggcggcggtagccaagcaatggggcgatccggcgcaatcgcaggcgatctccgaagaactgctgcaggacatcgccgtcaccgtcaccaacgtcacgcttccggtgagcttcgccaaagcctggcccacactgctggaagccatcgaacaggccaagccggacatcgtcatcgccacagggctcaagcgcacctcccgtggcattctgctggaacgatgcgccacaaatctcatggatgcggccaagccggatgccgacaacgtgattccgccccgccgcccgatcgacccggaaggtccggccgcgtactggacgcgcctgccgttgcggtcgatactgcacgatttcgccaaacacgagattcccgccgcgttgagttccgacgccggtacgttcgtatgcaattcgctgttctaccatctgctcaactggtcggcgggccaggaacgtcgcattctgtcggggttcgtcagcctgccgatcgtcaacggtcggccgcacgaacgtggactgccgatcgaacagcagaccgctgcggtcgatgacgtactgcgtgaatcggtacgatacttcctgcaaccctcgtcaagcgacattctgcttggctgaggacggctccgctttctacggcacgattttctgcgacatgtgagtcatgcggtttcgacacgtggtcgcggacataccgccatacccccgacagactttttcgaacgatttctgtgctctctgtgagaataatgcatttcgttctgcgtgccgcctgctgactgagatagagtactgaacgagtgcgcgctggcagatgcgcgaagtgtagggaattcgtgaaaggaaaagggcatggttgagcagttcccaatcgtgttgagggggtacgacaaggatcgagtcgacgaggcgttcgcttcggctcaggagacggtgaaccgtctgcgtgagcaggtcaaggccgacgaccagaccatccttgagctgcaggcgcagctgcaggaggaaaagaacaagaaggccgctccgaagtccttcgcgtcactgggcgccaacgcccagcagatgctcgccagcgcggaacagaccagcgccgagctgcttgaacgagccaagaaggacgcttccgcggcccgcgccacggtgcagctgcaggctgaaacactgctgaacaacgccaaaatcgacgccaagcgcatcatggacgacgccaacgccaaggcggccaaggtgctcggtgacgccaaggacgaatccgaagccatgagggccaatgcccagcatgaggtcgaccagatgcgcagcgaggcccagaaggccgtggtggcgcagcgtcagaccgtcgatctggaactgaccaactcccgtgaggaacacggcaagcgtcttgccgccgaacgcgccacgcaggaacgtgagatttccgacatgcgcaccgaggcgaccagcaagatcgccgaacagcgcaagaacgccaatgaggagatctcccgcctgaagagcgagaccaacgaccagatcgaatccgcgcttgccgaagccaacaagaagctggcggacgtgcgcgagcaggtgtccaagatgatgaccgacgcgcagcgccgtgccgccgaaatcaccgacaccgccaaggcgaaggcccaggagatcaccgacgaggcggaggtgcaccgcaccaagaccatcagccaggtcaacgccgaagtggagcagatccgcgccgacatctccgcccagcaggaggaggccacgaagaaggtcaatgagctgctcaccgacctgaacgagcgtcgcgaggccgccaacaagcaggccagcgagttgatttcctccgcgcagaagacccgtgacgaggctgaggcgtacgcttccagcaagcgtgacgaggcggacgcgaacgcggcaagcatcctcaagcaggccaccgaagacgccgacgagcagatcaacgagcgtcgtgaggccgcgaagaaggaactggacggcgtgcagcagcgcatcgccgacctgcagagccgtgaggcccagatcacgcagcgcgtcagcgaactgcgtgccatgttctccaacgcgttctccggtttcggcatgaacgacctgtccgtggtcaacgccgtcgatgaaggcgagccttccgacgcgcaatctgatgacgacgcgcagcacgacgatgagaccgccgcaccggcagacgccgacacgcaggatgccgtcgagaacgattccgcagccgagaccgagccggaaggcgacgccgaatccgcagacgcttcgcagaacaactgaaaccatagaaagggaatggataatgaccgacatcacgccattgagcggtgatgaactgaacaagctcgtcgacgatttcgaagcaagcgagcacaatcgcatggccatgaacgccgtcacgacggccggcatcgacaaggtggcgcgcaactacgatcgcgcccgtctgatgcagcgtcgtttctccaccgtcgtggacaacggcaccgtcacccatcaggaccgttccggccgttgctggctgttcagctcgctgaacgtggcccgtttcgtggccaagcagaacatgggtctcaaggagttcgagttctcccagaactacgccatgtactacgacaagctcgaacgcgtcaactacttcctgaaggacgtggccaagctggtgcgtgccggcgagcctgccgattcgcgtctgatgcagcatctgctgtccgacgtgatgggcgacggcggccagtggaccatggccatgaacgtgtacaagaagtatggcgcggtgccgaaggacctgttcccggagactgaatcctccaggaacaccggtgagatgaacgtgcagctgcgccgcatgctgcacaccgcggttgcgcatatgtacgctgatccgtccgcgatcgatgcgatcatcgccgatgcggtcgccgccggtcaccgtattctgacgattcacttgggcgagccgccgaagagcttcgattgggagtggaccgacaaggacggcgagttccaccgcgatggcgagatcacgcctgtcgagttctggaagaaatatgtgggttccgccgatttggaaagctatgtctgcctggtggacgatccgcgtcaggagcacgtcaagggcaagaagatcggcatcgagcatctgggcaacgtggccgggggagacccgaccgagtacctcaacgtgccgaaccagttcatgaaggactgcgtgcgtcagattcttcaggaacagggcattccggtatggttcggcgctgattgccatccgatgatggaccgtgagaacggcgcgtgggccaccgacctgttcgagtatggccgcgtgtatggcgtcgatttcgatctggacaaggaacagcgtgtccgtttcggcgattccgcgatgaatcacgcgatggcgttcgtcggtgtggatgtggatgaggatggccacaccacccgccgttggcgtgtggagaactcgtggggagacaagattgccgacaagggctacttcaccatgagcgacgactggttcaccgaatacgtctacgaggtcgccgtccccaaggtcctccttcccgctgaatacctcaaggccctagaagaacccgccaccatgctccccgcgtgggatccgatgggagcgctggcctaaggccagcgctccctgagccgacgcgccgttaagcaaacagtcctgtggactgtttgtaggcgcggctgaggccgtcaggccgaaggcacggcgaaggtagtattgagtccacgcggagcgtggtccgtaattgcagggccgaaggcgcgttggctatgtagcgcgcgaagcgcgcgtagccaacacgcgccgagcgttaagcgagagcccagtgggctctcgtagcgaggagaaaacgccgacaggcgttttcatttagatttagcccgggtcaaccagcccgggtttttcttttgtctttcccacgtcacccccacccattccaccatgcagtcgcccatccccatattccgtccccatccgttaaggtaacgacggtggcgctatcgcgctacgcaagcataatgatgcaggggaggaacagaagcgatggcaggtcttcgcggtccggatagttcgaaggatgcacagctgttggatgagcgcgccgtgtttccggagaccgtggatgtcaatattcgtcagcttgacccgattcccgctccccgatattttctgaaggaacttccgctcacgaacgagatgagcgatctggtgttgaagtcccgtcaggagattcgtgacgtgctgcatggccgtgacgatcgtctgctggccatcgtcggcccgtgttcgattcatgatccgaaggctgcgcacgagtatgcggagaggcttgccgccgtcaagaaggagcttgatgatcgtctggtcatcgtcatgcgcgtgtatttcgagaagccgcgcaccacgatcggttggaagggtctgatcaacgatcctgatcttgacggccagttcaatattcgcaagggcatgttcatggctcgcaaggtgcttaccgacgtgctggggctcggcttgcccgccgctacggaatggcttgatccgattaccccgcagtatatttgcgatctgatcagctggggcgctatcggcgcgcgtaatacggaaagccaggtgcaccgcgagctggcgtccggcatgtccatgccgatcggtttcaagaacgctacggatggttccatcaagccggcggccgattcgtgtttcgcggccgctttcgagcatcatttcctctccatcaatctggatggtcgtgtgatttccgcggagaccaagggcaatcccgactgccatctggtgctgcgtggttcctcgcatggtccgaactacgatgccgcttccgtggcccaagcgttggcggatctcaaggcttccaaggcttccggaccaagcgagcatggtctgatcatcgatgccgcgcacggcaactgcggtaagaacgaggtgcgcgaggccgaagtggtcgaagaaatcgccgcacgcgtcgcggccggcgaacagggcattctcggcatcatgatggaaagcttcctcaaggcgggcaatcagaagcccgcgccgctcgaccagctggaatacggcaagtcgatcaccgacgcatgcgtgccgtgggatcgtaccgagcagctgctgcacacgcttgccgacgcggtcgacgcgcgtcgcaagcttggctgatgtttctgcgccatcgttgctatccttgggaaaggaagcgacaaggagagcgagatcatgcagcagcagctgaatacgcctgaggatttacgtgccattaggcaggccatggatgagggcaagaatccgctggtggagaccgacgtgccgcgctgggaggaccaggtgggcatcagccgcatcgtgaaccgccgcgtgctggaattcgaagtgttgcccacgccggcgcaggtgttgggcgacctgccgttgagcgagcaggcgcaggagatcgtcgcctattcgcgtgatgagattcgtgcctgcctgtacggtcaggacgatcgcctgctggtggttgtcggtccgtgttccgttcacgatccgaaggccgcgctcgattacgcgcgtcgcctgtccgcgttgaaaggcgagttggatggcgagctgctgatcgtcatgcgcgtgtatttcgagaagccgcgcaccacggtcggttggaagggtctgatcaacgatccggatatcgacggcagctgcaatatcaggaagggcttgctgttggcccgccgcacgctgcttggcgtgcttgacgagggtttggcggcggccacggagtttttggagccgaccagtccgcagtatatttccgacgcgattagctggggtgcgatcggcgcgcgcaatacggaaagccaggtgcaccggcagttggcgtccggcctgtccatgccgatcggcttcaagaacgccacggacggttccatcaaggctccggccgattcctgcttcgcttccgcacaacagcacacgttcttcggcatcgaccatcttggccgcgccgccgtggtcaaaacgcttggcaatcccgactgtcatgtggtgttgcgtggttcctcgcacggcccgaattacgatgccgcttcggtggccaaggccatggacaccatccgcgccgaaatgccggccgattccgctgcggcacatgggctgatcgtcgactgctcgcatggcaactccggcaaggacgagcatcgtcaggcgcaggtggtgcgtgacatcgcgggccgtatcgccaaaggcgagcagggcatcaccggcatcatgatggaaagcttcatcgaaggcggcaaccagaaggccgcgccgctcggccagctcgtctacggcaagtccatcaccgacaaatgtctgagctggaacaccacggaacagctgctacgcgagcttgcccatgcggtggccgtgcgccgctggaagtgaccgattcgattcactatccgcgcgattgcagaaaattcgggaaacgcgaatcgcaatcgcgtaaaacaacactcaagacagcacgtaagacagggagggtgcaatgaccgcaatcgccatcattggcgccatggatgaggaagtcgccaatatcgcaacggcactgagcaacgtcaccgtcaccgaggaagccggcgtcaaggtgacgcgcggcaccctcgaaaccaacaagggcaccgccgtcaacgttgccgcgaccgtcggcggcatgggcaccgtcaacatcgccgccaccacgcagcatctgatcgacgctgaccagccggacgccgtgatcttctccggcatcgcgggcaatctcaacacgaatctgcacatcaacgacgtggtgctcggcggcaccctgcgctatctcgacaccgacatgcgattggtgggacagttcaagcccggcaccgccgaccggcccatcgaggaataccatagcgacgaccgtctgctcgaactggccgaccaggcgctgaacgacttgaacattcaccatatcgtcggcatcatcgccaccggcaactatttcgtcgatgatccgcagaaggtcgagcaggtgatccgtgagaccggcgcggacgcggtggaaatggaaggcgccgccgtcgcgcatgtcgccgcccgcaacgacgttcccgcattggtgattcgcgcgttgagcgacaacgcggacaccgactacgaggatttcaaaacgttcgacatttccgaatacgcggacaccgccgcgaaactgacggtgaacatcgccaaacgcatgtagcgttcatgtggcgttgcgaaacgcctaacgttgcgaaaagccgtttccacatcccgtttgccgcatgacccgtcatcatgcatcgtcatatcggcaaacgggacgtctcatattccgatatgctgcgtttcggaagatgaacggcaggaaaacttccggtggcgtgagagaatcgcatacgcgaaagcctctccgaaaccgctagtcttaaggaagaactgaggattatcggaaggtgaacgcatgacgttggagcagatgctggcaacgccgtcggtggttgcggcattggtggtcgtggccgtggtcgtgttcgtcgtggcgttcctgcttggccgcagacgaggcttccaggatgtgcaggacagcgtcgaccccaatgatccgagcctgttcggagctgcgaagaacacgtccctgttcggcccccgcgttcccgtgcagtccacggaacgccagctggtggccgtcatgcccgaagctttggtggtcgtagactcgctggccacggtccaatacgcatccccggccgcgcggcgcttcggcatcatccacgaccaggcgatggcgctcgcggaaatccgcgacatcgtgaaactggtctccacagacagcgtggtgcgcgaacgcgaactgaccatccccctgcacggccgcacgcgaacgggcgtggtgaacacgaacggcaaaggcgtcgaagccggcaagccgctgcccgaagacacgctctacctgcacgtgcgcgtcggacagatcgccgacaacctatttgcgattttcatttccgacatgagcgagcaacgccgtttcgaaatcatgcggcgcgatttcgtcaccaacgtctcgcacgaactgaaaaccccggcaggcgcgatttctctgctcgccgaaacgatcggcgacgcggccgacgatccggacgcggtgaaatacttctccggccgaatctccaaggaatccgaacgattgacggaactggtccaccgtctgatcgacctgcagaaagcgcaaagcgcggcagcgatgctcaacgcggaacggctgtccgtgctgcccgtggcacgcgaggcgctcgccgaaaaccaggtcaaggccgaatcgaagcacatcagcctggtcctgtccgtgaacggccggcaggtgctggtgcatgcgaacgccgaggaactggccaaggaagccgaacagaacctggacgtgttcgtggtcgctgaccatgagaccatcaaaactgcggtgaagaacctggtggagaacgccatcaactattcgccggaacataccacggtggccgtcggcatcggcatcgaatccggcaaggtggcgattcgcgtcgtggaccagggcatcggcatccccgcggcgtcgctcagcagaattttcgagcgattctaccgcgtcgatccggcgcgctcccgtgaaaccggcggcaccggcctgggattggccatcaccaagcattgcgtcgaggattgcggcggcaccatctccgtatggtcgcgtgagggggagggatccaccttcaccatcacgatgccgcaggcttcgggcgctgcggaacccgaccatccggcggattcggcgaatgataacacccgtgaaaagaaacagtccggccactccaccacaacagagaatgaggagaaccactgatgacgcgaattctgatcgtcgaggacgaagagtcgtaccgtgagccgctggtctaccagctcacccgtgaagggtacgacgtgtccgccgcggccaccggtgaagaaggattggaactgttcaccaagggtggtatcgatctggtgctgctcgatctgatgctgcccggtcttgacggcaccgcgctgtgccgtcggatccgcgagcaaagccgtgtgccgatcatcatgctgaccgcgaaaagcgcggaaatcgacaaggtcgtcggccttgaaatcggtgcggacgactacatcaccaaaccgtattccttccgtgagctgctggcacgcatccgcgcggtgctgcgccgcaaccagatggtcgccgaatccggagaagccgccgacgacgatattccgctcgtatgcggtgacatttccatgagaatcggccagcatgaggtgacggtccgcggcgagaacgtgttcttcccgctgaaggaattcgaactgctggaatacctcatgcagaacaagggccgcgtgatgacccgccaccagctgatcgaccgcatctggggctccgactatgtcggcgacaccaagacgctggacgtgcatgtcaagcgcgtgcgcgccaaaatcgaggaggacccgggccatcccaagtatctgaccaccgtgcgcggcctcggatacaagatcgatacgccaagcgaatgatgatgaaaggcttggtatagcgcgcattcgcatcgtgcttgcaaagaacggtgaacggaaggaacgtcgaacggcgaaggtgtcgtagactgttcatcttccgttcaccgtttttggtttggggcgagtgaaacgcccaataggctggagattgtcatgaagaacgatggcgacaacagaaaatcgaaaaatcagaaacatacgccatctgaatgttgacagagggaaaagaataatgcgtaactccattctcgtacgctccatcgccgctgtgtccggcattgtgatgctggcttccgtcgcggcttgcggtgacaacatcaccgcttccaccgattcttcggccaagtccgataccaagaccgaaaccgtttccggcaacttctccggcgctggcgcttcttcccagcaggccgccgtcgaagcttggatcgccggcttccagggcaccaacccggacgccaaggtcgcttacaacccgtccggttccggcgctggcgtgtccaccttcctgaccggtgcaaccgcatgggccggctccgacgcctccctcgccgataacgaggtcgagcagtccaagagcgtgtgcgcttccggcaccgccttcgacatcccggtctacatttccccgatcgccgtcgtcttcaacctgcagggcgtgtccggcaagggcaagaccctgaacatggatgccgagaccatcgccaagatcttcgacggcaagatcaccaagtggaacgatgacgccatcaagaagcagaacccgaaggtcgatctgcctgacctcgacatcaccgtggtgcaccgttccgacaagtccggcaccaccaagaacttcctgagctacgtcaaggacgccgctggcgacgcatggagctacgacctcggcgagaactggccgaacgaggtcggccagggcgccaagggcacttccggcgtgatctccaccgtgcagcaggctgacggcaccatcggttacgccgatgcctcccaggccggcgatctgggcaccgtggccgtgaaggtcggcgacgattacgtcccgttctccgctgaagccgccgccaaggtcgtggacgcctccccgctcgacgattccgccaagggtgacaaccgcgtggtcgtcaagctcgaccacaacaccaccgagaagggcgcctacccgatcgtgctggtctcctacgacgtcgcctgcccggcatacaaggacgccaacaccgccaagttcgtcaagtcctggctcacctacgtgaccagcgacgaaggccagcagaccgccgcttccgcagccggctccgctccgatgtccaacaccctgcgtcagaaggtcgtcaagtccatcgacgccatcaaaaccaagtgagcccatcacagtggggcgatcgctttcggtgatcggtgactgaccgtaggtttcaggccgcagccgcgtaaaaaaacggctgcggcctgaaacgatacctacggacgatacgcaaaaccagaaaaatcgaaagcaatcgcaagcaaaccaaaaggagaacccgtgagttcgcaaagcaaaacggcacagcagccggtgagcggcaagaacgcggataaggtgttcaagggcgtggcctacgcctgcggcatcctgatcctcgtcgtgctcgccgcggtcgcgctgttcctgctgttccgcgcgtggccgttgatcggcggtgaccagaaggccaacagcgcgaccatcagcaacttcaccggcggcaaggcttccagcttctggggctacgtcggaccgctgctgttcggtaccgtgctgatttccgccctggcactgctgatttccttcttcgtgtcggtcggcatcgcactgttcatctcgcattacgcgccgaagaagctcgccaccgccctgagctatgtggtcgatctgctcgccgccatcccgtccgttatctacggtctgtggggcggtctggtgctggtgcccgccatctacccgttctggaattgggtggccaaataccttggctggattccgattttcgccggtcccgccgccaatccctcccgtaccgtggccaccgtgtccgtggtgctggccgtcatgatcctgccgatcatcacctccatgtcccgcgacatcttcctgcagacccctcgccttcaggaagaggcggctctggccctcggcgccacgaagtgggaaatggtcaagctcgcggtcctgccgttcggcaagtccggcgtcgtgtccgcctccatgctcggcctcggtcgtgcgctcggcgagacgatggccgtgctcatgatcctgtccccgggcctcaactactccgtcaagctgctgcaggcctcgcagaaccagaccatcgccgcgaacatcgccgcgcagtatccggaagccaacgatctgggtgtttccgtgctgatcggcaccggcctggtcctgttcctgattaccttcgtggtgaacttcatcgctcgtaagctcaccgagaaagcgagtgcgtgatgaccgccgcaaataacgacgcttcgccgatggacggcgctcccgtcatcgacttcgacaagttcaagccgacccgttccttcacctcagcgcgcaagcgcaaggacttcgccatgaaggcgctcatctcgtgcgcgttcatcgtggcgttgatcccgctgttctcggtgctgctcaccaccatcatcaacggcgtcaagaggctgaacctcaacttcctgagctacaacatgaccggcgtggtcggcggcaactcgaccccgtccggcggctacggcggcatcctgcacgccatcatcggcacgctggaaatcaccttcggcgccatgctcatctccatcccgatcggcctgatgtgcgccgtgtacctggtggaatattccaaccgtggcaagctggcacaggtcatcaccctgctggtcgacgtgatgagcggcatcccgtccatcgtcgcaggcctgttcgccttctcgatgttcacgattctgatcggccccggcaccatcaacggtttcgaaggctccgtcgcactttccctgctgatgctgccgaccgtggtcaagtcgtccgaggaaatgctcaagatcgtgccgcacgatttgcgcgaggcctcgtacgccctgggcgtcacgaagcagcgcacgatcacgaagatcgtgctgcgcaccgccctgccgggcatcgtttcgggtgcgattctcgccgtcgcccgcgtgatcggtgaaaccgctccgttgctgatgaccgcaggctacatcgcctccacgaacgtcaacctcttctccggccagatgaccacgcttccggtgtacgtctaccaggagtattccaagctcaacgcgaactgcccggccaacgcttccgcggcctgcgtcaccaccatcccgatggaacgcgcctgggccgcagcccttgtgctgattctcatcgtgctgatcctcaacctcatcggccgtctcgtggcgaagatcttcgccgtcaagtcggaacgctgagcgcggtcgaatagtcgaaaacataagaacaataaggaaaacaaatgggacaacgtattgatgtcaaccatctgaacatcttctacggcgacttcctggccgtggaagacgtgaacatcaacatcgaagccaacaaggtcaccgcgttcatcggaccttccggctgtggcaagtccaccgtgctgcgcaccctcgatcgcatgcacgagatcattccgggcgcccactgcgaaggcgaggtgctgctggaaggcaagaacctgtacgacaaggatgtggatccggtcgccgtccgtcgtgacgtcggcatggtgttccagcgtccgaacccgttcccgaccatgtccattcgcgagaacgtgctggccggtgtgaagctcaacaaccgcaagatctccaagtccgacgcggatgatctggtcgagtgggccctgcgtggcgccaacctgtggaacgaggtcaaggatcgtctggacaatccgggcatcggcctgtccggcggccagcagcagcgtctgtgcatcgcacgcgccgtggccgtgcacccgcaggtgctgctcatggacgaaccgtgctccgccctcgacccgatctccaccctggccgtggaggatctgatcaacgagctgaagaacgagtacaccatcgtgatcgtgacgcacaacatgcagcaggccgcccgtatcgccgactacaccgccttcttcaacctgaaggccgtcggccagccgggtcacctcgagtacttcaccgacaccaccacgatgttcaacaacccgcagaacgaagaagccgaacgttacgtctccggacgttttggctgatcgataaggccgattcgccaaaacgtagtgccaacccggtgggttggtgcgagtcagcttcagctggccagttaatagcgcttcgctgtgcgaaactctgtaattgtacgttttggctgatcggcagctccttttccccgcaaaccgacgttgagattgctctcggcgtcggtttgttgtttttcttgtggaagcgacacgcgctgttgagaatcattctcagttacggttatgatggattcaccgaagcatgaagcgtatgaaaatggaggaaccatcgtgaaccgttatgcaagaattgcgattgccgtactcgcttccgtcggccttctcacttccgcgtctgcctgcggaacgtcgcagaacggtgccggttccgcgcatggcgcgatttccgtcgtctcctccatcaaccaatggggcaccctcgccgagcagctcggcggaagcggcgtgcaggtgaccagcatcatcaactccaccaacgtggacgcgcacgactatgagccgaccacgtccgacatcgccaaactgcagaaggcacgaatcgtcatcgtcaacggcgccgggtacgactcatgggccgtcaaagccgcgcaatccgccaaatcgcaagtcatcaacgcggcggagatcggtggcgtcaaggatggcggcaacccgcacgtctggttctcggcggcggtgcgcaaagcggtcgcacaggccatcaccagggcatacgagggcacaaggcccgacggcaaggccgatttcgacaagctgaaccagcaatggcgttccaaggaagacgaggtcgcccgaaaaatcacggagaccaaacgcaaggcggatggcgaagcctatgccgccacggaatcggtcgccgaatatttggccggggacctgggcctcaaagacgcgacgccgaccggctacatgcgtgccacggccaacgaaagcgagccaacgccgaccgacatcaaacagttcaccgacatgctggaggccggcaaggtcggcctgctggtggtcaacattcaggaggagaccgagttgaccggcaagatcgtcaccgccgccaaatcgtccaatattccgatcgtggagctgaccgagcagatgccggagcagtacgattccctgacggactggatggccgcgctcgtcgacgcgttctcccaagccatctaatgcggatctgcgtcaaaccgatacgaaagtcgataaaaaaagggcgattccactgaaggaaccgcccattttccgtatgaaaaggactgttacagcactgcggtgatgatgaagtccagaatgaacagcacggccacgacccagatcaccggatgcacgtccttggcctgcttcttgcaggtcttgacgatgcagtaggtgatgaagccgccggcgatgccgtaggagatggagtagctgaacgccatgaacacggacgcgaagaacgccggaatggcttcggagatgtcgccccactcgatttccttcaaggaggaagccatcatgcagccgaccacgaccagcacgcctgcggtcgcggcggacggcacggcggagatgaccggggagaggaaggcggacagcgcgaagcagatcgccacgaccacggaggtcaggccggtgcggccgccggcggcgatacccgcggaggactccacgtaggtggtggtgttcgaggtgccgcagatggctccgatggaggtggcgatggagtcggcgaacagggccttgtccatcttggaggagaagccggaaccgttctcaagagccttctcgtcctcggcggagaagatgccggtacgacggccggtgccgatgaaggtgccgatggtgtcgaaggtgtcggacatggagaacgcgaagatggtcagcaggatgatcggcagcttcgacacgtcggagaacagcgccgggaagccatccttggtgaagatcacgccgaaggtctgcggcagctgggcgaaggtgtcggcgatggacacggagttggccatggtggtctggcccatcggaatgccgacgaccgcggtgacggcgatggcgatcagcatgccgccgcgtaccttgagcacggtgagcacgatggccagcaccaggccgatgatgaacagccagatggtcggattgttcatgacggcaaggcccggggtggcctgcacggtgtcgccgctcttggccgcggacttggtggtgaaggtgaagaaaccgacgttgaggaagccgacgtaggccacgaacaggccgatgccgccgccgatggcgttctgcagcacttccggaatggcctggatgatcatcttacgaatcttggtgacggtgatgatgatgttgatcaaaccgcacaggaacaccatgcacagggtttcctgccacttgaagccgaggccgaagcacacggtgtaggtgaagaacgcgttgaggcccatgccggcggcctgcgcatacggaacgttggcgaacaggcccatcacgagcgtgccgatgatggccgcgatgatggtggcgaggaacacgccgccccacggcataccggtcgaagacaggatctgcgggttgacgatgatgatgtaggacatggcgaagaacgtggtcaggccggccatgatctccgtggagacggtggtgccgttctccttgagatggaagaatttctccattttctcttttctcatctttcttgggttggtaggcgcgtgccatatggtggcgtgcgccggcgagaatcgcgactcgcctgggacatgcgtccctgaacaaagcaaacgtagcacctatgtaagtcatggaaatttcgtgcgattggtaaggggttgcttttgcggcggcgcgacacgccggtctggattagtccaaacgggtcagtaaattacccacttgtaaaccacagaccgttggttggagcgtgcaagcgctcacgaagtttggttcgccaagccagcgcaggttgaagaacatacgcccaccaagggctttccgcttagcggtcgaatgttgctctgcctgcgtgcagggctttttttattgccctgcgaggtgttccgaatctcacagtcaacggttgactaaggaaggaacgccatgaagaggcccgaaaaggaagcggtggtcgctcagcttacggacaagttccgtaacgccgacgctatctacctgaccgagtaccgcgggcttaccgttccgcagatctctgaactgcgcgaaaagctaggccgcgatacttcctacactgtggcaaagaacacgctcgttcgcattgcagccaaggaagctggcatcgaaggtcttgatgaacttctcgccggcccgaccgctgtgaccttcgtgaagggtgacttcatcgaagctgcgaagaccctgcgtgacttcgccaagaccaacaaggcactgatcatcaagggcggcttcgctgatggcaccgtctacgatgctgaaggcgccaagaagctggcagacctcaagtctcgcccgcagctgctcgccgagttcgccggcgacatcaaggctacgatgtccaaggccgcgtacctgttcaacgctctgccgaccaaggccgtgcgtacgatcgatgcgctgcgcgagaagcaggaaaaggctgcctgatttcgctgcggctcgccgcatgaatgaagcaaccacaaaaaagaaaaacaattgttttaggtgacggccacctcttcaattcagtccgtcgccaagaatgaaaggaagccattatggctaagtacaccaacgatgagctgctcgaagctttcggtgagatgactctggttgagctctccgagttcgtcaaggccttcgaagagaagttcgacgtcgaggctgctgccccggtcgccgctgttgccgccgctccggctgctggcgctgctgctgaggaagagaaggacgagttcgacgtcatcctctccgccgttggcgacaagaagatccaggtcatcaaggccgtccgcgctatcaccaacctgggcctggctgaggccaaggctctcgtcgacggcgctccgaaggctgtcctggagaaggccaagaaggaagacgccgagaaggccaagtcccagctcgaagaagccggcgccaccgtcgagctcaagtgattcgcgcggcttcaagccgcaatcaccaagctgtaatggaaaccccgtttgccgtaaggcagcggggttttccgcatatggagcatgactcaggcatgttctaaaatgggggaattaggcgaaagttgtcaatttatcggttcggaatccttactttcgcgatgaatcatgacacaatggcagatagtgtagtgcgaaaggaaggccgacaacggtgagcgaggatcgacgaatgacgcggcagtggaccgtcaaagttgacggaaacaacgtgaaaacgcttcatgacggcgaaagcgtggaaatcgggcgcaaaccgttgcgcccgctgtcggatgacgggttcgctcgtctcgacatcatggatccgggcaagtccatgtcgaaaagacatgcggtcctctccgtcgacaagcagggcaattgctccgtacgagatctgcattccaccaacggctcgttcgtggtgacgaacaacggccaactgatgcgcctgcccgcaggcgaggacatcaagctgcccatcgactcgatgaccctgcagttcggcgacgtgcgtcttacgctcgaatccgcattcgaacacgatgacgaggatgacgacgccacctccggtgtctcggatgatacaagccagccggtttcgaacctgttcgaatacgcggtctccgacgaggctccgcaggaaccggatgcagccgacatgtccgtggacgacatcctcaatctgcgtgccggcgagccgacgacgttcttccacgcgcgcaatgtcaccgaccgtgccgatgctctgcaccaggcggaacgtcagaccttcacgccggagcatgccgacaagccggaactcgaagatgcattcccctcggtctccttggttcaggaaaccgtcgtggccgcggacaagccccgcgacctgttcgccgacgccgcagcgcaggccgaggctgaagctgagatcgaggccgatgcggccgattccgctgatgcggctgcgaccgatgccgaggtggctgccgtctcaaccgagacagccgctcagcccttggaagcatcccatgacggtaacaagaacaacctgattccggtggacaagctgttcagcgcgcgccccagcacgccaatcgccgtcgctctgcccgacaggaacgacactggcgataacacaggcaacgttgacaaggctgacaatgcggctgacgcgtccgcccaggaacagacgcagtccgccgaacaatcgcagatggcggaacagcccacatcggaaacggccgaacagcagcccgccgaacagcagtcgaagccgatgcacgctacgcagccgcagacggaacagccgggaacggtgaccgcggaagacgacgacgagcggttccgcccgcaaaacagccaatcgcagcccgcgccggacgaaaccgccgcattcaagccgatcttcgaaccgggatcggtattcgaccgtgtgtccaaaggcggcctcgccaagcaggagcagaccatcgaggtcgacggcctgacctccgatgacgccaaacgcacggatgatttcacagtgcagttccagatggcgcgtcatccggaactgttgccgttcctcgccatgaacccatccctatacgatgacctgtacgcgtggttgggcgcattgggcaaccaagacatcgatgcggctttggcacacaatccgggatatgaggaataccgcaaggcagtagggaagtgagtcggtatatgagcgaaaacgaagagacggccaccgcgttggaccgtatccgcggatggcgtgaggagtatcgccttggtctggcaccatccccgcttgaggatgtgacgcaactgagcgcccagcttgacctgacgcatgcgcacccatcgggcatcgcgcagctgttcgccaaaggacacgtcaccttggactcgttgttccgagacaacggcatgctgcgcgccgcgggcaggcgtgtggaacgcgtgctcgacgaccgtgacgcgaaaagccgtgtcagcggcgtcggcgaactctccttggtggtcggcgtggccatttggaaaggcaaccagatgccggtgctcatgtatccggtcgaagtgcgcaaggaaggccgcaacatcgagaacggcaccgtcatcgcgttcaccggacgagtgcgtctgaacgcggccttcgccgccgtgatgcgtgaaaacaacgtgacattggacgagaccaagctcttcgatggttcgaattacgaaagcggcacccccgaaacgtccgcggtgttcgcggccatcacagcgcgcgcgtccagcgttttccccgatttcgaaatcgaacgtcacatcatcctcggctgcttcatggacccgtcctcgcagatgctggtggaaagtcgccagatcatcaaccagctgtcccaaggcccgacaggcaacaccgttctggacgcgctcgccgggaacaaggaagccgcggacgcgctgaaagacgcgcagattcccgaatacagtccgttcgacgccgatccccatggcgaatacgagattggcgacgttgacaacaccgtccgatacgcggcgcagctggccgcatccgggcattcgattttcgtggacagcgcgatcagcggcaacacggccgaacaggccgcggcaatcgcctcccgttgcgtgatgggcggacacagcgtgctgtacgtgccgtgcgtcaccgaccaaaagcgccgtttcatgcagacgatcgcggccaacgagatgagcggccaattgctggacatcgccgatgacggcgccaatgcggcaatcgaccgtcagctgatagccgcagtcggtttccaatccggcgtcgcgacttcgcgtttcgaccagatctccgacgaactggtgggcgtacgctcccgcctggcccgctatctgggcgacctgcatggcgtcagccaggaatggggcgtgtccgcataccagaccatccagaacctcgcacaaatcgccgtcctgcccacgcatccgaccacgcatgtgcgtctgaccaagcagtccgcccattccatcgcggacaagatggaggaatgggcccagaagctgtatcgcgcgggagaactcggcgaatacaccatcggcgcgcaggacaccgcctggtacaaagcctccctgtattccgaagaggaagcgatcagcgcataccagcgtgtggtcgagctgctgcgcaaggtgctgcccgccacccgcaaacaggtgtccagcaccgtgcagacctgcggcttcccgattcccaccaccgcgcaggagtggggacgccaggtcatggtgctcaagaacctgcgccgcgtgctcgacgtcttccagccggaaatcttcgaacgcgacatcgattccatgatcgaggccaccaagcccaaggcccagcgcaaggccgaaggcagctccatgggattctgggaacgtcgccgccatatcaaggaggccaagtcgatgctgcgcgtcggcgcgcaggtggagaacctgcatgagacgctgctcgtggtggccaagcaggccgaacagtggcacatgttcgttcctcacggcggatggccggtgctgcccgccaaactcgacgacatcatcaacacgcaggaccagctgacgaacgatatgaccgcgttgaacgtggcgctcgccaccacaccgcagggcggcaatctggacaccgtcgacctcaaccaggtggaagagcgtctgaaggccctgtatgacgacaagcaggcgttggatacgctgccggaacgcgcccgtctggaacgtgagttccattcggccggtctggatgagcttgtggcggacctgagcaaccgcggcgtgccgaacgacgccgtggccggagaactgcagctggcgtggtggaccacggctttcgaagacatcgtgaagtcctccgccatcatttccaaccaggatggctccgccatgcaaagcgccgccgaccgattcacccaggtggatgtcgaacacgtgcgttccatcggaccgatggtcgcccaagagtccgtacgccgtctgtgcgacatgcttttctcccgcacgcaggaagccaatctgctgcataccacgcttgccggttcccgaaacgtgccgttgaacaggctgcgcagggagcatccgcagattttggccgcggcaaagcctattctggtggcaacgccagccacgctcgctgccatcaccgacccggcgccgcttgccgataccgtcatcatcgatacggccgcgcatattccgtccatcgagctgctcagcatcatcgcccgcgcgaagcaggtcgtggtgatcgcgcaccgcaagaccgtcacatccgatggcctgcagcgactgatcgcactgctgccaagcgtgaagataaccgacaggccggttcgccgtgcgccgaagctcaacgccttcctcgaatcggaaggatacggctccgtgccgtgcgatgtggcgcgtgaaggataccaaggcgaagtcgcgtaccatttcgtgccggacgccaacggtgtgccggtcatcaattccggcctggtcgaatcaagccagcaggagatcgacgaagtggtgagcatcatccgcaagcgcgcggccggtttcaccatcgttcccgcatcgtatgtgcttaccgtggtagcgctcacgcacacgttccgcatccgtctgggtgccgagctcaagtcgcttgccaacaaagacaaggccatgggcatgttcctgcgccacgtgcgcatcgtggacatcgtcgatgtggccggcgcccacgccaccgacgcgattcttgcgatgtgctacgccaagacctcgcacggcaggctgctgcagcagttcggcgcgctggaatccgacggcggccgaggcatgctgctggacgctttggcggtaccggaccgtcatctcgacatcgtctcgtccttcgcatccgacgatatggacgacgagcgactgcatcaggatggtccgaaggcgctcaaaaccgtgctgcgttgggccgaacagcttgatgacagcatggtccgcccggcgatcaaggagtccggagagaacgtgctcttcaacgatctcgccgagaggatccgcgaacgcggcttggacgtggccgtcgattacggtttcgatgacggactcaaactgccgttggtggttggtctgaaaggcgagccgttcgctttggccgtgctcaccgatgacgcgcagttcatgggactgcaatccaccagggaacgccatcgcgtgctgctgcaggacatcgaatcgcttggctggtcggtgatgacggtatggagcgtcggcgcgttcgtgaaccccgataaggaagtcgaccgcatcgtggcacgactgggaagcctgtaccgggaggaacggtgagcgccgagcatatcgaaaacgtcatggagcatgacgattcgcagacccagtccgagacgcactccacacccagttattccgccacgcggcggaccgcacgcaagcataagcgcgtggtccgccaaggtacggaactgttcgatgccgatggcgtcaaactcgaaccttcggacgtgctcaccaagcgccaacgcgaggcggatgacgacaagcgcatcctaaacgagcttccgccacattgggcggtcttctccgaacgcggccgctgatacgtccagccgggtgccagctatcgattaggattatcagccattaattgatggtggcgatgaccgcactgtattcctgaacccgcaacacgacggccgcctcattgggcggcatggcgaacaccgcgatggtattgccttgcgcatccttagccggtttgccggtcagcagcgcttcggcgcagatcgtgtgtaactgcgcatccacaccaccgtccggcatatcattagccatgccggacggcgtttccgtaccgttcggcatatccgcgacattcggtgtgccggactgcatctcagcatctgtcatggtggcgctggaaagtgtcaccttgtctccgggaatcaaaccgccggccacacttgccaaacgcacttcgatactcgtatggccctgcggcacaacgggggacgcacgggccatgcccgacataagcacatcgtgcgcgccgatgcccacctgtgcgatcaagccgacggcgtcgtcaagcgtatggaaggcgttgctcagcgagccatcgctcggcgcctcacgtaactccacgtcttcgcgtgtgatggccgtgcctttggcgacattccgcaccgcgaccacaataggctgcgtggcgatggctgcgcgtacgcattgcagcgtggcgaataccgtcaggccagcgcacaatgcggcgaggaaccgatgcaggcgtgcgttgcttcgtctggcttccaacgatgcggcagtcgaaccatgacggtctcgttgcagacgcgtcgtgcgcgcggtccgtccttccgaagccgtcgatgtgcgcaaactcgaatgtggccggcggtccatcaaggaatgaaaaaaggtcatcatgcatgcatgatgacctgattgttatgaccacggcaagcggaatccggggttgtggtcggagaatgggagttatccacaatctccggcgtgtcgcgttggattccgcgcctgtgggtcacttggatttgtcggtgcggtagaagccggaccccttgaactcgatcggcaccgcggaataaaccttgcggacctgctcctcgccgcattccgggcatacggtaatcggatcgtcggtgaatgactgctgctcggtgaagtcgtagttgcagttcttgcaacggtaatggtaagtaggcacgatatcctcgctttacgcacaatcccaaatttcttaacgggacatatcctagtacgttccctgagacggccccgcaaccgtcctatcctcggacatcggcataaccatccggcgtgagcacgccgtcgacgggaatatcatgcggctcatgcggcacggtctcgtcggtcggctcccaaggccagcaaacggcgaccacgcgcgcggtgctgctacgatgctccaaagcgcggtcgtaccaaccgccgccgcgccccaatcggaaaccatgttcgtccacagcgaacgctggcacaatgatcagctcggccgaagtgagaacttccggtccttccgctgcgttttccggctcctgcgggcgatgtgtgttgatggaaccatcagcattgcgctggtcgcgcagatcgtcaagaccgttcagctcactccagccgacttccatgccagcacccagacgcggcaccaaaacacggcaatccgtgtcgaacatcgcttcgagcaacggcatcatcgatatttcactgcccatcgaggcgaaggccgcgacggtcgatcgcggtcgaatcaacgacgcttccaatgcgtgttcggcaagcagccgtcccgcttcgcgacgctggtcggcggacgtccgctttcgtcgttcgatcgcagccgcgcgccaatgccgtttcagctcgcgttgttgcttacacatgtccatatcgttcgttgtaccacggttcgattgcgtggaaaacggaacatggggtatgggtggggcacaatggaagggtgacgattttgcaatccttgagcgacatgatgcgtcgtccggggaataattcctttgaaatgccggaattcatccaatcgcacagcatgcgcgtcccggtgagtctgcgcccgttgacgggcgccgactatgacgagtggaacgaggttcgctggcgcaacgatgcctggctcaagccgtgggaatccggcgatccgctgcacggcgcgcccatcacctacaaggaatggatgaaacaactgcggcgcaacgaacgggccggtaccggtgccgtgttcgccatcgaacagcatggccgtatcgtcgggcagatctcgttgggcgcaatctgctacggcgcgatgcgttccggcgtggtcggctattgggtggacgagcgttgcgccgggcgtggctacgcgccgatggcggtggcgctgttggcggattgggccatgttcgacccggccggacctcgactgcatcgcatggaaatcgacattttgccggaaaacaagcggtcccgtgccgtcgcacgcaaggtcggagcaacgttggagggggtgcggcgcgcgtatatgtacgtcaacggccaatggcgcgatcatgaaagctacgtattgatggccgaggacgtgccaaacggtttcaccgcgcgtctgatgacagggaattcaccctcctgattcgacacgccggggaggactcgcctcgaatgtcggaatgtcacctattcttatgacatatgggttatgaatcgttaagcacggtggtcgtgcttgcgatcgttgtcatcctgatgctcatttggttgcccagacggacgattaaaggcatgaagagggtgatcgaacatcgcgaggaccgcttttcaccgtcgttgcatctggtggatgccgacagcggaacgcgattttccgatgagaccgtcgcggcagcgaaaggggtactgatgcagtccacagaggcgcacaaaggcgcaacatccgaagaacggatcgcggaaattcgcgcccttcgtcacgccgcggtccgcaggaggcgcgccatcgccgtctcattgctgacaatcacggtcgttgtgctggtctgtgcgttcgcactgcacttcagcccgctgttcgcgctcattccggccgcgttgctggccgcggtgctcgcgttgggtgtgcgtgcgtccaagcaggccgtggcgtgggagcggaaggtcgccagataccatgccaaggtgaagaagcgtgtcgccgccgaacgcaaacgtgcgcaggcggagcaggcggaacgtgccagactgcgcgcgcaggagctggccgaagcccgcaaggtcgtcgacgagcagttgaagaccgatgtcgttcccgagggggagattcgccaggcgatcgcccgcggcaaggccgatcgggacgccgcggtgaaacggcgcaaggaagagatgtcttccaaggaagagacgcagactgccgagaaggccgtcgaccagacaaccgaacgtgcggatgccgcgcccgctgacgtcaaggaagtgggactgtccatccacgatgagcgagacaatatggccgaagaagccaaaaccgttgccgtcaagtccacgcaggacttgatttccttctcgttgggtgcgcctcgcgacggtgccgacgttgaggtggatgctccggaaagcatggagatcaagtccaccaaacaagtggccaaggccgtgcccgtcgaaacgccttccgacgaggctgagccgttgattccgccaaacgacgcaatgggcagcatggatgccgatgaggccgccgcccgcgtggatgagggcgtgcacctcagagaggtcgacgttccgggattccacgatgccgaagtacgtgccgatgtggaggctccggatgtgacttcggactccctaggcaccggcctggaggccattctggcccgtcgtagcgcctgacgaaacgcttgaaccgttttttacaaagcctggaaccgcatggtttcaggcttttttgataatttctctcagagcgttagcactcgagttggcagagtgctaataatcgcgctaggataagtcacagcgcgaaaggacgacgccgtaagtgatcgtcagcctcttgctagcgggtcccggcgcggtaagtatcgatttctctttagaaagaggaggtccacagtgtcgatctcactcacaccgttggaagacaagatcatcgtcaagcaggcggaagccgagacccagaccgcttccggtctgttcattccggacaatgccaaggagaagccgcagcagggtgaagtcctggctgtcggcccgggccgtcgtaacgacgccggcgagcgtatcccggtcgacgtcaaggtcggcgacaaggtgctgtactccaagtacggcggcaccgaggtgcactaccagggcgaggattaccttatcgtctccgctcgtgacatcctggccatcctcggctgagactagcgcgtagctgtcgaaaccccgtttcccgtatattgcgatttgcaaggctcgggaggcggggtttctgcgttgttcggcgccgatttgcgcaaaacgttggaatttcaacgatttgcgccgtttttggctgtcgcgacacgccgtatttgcataagtcggccggtctgtggcatactaaacgggttgccggttggggttcaaccaaacaggcagcacggcggatttcccaagcggtcaaagggaactgactgtaaatcagtcgcctcgtgcttcagtggttcgaatccactatccgccacgcctcgatagctcagtggtagagcacttccttggtaaggaagaggtcgtgagtccgattctcactcgaggctctcatggcgggatagctcagctggctagagcgtacgactcataatcgtaaggtcaagagttcgagtctctttctcgctacaaaggccgacggaatgtcggtatagcaacgaaccacaagaggtgaactaaatggcaagcaagagcgccgacattcgtccgggcatcacgctggcatgcaccgagtgcaaggagcgtaactacatcacgacgaagaaccgccgtaacacgccggatcgtcttgagctcaagaagttctgctcccgctgcggcaagcagaccgtgcatcgcgagacccgctgagcggaatcaagctttcgaaacccgaccaatttggtcgggttttttgttactctggagcgttatgactagttttgcagatctcaccaccatcggtgtgggcggtcctatcgccactttcctggaaccgaccacgcgcgtcggcgtcatcgaagctgttgaggaagccgattcccaaggactgccattgtgcgtgatcggcggcggatccaacatgctcgtatccgacacgccgttcgaaggcgtggtggtccgcgatgcgagacgctccatcggcgtgttggatgaggcggctccggtcgaggatgatgggcgtgtcgtccacgtgaacgccgaagccggctgcaactgggatgatttcgtcgattactgcgtccgacttggactggaaggcgtcgaaggcttgtccggcattcctggcaccgtcggcgcgtcggtcgtgcagaacatcggcgcgtacggtcaggaggtcgccaccagcgtcgacagcgtcgaggtttgggatcgtaaggaacgtgcggtaaaggcgttgcgcaacgatcagctcgccttcggctaccgcatgagcgcgctgaaagccagcatgtacagcgctccggcgactccggccgcggaatttttcccgacgccgcgatacgtggtgctgtccgtcacgttcgcgttgcggcacagcgatacgggcgtggtcggttacggtcagctcgccaaggcgttggacgtcgccgtgggcgatcgcatgaacaccgcggacatccgcaacgcggtgctgaaggtgcgtgcggctaaaggcatgctggaagacgcgcatcgctatgcgtcgccggccatgcagggcaccaagaagacgaatctggtcgatgtcgctcttgaatcgcaatccaagcagaacggcgatgacggtccggacttcaaccgccatagctgcggcagcttcttcatgaacccgattctcacgccacagcaggccgagacgcttcccgaagacgcgccgcgcttcgacgcggcattgccgggcggcgggcagggcgtcaagacctccgcggcctggctcatcgaccatgccggcttccataaggggttcaaaatcaacgaaaacgctccggctggcctgtccacgctgcatacgttggcgttgaccaatcgtgggggagcatcagccgaagatatcgcccgcctcgccaaaaccgtgcaggacggcgtcgaggccgcgttcggcatccgactggtgcccgagccggtcgtcatcggtatgaatcttaaatagcgtcacgcacgccgtcaatgtgacgaaaacgacttatacttgcgccttgtgctctagaaggtggagcgtgaaaccgcgcgggcggaaagaagagaaggacgagacatgaacgtatttcgcaagaaatccgtcgaacagacgctggctgaaacaggtgagtccggccatgcgctcaaacgcgatctgacctggtgggatcttgccatcatgggtgtggccgttgccgtgggcgcaggcatcttctccatcggcgcgcaggcggctgccttccatgccggtccggcggtggtgctgagcttcctgatcgcaggcgtcgtgtgcggcgccgccgtgatgtgctacgccgaattcgcctccatgattccagtggcgggttccgcctacaccttcacctacaccaccgtcggcgagatcgtggcatgggtgattggctgggatctgatccttgaaatgctcatggccggttcggtcgtctccaaatactggggcgtgtacctcaaccagttcttcgagctgatcggctggaacatcaacaccaacatcgccatcggctcgttcaacttcgacctggctccggtcatcatcgtcgccttcttcaccgcgctgctggtgatgggcaccaagatcggcgcccgcgtggacggcgcgctcaccattttgaagatcgccatcgtcgtgttcatcgtggtcgtcggcttcttctacatcaaggccgaaaacttcaccccgttcattccgccgagcgaacccgcagcatccaccgacggctccggcgtctccgcggtcatggaacagccgctgtggcagtgggccacaggcatggcccccagcatttatggcgtgaccggcatcatctccggcgcggcactcgtgttcttcgctttcctcggcttcgacgtcgtgtccaccgcttccgaagagaccatcaaccccaagaagaacgtgccgctgggcatcggcgtgggcctcggcctgatcatcgtgctgtacaccctcgtggccatcgtcaccacgggcatggtctcctataaggaccttgccaaacagtccgatccgtcactggccgtcgcgttcaagatggtcggcgccgactgggctgcgaagatcatcagcctcggcatcgtcatcggcatggccaccgtggtcatggtgctgctgctcggcctgacacgcgtggtgttcgccatgagccgagacggactgctgccgcgtggcctgagccataccggcaagcatggcactccggtgcgtctgcaaatcatcgtcggcgtggtcatggcgctgatcgcggcctgctgcaatgtcggcatcctgtccgacatggtgaacatcggcacgctgtcggcgttcacgctggtggcgatttccattccgatcatgcgcaagaagcgccccgacctggaacgttccttcaagattcctggcaatccgtgggtgccgattctgattgcgctcgccaacctgtggctgatggtcaacctgagcgtgctcacttggatccgtttcgtggtctggctcatcgtcggcttcgccatctacttcggctatggctaccgtcatgcccgtctcggtgccggcgaactcgaagttgccgcgcaagagtaatctggaacagtacacgttgttgttgaggaggtaagcatgccgtatgttgttgcccagccgtgtgtggacgtcaaagacaaggcctgtgtggacgagtgcccggtcgattgcatctacgaaggctcccgttccctgtacatcaatccgaacgaatgcgtggattgcggcgcatgcgagccggtgtgcccgaccgaagccatcttctatgaagacgatctgccagacgagtgggcttggtacaaggacgccgcagtcagcttcttcgccgaagttggtgatatgggcggcgcttccgcagccggcccgatcggcaaggatccggagcaggtagctgctctgccgccgcagaaccagtgagcatgtcttggctgatgcgtccgccgtccgtattgcgcgtaaagcggaatattcgcggtcgattttaaccggtttgccgctgacgtttgcacacgtcagcggcaaaccggtttttgtatggaacggttgcatgtgccggcacgtcgattgccgtatgctggaacatggttgtgatttccgcttgaaaaggagccttacggatgggttttcatgaattttcatcgccgtacgactggtcccgcatcgcgtcgtacaaacgtacggcgaaagccgcgttcggtggcatggtcgacctgtccgtcggttctcccgtcgaccccgttcccgattcggtgcgtaaggcgctcgcggtctcgtcgaacgacccgaacgcgtacggatatcccgttacggcaggtaccgccgatttgcgtgacgccattcacgagtggttcgcggccgcccgcaatgtcgatttgcgtgcgatcggcgccgatgcggtgccgacggtcggttccaaggaaggcgtcgcgttgatggcgtcgctgctgcatttcggcgagggcgatgtcgtcgtgcagccgaaggtgtcgtatccgacgtacgagatcggcacgcagttggccggcgcgcaaacgctgaaggtcgacgacgtggcggatgcggattcctggaaggatgtgccgggcgtcaaggccgtttgggtcaattcgccgtgcaatccgaccggtgaggtgctgtccgcggaacagatggccggtattgtgcgtgccgcgcgcgcgattggtgccgtggtgctgtccgatgaatgctatgcgttgatgcaatgggaagacgacgttgcggaagcggatgcggatacgcttgcctccacgccgtgcgccttgcgcgccgatgtgtgtggcgggtccgccgaaggcgtattggtgctgtattcgctgagtaagcaaagcaacatggccgggtatcgtacggcgcttatcgctggcgatcaatcgctgatcgggccgatggcggcataccgcaaacagatcgggcagatcattcccggaccggtgcaggctgcgatggccgccgggctgcgtgacttcgacgcggtcaagacccagcattcccgttaccaggagcgtctgggcatgctggtgagtgctctgcgcgcatacggatactgcaccgacatgccgcaaggcgcgttgtacgtgtgggtgaaagccaagtccggcgactgctgggaggatctgcgccagcttgccgaaatcggcatcgtcgccagccccggcgagttctacggagcgccggaatacttgcgattctcggctacggccagtgatgcggcgatcgcctccgccgcggaacgattggcacgttgacggtttgctgacgatggccttttgacgaacgaaagcgttgaaaacaaaaaggacctccgattcactcggaggtccttcattatggcggagtcagagggagtccaacgcccatgcgtcttatggctatgtgcagctgttgatgtcgctgatccaggagtggcgtgcgctactcaagcgtccggaactaccattcatattcgcccaattgccgaactatactttggaacccgattgcgattggccaaggctgcgtgatgaacaacggcgcgctttgacgttgtggaacacggcgatggtggtgacgatcggatatggagaggataatgacctgcatcctttggataagcgccatgtcgcgcagcgcttggcaacggctgccgagtcgttggtttatggacgtgatcgcgagccgatggggccgcttcctgtcatggcgattcacaaggatgacggcattgagatctccttcatccatacgggagggggattggtctgcacaggcgacgtgccttttgacatcttggagccgggaggctcgatatatcgggtgaaggctcgtcggtacgattgctatggcggtaacggaaccgggcgttcgagtggcgcagtgagagagctctccccagtacagtgtcagtttgtcggccaatgaagcatcgatgataacgctattgccggggacagcgtaaatagtttttgcagttaatcgtgtttgggcggaagcctgtaatttcctgcgtttggaatacttaaatctattcgaaagtttcgtaaatagttgcatatagaactttcgtaacaaaaaatttaagcatttagttaagcgatttgactttcttgaaagtcaaatcatataatcaaacagtgctttggctgaaatgctaaagcatttacgaaacatgaagatgtgtgttcgtgcatgtcgctaagggagaaagactttgtattcccacatccgatattggataaggagatgcagcaatgaagtttgaataccatgtcaaaccaaccggcaacgatgctgcgtgcggcgacacggagcatccgttcgccacgatttccaaggccgcgcagatggcctctccgggtgatacggtaatcgtgcatgaaggcgtataccgcgaacaagtcaatccgagacgcggcggtctgagtgaacatgagcgcatcacctactgcggagccgaaggcgaagcacggccggttatcaaaggctcggaatgcgtgcagggctggacggaattggccgatcatccgcatgtgtggacggtggtgcttgataatacgatgttcggggatttcaatccattcgcgaccccgattttcggtgactggctggaaatgcccaagttcggcaaggatccggacaaacatcttggcgatgtgtatctcaacggtgtttccttcttcgaatcgacgacgttggaaggcgtatacgatccgcagccgcgtgatacggatgaggatttcgcgttgaagattccctgccccgtgccggatgtggaccgtacacgttatgtatggcatgccgaagtggacgaaaatgccggcaccacaacgatctgggcgaatttccaaggtgccgatccgaatgaggaactggtggaggtcagtgttcgtcgcacatgcttcttcccttcccgcaaccatgtcaactacatcaccgtgcgtggctttgaaatggcgcaggccactggagattgggcgccgcctacctcgcagcagtggggcatgatcggcccgaactggtcgtatggctggatcatcgaagacaacgtgctgcatgacgccaaattctccgcggtgtcattgggcaaggaaatctcatccggcgacaacgagtgggcgaaaaccgagcgcaagaccggttaccagtaccagttggaggccgtgttcaaggcccgtcgcatcggctgggaaaaggggctgatcggcggtcatatcgtacgcaacaacgacatctacgagtgcggacagaatgccatcgtcggacatatgggcagcgcattctgccgtatcgagcataaccatgtccatcacattgcgttgaagcgtgaattcttcggatgggaggtcgctggcatcaaattccatgccgcattggatacggtcattgccaacaacaacatccacgactgctcgctgggcatgtggatggattggcagacgcagggcacgcgcatcacgcgcaatgtgttccacgataacgtccgtgacctcatgattgaagtgagtcatgggccgtatctggtggacaataacgtttttgcctcgccggtgatgttccagaactggtcgcaaggtggtgccttcgtcaacaatctgatttgcggcggcattgaaccgcataccgtccccgaccgttccacgccgtatcactatccgcacaccaccgaggtggccgggtgcgctgtggtatccggcggcgatgagcgttggctgaacaacatgttcgcgccgcaaccggtgaaaccgaccgtcggtgaatatggtttgtccgcctacagcgattgcccgatgtcgatgcatgaatacttggaacgccagcgggccatgtgggcagatccttcgcagggtggtggcgagcgcaatcctctgcagtctctatacgcgggcggcaacatctatctgtccggcgcacaggggctgaacaagcaggaaggtgcggccgacgattcggagcgcatgcaggaggacgccccgttcttcggcggcaccgcctccacgagcgttgcatgtgatgagcccatgccggtgacattggtcgaagaacccgatggactgtacctgcagtgcactgtgccacaggccgtcaccgataccagaatgcaggtcgtcaccagcgatatgctcggcgtgcctcgcatcgtggaggaacgctatgaacagcccgatggcagtgactatgtgctggacaccgacttgctgggacaagccttgacggcaacggaacgcaaggccggggcgttgaatggtcttgtctccggagagaatcacatccgaatttgggaatggaacaactgatatgacaaatgcaaccgataccaacaagacattgggcgagtccatgttcgcacagtgcggatatgcccaggacgccatcgataagcgcgtgtcacaggtctggcatgaaattttcgaaggtccgaacaaattctattgggagaacgacgaaggtcttgcctatgtgatggacaccggcaacaacgatgtacgtaccgagggtatgagctatgcgatgatgatcgccttgcaatacgaccgtaaggacgtattcgacaagctgtggggctgggtaatgcgtcacatgtacatgaaggacggtcatcatgcgcattatttcgcatggtcggtcgcgccggacggtacgccgaactcgaatggtcctgcacctgacggcgaggaatatttcgcgatggacctgttcctcgcctcccgtcgctggggtgatggcgaggatatctacgaatattccgcatggggacgcgagatcttgagatattgcgttcataagggcgaacgctacgacggcgagcccatgtggaatcccgacaacaagctcatcaagttcattccggaaaccgagtggagcgatccgtcctaccatctgccgcacttctatgaagtattcgccgaagaggccgacgaagaagaccgtccattttggcatgaggcagccgccgcaagccgtcgctatctgcaggcggcctgcgacgagcggaccggcatgaacgctgaatacgcggattatgacggaaagccgcatgtcgacgagtccaatcattggcatttctattccgacgcctaccgtactgcggcgaatatcggactggatgcagcctggaacggtccgcaggaagtgctgtgcgaccgcgtcgccgcgctgcagcgattcttcctgacccacgaccgtactagcgtctacgccatcgacggcaccgccgtggacgaggtcgtgcttcatccggtcggattcctggccgcgaccgcgcaaggcgcacttgcggcggtgcattcggcccagcccgacgcggagcataatgcccgtgaatgggtgcgcatgctgtggaatacgccgatgcgaaccggcacgcgtcgttactatgacaacttcctctatgctttcgccatgctggcgttgagcggaaagtatcggtatgaatgatgattacctcaactaatcctatggtctacacggattttcctgatccagacatcatccgggtcggggacgtgtattacatggccactacgactatgcatttcacacccgggtgcgatattctgcgcagctatgacctagtgcattgggaattcattgcgcacgcattgaatatcgtggcggatacccctgaagaacgtttggaatgtgaaggtgccaacgcctacggtcgaggcatgtgggcgccgtcactgcgttaccatcggggcacctggtatgtgttgttcgccgccaacgatacgcataccagctatctgctgacggcggacgatccatgcggcccatggcgaaagcgtgagcttgacggcttctattacgacagcggactgttctttgacgacgatgatcgagcctatgtcgtacatgggcagtcgacattgcgcatcacggagttgaatcctgaattaagcgggccgatgccgggtgggctcgaccgggtcatcgtgcaggacgatccgcaggctgaccttggttatgagggcagtcacctgtacaagcatgatggacgctattacgtcttcacctgtcacttcccgcaaggcaagggcaaaacagaagcctgcttgatggccgaatccttggatggagctttcgaagtgcgtgaaattatcgaagacgacctgtccttccacggttacggagtcgcgcaaggcggtatggtggacactccggacggcgactggtatgcattcatgatgcaggaccgcggcggtgtgggacgcgtgccgatactgatgccgatgcggttcggcgaggacggattccccgtcgtcggcgagaacggcaaagtgccgcagtcggtcagcgtgccggctgcaagctgtgccgaacctgtcacgcccatcaacggcagcgaattcatagcccggtataacgccgaaggcggagtcgatgccaactgtctgcagccatactggcagttcaatcacatctcacataacgaatactggtcactgacggaacgtccgggagcattccgcctgcattccggacgcatcagctcgaatctcaatcatgcatggaacacgctgacgcagcgcacgatggggccggtgacggtggccgaagtcaccgtcgacgcgtcgacattgcatgatggcgacttcgccggattggcggcgttccaaggatgctattcctacatcgcgcttacgcgaaggaacggccgcacgatgctgaccgtccaatacaagccggcgaatgacgattccatcttctccgataatgattgggacagtccagccgtaacggatgcggaaatcatggcggatgcggattgcatgcgtctgcgcgcggtatatgatttcaccgattgcaaggatgaagtgacgttcttctaccgcgatgcggatacgccggaatccgaatggtgtccattggggacagcgcaccggatgatcttcaaaatggatcatttcacaggttgccgtatcggattgttcctgtattcgacaaaagagaccggtggaatcgccgatttttacgactttgcgtattcgacgccgaatacgaaggaaagagagcaatgaagcgacaggtcatagtggcgcaaggaactgtcgaaggcttggcggctgaggatcagggcatcaccgtgttccgaggagtcccgttcgcccagcctcccgtcggcggtctgcgctggcgtgcgccgcagccggccttgccatgggatggtgtgctgcaagccttcgatttcgggcctaccgcgatgcagccgacgccgggcgcctccgatgatttctatgatcgtgaatggggcaccgatccggccgtgccgatgagcgaggattgcctctacctgaatatttggactccggcattacgcggatatggcgcggatagcatggtaacttccgaaaagctgccggtcatggtctggatctacggcggagcctatcaatgtggcggcacatttgaaaaggaattcgacggcacgcatctcgccgcgaacggcgtcgttgtggtcagtgtggcctatcgcctgaatgcatttgggtttatgacgcaccctttgcttcatgaggaggccgtagaacgcggcgacggcgaaccatatgcgaatttcggattcctggatcagcgtgccggaatccaatgggtgaaggaaaacatcgcgaagttcggcggagatccggaaaacatcacggttttcggccaatcggccggtgccgccagcgtcttggcccagatctgctcgccgatgaatcatggcctgtttcagaaagccatcatgcaatccggcgcaggcttagggtatttcaatgcgcggcaggacacgctggagcatgcgcaggccaacggaatccgtctgttcgaagcattgggtgtctccacgctggagcaggcccgtgcaatcccggcccgaacggtattggaagccgccgagtccctgcctgttccaccggacagcggacgtgaagatgactggtcgatgatcgtcaattgggtgccatgcgtggacggcctgttccttcccgatcaggaggagcgtatcgtcgagggctgcaaggccaacaacgtcgacatgctggtcggcaacacgaccaatgagttcatcgcttcgactgaagatgggaagcctgtgcatgtcggccagctcggcaatctcacgctgattcgcaaatggaccgcaagcggtgggaccgcgccatactactatcatttcgatgtcgccatgctgggggatgatgccggagccttccactcgtccgatctgtggttctcctttggaagccttgcgaaatgctggcgtccgttcgttggatggcattacgatctggcaaggcgaatggggctgtactggaccaatttcgccgccaatggcgatcccaacggaacggaccgtgacggaacgccgcttcctgtatgggatccttgcatcggtgaggaatgccccgccatgcatttgtgccaagaaccgggcatgcggacggattggcttaccgaaacggatcgaaaagcattcggcctgtgacggcatgccgttgatgtataaatgctgatatgtaaacagggacggtctttgtggatcgtccctgtcgcataatggtttgccgttgcacgtgcaggaggatttcgagactgattatccgacttttcaccgtttccgtcgtctggttcgtcggtggcatctcgcggaggctcgggccattaaagaccctgttcggcgttgtgcaggctaggagctgtttgaagtgttctaggccggacgtttcgccgtataggggcgtgtctgcgtggattccgtcggatgtggcgtctcaattgttggacgttgcggtgagcgtgaacgggggtgattatgaggaagactgaacccccgctcatgaccattgccgacacgatggcctatttgcagtgcagtcgtcggctgtcttgttgggtacccaactcgggtaccttgctgggtaccggaaatgttggcattggcgtacatttccgtacattctctgtttgcgccgtatgtcttgaaatcgttggtattccgccgttttggcatgaaaaaaagggcttccggatttctccgaaaaccctcaaggcggagtcagagggattcgaaccctcgagccgctaaacacgactaacaccttagcagggtgcccctatcggccactcaggcatgactccactgttgcgttacgacgcaacagcatgtaactatagcatctatccgcgtgcgaaacaccatattgtgaaaaaatgagagaaaaacgtgtggtgatgtcagtgggactcgaactcgtgagccgtgtcgagcggtctcattgatatgcgacacgccggtatgcccgcaggtttcgccatattcgaacatttgttccaaaactgccgaatcgttgtctatcatggaatcatgagcacggcaccaagaatcgcagcggccaaacgtgactggggtcacgatgaggtcggatgcacggtgctgcatatcgacatggacgcttttttcgcatccctcgaagtggcgcggcatccggaatacgccgacaaaccggtaatcatcggcatcggcaaccgttccgtggtgtccgcggcgaactatgaggcacgcaaatacggcatcaattcggcgatggcaagctcccgggcaagaaaactatgcccgaacggcgtctttctgccggtggacatccactactaccgtgagatgtcccgacgtatcttcacagaggtgttctcccgcgtcaccgatcgcatcgaacaggtttccgtggatgaatgctatatggacgtctccggcgcgctgctgcggtggaaaagtccccgcgccatcggagcttggatacgcgatcaggtcgccagacggtaccacatcacctgttccgtcggcatcgcggcgaacaagcttgtcgccaaaatggcttcgaccaatgccaaaccggatggcatgctcatgatccccgtggccagacatgccgaattcgtgcagatgatgccgttgcgtggcatacctggcatcggtccgtccttggagaaacgactgaacgcatggggcgttgattccgtggctgacttggcgaagatgagcatggaatcgcttgagcaggcgacggggtcagccatcagcgcgcgcgggttgtacatggcggcacgcggattggatgaccgccctgtcgcaccgcgtgcgcaggggaaatccgtcggcgcggaacgcacgttcgacaaggacacccaagacatgcggcaggtgacatccatgctccgctggtgttgcgatgatgtggccggcacgctgcgcagacgagggttgatggcgcgtaaggtcatggtgaagctgcgattcccggatttgagctatgcgacgaaaggacatacgctggactgtccgacggatgcggcaagcatgctgtatccgcaatgtgtcgcattattgctggccatgatgggcatgccggaaagctctatcgacgccatttccttgaccagaccggtgcgacttgccggcatgagcgcgggcggtttggtcgaagcggcggatgcggcggttcagctttcgcttgatgacatgcttgaagagcagaacgaggcgcagcggggtcgtggaacggataccgaaccgtcgacccaatcggaacggctacgcggtgcggaagcggcattagacgcggtacggctcaaatacggtaaaggaagcgtgcgtcttggcatatggcgtacggggccatcaggtaatcttgaacattgagagtgatgtggagcatgagaagaaacagggggagtgccatgagatacagggacaaggcggtgcatgcccgcaacccggaagtgctggttgcagggcgtcgcaggctggccatcgtcgcagccgtcgtgcttgttgtattgctggcggtaggtgggtggttcctgacgcggtgcttgcattcatcacagtcccaagccgggcagggggccgcaacgcagatggacgtggccaagcagaaaaagcatgtggtgaaaaaggccgagccgaaggaacatcacggcaattcgccggactgtccggataccgattgcatcgccatgatggtcaatggcgatctgctgttccaccctggtctgtgggacaacttcgccggtcccaataccgcggcgacggacggtacggcctatgacttcaccagtctgttcgaaccgatgcgcaagtacatcgatgcctccgatatcgcggtgtgcgaattcgaaacgccgattgcgcctcgcggtggcccctacaccgggtatccggtgttcaacattccctcggaggtcgccgacgcggccgccaaggtggggtatcgcgcatgcacgcatgcgtcgaaccattcgtgggatcaaggcgcggatggcatcacacgcctgtgggataccctcgaccaggacggcatcgcacagacgggctcctacaagaccgaggaagactctaccaaaccgctggtcatcgattccccgaccggtggcggcaaactgggcctgatcgccggtaccgtgtccctgaacgcgcaaacccccgattatgattggcgcgtcgaccgtctgcgcgagagcggcgatccgaaccatcaggccgacatcgacaaagccgtggccaaagccaaagaggcccgtaaacaaggcgccgacgtggcggccatcgccatgcattccgtgcaggaatatcttgactacgccgactcgtggcagcagtccgaagcgcatgagctggccgacaccggtgcattcgacgtcatctacggtgccggatgccactgcgcgcagcccgttgagaactacaacggcacatggatcatctacggtctgggcaacgcggtgacggtcacgtcctacattccaggcaacgaggtcaacaaccaaggcgtgacggcccgcgtccaattcgccggcaagaaaggcgtggccggctcatggcgggtcaatcgcatcgattgggtgccgacggccaatgtgcgtcaaggccaataccagtggtgtccgatttcggacgaccatccggatggagcctgttggaacgaaacagaagatgccaatcagagacaacgtatctggaacgtgatctattccatgggcgcggaccagaacgtggttcgagagtggaacatcaccgcagaacaagctggttcatctggaaagtagtttcccgtggcagaatatgcctcgtattcgttaatcgacctgtatggagcgtttccgctcgtgatgtgaggtaaagatatggatggagttttcgagacccagccggaccgtgccgacttgccgctggtggtcatgccggtggtcatcgaatcgatgatcggaccgttcaaacagaacttcacgatgctcgaaaacgtggcccgcgtgcgcatgtacgaggatttcacactggacgaggacaccatcgtggaacgctgcaaggatgccgacgccgtcatggtcatcggattccactgcgccgatgccatcctcgacaggctcgacgccaagtgctatgcgttcggaggcaccggcgtcgccagctacatcaatcttgagaaaaccaaggaacgcggcatccgcgtctgcaacgtgctgcattacggcgatcacgccgtcgccgagcacgccatggcgttgctcatggaactgaccaggcacgccggagcgcttgatatgcaggtcaagcaaggcgattgggacggtgccgacggtttcgaactgttcggcaagaagctcggcatcatcggactcggcggcatcgggcagaccgtggccggcatcgccaacgctttcggcatgaaagtatccgcgtggaactcccacgtgccggcacaggtgttcgagaacctgaatgtcactccggtggaagacatgaacgagttgatctcgaattcagacgtggtcagcgtgcatatgccgttgcttgactccacccgtggcatcatcacggcgaagaacctcgacgcgttgcgtccgggaaccctgttcgtcaacaccgcccgcgccgaagtcatcgaacccggcgcactgctcgcaagacttcaacgcggagacattccggcggccttggacgtgttcgatcatgagccgcttgccgccgacgatcctttgtgcaagattcccggcatcgtgctcaccccgcacatcgcatggcgcaccgacggcgcgtatatcggcatgaccaagcaggtggtccaatccatcgccgccttcttcaaggggaggaattcaacgtcgtcgtctgaaaaaataaccgggaagcagcatatgcgcgcggtcggtgaggttaggtaggttgaacagcatgcagaccatactcgattccgccgatcggccggcgcacgacgccttcgtcgaaaagaaatcggaattcatcggagacgcctgtcatatcagctcgttggatgaggcgctcgctttcgttcagacgatccgtgaccagcatccgaaagcccggcatgtcgcctatgccgcggtgtgtggtggatccgatggacgtcttgcggaacgcatgagcgatgatggcgagccgtccggaaccgccggcaagcccattctcgacgtgctgcgggcaaacgaaatgactgattgcgtggtcgcggtcacacggtatttcggcggtatcctgcttggttccggcggcctgattcgtgcgtattccacaggtgcgtcaattgcggtcaaggctgcttccaaggcgaaaatcgtaccgtgcggcgaatatcaggtaactcttgattatccgcagttgggcagcttccagaatctgttgtcaacggtggaaggcgagcagaccgacgcgcagtacactgaccgcatcgccttgactgtggtggttccgcaggaacaggcgaatgtcttcgaatcccgagttgtggaaactttcaacgccacggtcgttccgcaactggtgggcacgtccaaccgtccggtcaaagtatgagttcacgttgtgagccgcatgcatatagtgtcgtaaggtgaaaatatgagtgatgagaacgagcagcatgagaatgattcgcaggccgacgcctcgaacgccgatgagaccgtggatttcgagccgttgaccgccacatacgagcggctccggcattccactgattccgccgcattaagcgagttcgccagacgtccgctgccggaccggagcgaccaggcggcgttctcccgtgccaccgcattgcttgaggctgtggccggcaacgcgcatacgccggtggaggaccgcgtcttccttgccgaaaccatgccgttcccgaacattctggtcaagctttccaccgacgagtctcctgaagtacgcaaagccgttgcgggaaacgccgatgacaagaactggctggtgggccgactgaccaaggatgagtcgcccgaagtgcgtgccaccgcgctgcgcaacaaacgtacgtcttggaaaatgcgtcttgaaggcgccgaagattccaccatggattccgacacgcttgatttcctgggctcgttgggaacgcaggtcgaaccggacgctccggtggtgcttgcgaccatggtgcgcagggccgtcgccttgaatccgaatgtttccgatcggatgctccagcagttggcgcaggacgcttcaagcgacgtgcagaaggccgctcaacggcagcttgcggaaaaataattgcatacgttgtcatttttatgagattcctgcgcgtggtgcgcatgttttggtcctagactgggaaccatgacagaacagaccgaaaacgcaacgcgtctcgcccgtccgctcattcgtctggcaaagctggtgggtgtcgccaccagctacgtcggtatgagccatgattaccacgaaatcgaagacgatgttctggtggcggtgctcaaggcgcttggtattgacgcttccaacgatgaggcgatcaaccagtccatcacatccatcaagtccgaacgcgaaacgcgcgtggtggctcccaccgtgctgcatatcgtgggcaaggaaagcaaggtggaggtgcacggcggcatgttcgatgtgccggaagcctccatcacgctggaaaacggcaagcaattcacgggcaaaatctcccatgagggcggtgagaaaatcgcccatgagattgatagcagcttcttcttcacgtcgtatctcgtcctgcccgccgatctgcccgaaggctatcacaccctcgaggtcactgtcggcaacgaggcggagactgcaaccgttatcagcgctcctgagaaaatcgaactgctcgatgatatgaagaacggctccctgtgggggtggatgagccagctgtactccatccgttccaagggatcctggggcgtgggagacttcgaagatctgaagaccatgctggtcgaggccaaaaagaagaccggctccgacttcatgcttatcaacccgatgcacgccgcggagccggtgcctccgctgacgccatcgccgtatctgccgatttcccgccgtttcatcaatttcagctacatccgtccggagtccatgccggaatatctcacgctgtcccacgaggacagggctgaagtcgatgcgctgcacgagcaggtcgaatcgctgaatgacgacgcgcggctgatcgatcgcgacgccatgtggcgcgtcaagaagcatgcgctgtgggtcatctacaaggccggccgaaccaaggctcgccaggccgaattcgaccgttacctcgccgaatgcggagacgagatcgaatcctacgccacctggtgcctgtgctacgacaagtggggagctccctccgacgacgccgataattgggtgcgcaaatacaaccgtgattccgaagaagtcgcgcagttgcgtgagaagttcccggacacccttgagttctaccgctggcttgagtgggtcgccaccgatcagttgcacgcggcgcagcaggccgcccgcaaggccggtatgaagatcggcatcgtcgcggatatggccgtcggcgtgcatccggcaggatccgatgtgtggtggaatccggaacgcttcgccaagggcgccacggtcggtgccccgccggacatgttcaaccagcagggccaggattggagccagccgccgcttaacccgatcgccctcgaacagaccggattcaaggtgtaccgggatatggtgcatgacatgttcgccaatgccggtgcggtgcgtatcgatcatatccttggtctgttccgcctatggtggattccggaaggcaagcccgccactgatggcacatatgtgcattacgattccgatgtcatgctcggcattctcgcgcttgaggcttcccgcgctggtggcgtggttgtcggcgaggatctgggtgtcgtgccggcctatgtgtccaagtcgctgtccgaacatggcattctcggttgtgccgtggaatggttcgaacagatggacggtgtgttccgcactccgaaggattggcgtccgtacgcactggcgtccgtcaatacgcatgacatgcctccggcggccggttacctcgaatatggccacgtcaagttgcgtgagcagctcggcctgctgtccggtccggtggaggaattccagaagtccgcaaccgccgagcacaatgccatgctgaacatgctggtcgaggagggctatctcgacaaggctgctctggatgacgaagccgccaacgaaaacgagattgtcgacgcgctgtaccgtggtctgaaaggttcgccctgcaagctcatggccgcctccatcgtcgacgcggtcggtgagaagcgcacgcagaaccagccgggcaccaataacgagtatccgaattggcgtattccgctggccgatggcgaaggcaacgtggtgccgctcgaaaagctcttcgacgaaccgcgtctgcaagagatcaccgccatcatgcgtggctgatcttctataggcgattccatggggtgtccacaggtccgacggtctgcggacacccttgtttttcgtgttgccgaatgtcaaggcaggcgatatactagtagactgttgtgtttccctacggggtccttcaaagcgcttttcccactcgccatcgaggactttcagggagcccacggataatgagacctgaaaaacggcattattccgcgcccaaccaacgcgtgtaatgctgatggatggtccggaacacaatatatagaaaaggtacatcgtgaaaactttcactccgaagccagctgatctgactcacgactggtacgtcatcgacgccaccgacgtggtgctcggtcgtctcgccactcaggcggcaaccctgctgcgtggcaagaacaagccgacctacgctccgcacgccgattccggcaaccacgtgatcatcctcaacgccgacaagatcgctctgaccggcaacaagttgggcaaggaactgtacatgcactccggtcgtccgggtggcctgcgtcgcgatagctacgcccagctgctcaagaccaaccccgagcgcatcatcaagtctgccatcaagggcatgctgccgaagaaccgtctggccaaggttcagctggatcgtctccacatcgttcgcggtgccgagcatccgtacgctggcatgaagccgcaggttttcgagatcgctcaggtctcgcagcaggctaagtgaaccgaagggagataagaaacatggctgaaaacaccaacgactccgcggttctcgagaccgaagaggagctcacctcgtacaccaccgagaccaacgctggcgctggcaccggtacttccaccatcgctccgggctacggcaccggtcgtcgtaaggaagccgtcgcccgtgttcgcctggttccgggcaccggcaagtggaccatcaatggtcgcaccctggaagagtacttcccggccaagctgctgcagcgtgaggtcaactccccgatcgttctgctcaagctcgaaggcaagttcgacgctatcgtcctcgttgacggtggcggcaccaccggccaggctggcgcaatccgcctgggcgttgcccgcgctctgaacgctatcgatcgtgatgcgaaccgcgccgccctgaagaaggctggcttcctgacccgcgacgcccgcgtcgtggaacgcaagaaggctggtctgcacaaggcacgtcgcgctccgcagttctcgaagcgctaaagcttacagcaagctttattcgaaacccctcggaaattcgttttccgaggggtttcttggtattcgaacgattcaggcagagcttgatggaatcaggcggtcggcatctgcctcatcgcactgatgctcaacgccgggagcgtccacaatgtcggatcgtcttccgacaatccatcgtcggcagattgcagatttgcttcattgtcttgcatctgccagtacatcatattgatgcggtgcagatgattgcgcagtctacctgccggcttgttttccgactctgcgtcgaattctgatacccgttcgatggacgttcccaaaccgggatattcgccgacgatctctgatgaagaccagaccatctcccattcaatgcctttcggaagatggaaacgtgtgacttcgtcggaaccgttgatcagaattagcaggctaggctcgtcgggggagagcagctgcatggcgaacgagcgtacggcaggattcgtccaatccgaatcgtccggcatctgcccgttcggaagataccaatgcacgcgatcggatttcttcagcaaaccgattttgctcaggcgcgtgaagaaatcctcatgactgtacaaatcgtgggatttccgcaacgtgattaaacgtgacgttagattgaattgcttcaattccggcgtttgctcggtgctgtatagccaatcccaatcaagccatgtaatgtcattgtcttgcgtgtaggcgttgttgttgccgttttgcgaattgccgaattcgtcgccggcgagcagcattggcgtacccaacgacagtaagagcgtgcccagcaggttcatggtggcacgctggcgctgctgcacgatgatttggtcgctgctggggccctcatgcccgaaattgatggaatggttgtcgtttgttccgtcgtggttgttttcgccgttagcttcgttgtgtttgctcttgtacatggtcaggtcggcggtggtgaagccgtcgtggcaggccacatagttcacggaggcggtcgaaccgcggccggggtcggtggcgaacaggtcggaagatccgcataggcgtgtggccatgtcttgcatggtcatttcgccgtattcgccgctgcgtgtgcgatccacgtcggtcagccagaatttgcgcgtgcaatcgcggaaacggtcgttccattccgcgaaaggaatgccgaattcgccggtgcgccagccgttcgggccgcaatcccatggttccatgatcattttgagattgccgagcagtatgtcggagcgcaaagcgtacaggaatggatggtagcgggtgaattcaccgtcgagacgtgccagcgtcgccgcaagatcgaatcggaatccgtcgataccaatgcgtttggcccaatagcgcaacgaatccacggcgaacgtggtgacgtgcgtgttggtgaaatcaagcgtgttgccgcaaccggtggtgtcgtacaggcggctgatcttgtctttggtgcgtcggtagtacgagagattgtcaaggcctcgccagcaaatggtcgggccttcgggacctgattcgcaggtgtggttgtaaaccacatccataatcacttcaaagccggcctcgtgcaatgcgcgcaccatgttgatgacttcttgccgtactgcggccgctcctgcctcttgcgagcgtttggtggcatatgaggattcgggggcgaaatatccgagcgtggagtatccccagtagttggtgcgtcctcgttcctgcaggaagagttccgattgtttggcttggatcggcagcagttcgatggaggtgacgcccagatcctgcaggtatgagagcgtggccgggtgtgcgaggcccgcgtaggtgccgcgaagttctttgggcagccatggcgcgttggcggtgaagcctttgacatgcagctcgtagataaccgttttgctccacggaacgtgtggatgcgagggttctcctgcgtgtttgtcgatggcgcggtcgtctatggctacggaaacgggcatgcgccctaccgagtcgatggtgctcatcggtccgaagggggagcccttgaccttgccgttgacgatttcgcattcgtaggcgaatgcgcctggatcgagtttcatcgatccttcgatgcctttggcgtatgggtcaagcagcagcttgtaggggttgaaactcacgccatgatcgggatcctatgggccgttgacgcggtatccgtattgcatgccgtcccatgcttgcggcacgtgcacgtaccacagtccgtagttgggaccgtccatgcggaacagtgtttcgcgaagattgagcgagggaatgcgtctggtgcagatgcgctgttttttggcctgatcgatgaacgtgagtccgggttcgttgaacagccgtgcggcgtcggcatagaaggcgctcggttggtcaagtggttcaagtacgcaaaaccacacttggtctgctgtttctgagcggacaacggcgtccgcgccaccatcgtcggtgaaatagagacctgggcgggttgcgtagcggtgcaaaggtgggttcttcataacctcattctaaacactttgaaattatctgttgacttgctatgtcgggaccatctctgccaatgtcagatcgatggttgctgcgctgccggtgagatgccgttctggctgttttcgatgatgatgtgcatgttgtgatgatgattttttaaaaaacaaaacgttgattttctgcggcacacgctttgcaaacaactttatgaaaagagatttgcaaaagaatttaagaaagtgtatagttttcaatcatcaggcagaacgatctgccggaacttcttttatagtggaaaggacatatcatgaaagctcttgtactgaccggtgtcaaggaatttgaaatccagaacatgccaacaccgcagatcgaacccaatgaagtgctgatcaacaccgcatatgcaggcgtgtgcggcacggatcatgacctgtatgacggtcgccccggatcggccgctgcggtgccgccgatcgtgcttggccacgagaattctggcatcgttgctgcagtcggcgctgacgtcaccaatgtcaatccgggagaccgtgtcgccgtcgacccgaacatctactgcggccagtgcgaattctgcctgacgcaacgtcctgaactctgcgaccatcttagtgcggtcggagtgacccgcaacggcggtctggcggaacaattcaccgcccccgcaagtgtggtctataagctaccagataacgtttccctgcgtgacgccgctgccgtcgagccggtctcatgcgcggtgcatggtctcgatctgctggaacttcgcccgtatcagaaggcgttggttatcggcgacggtttcatggggcaggtcttcgcccagcttctgcaggcgtatggcgtgcatcaggtggatcttgccggcattttcgatgaaaagttgcagcgcaacaaggagcagttcggcgtcaccgaaacgtacaacaccacccgcgaacagattccggaagattcctacgatgtaatcatcgaagccgtcggtcttcctgcgacccaagctcaggccgtagccgccgccaagaagggcgcgcaggtgctgatgttcggcgtcggcccgcaggaggcgcatttcgaaatgaatacgtacgacatttacaagaagcagctgaccatccaaggctccttcatcaacccgctcaccttccgcgatgccatctcgctggtctcctccggcaaaatgaacatcggaggcctgatcagccacgagcttgaactcgagcaggtgcaagacttcctcgacggcaagatcactggcgtttccaaggctgtcgtcaagattggtgcctgacatgatccgcgtgcttgagcgtttgggtgttccgcgaacgctgatgctggggttccttgccgtcgtcattttcatgaccggcgatggcttcgagcttaccttcctctccaaattcatggtggattaaggattcagctcctcccaagcgtcgctgctaatcacggtgtatggcttgttcgcggcgtttggcggctggtccgcaggcgtgcttgcttttgtgctgacgttgtttattcgtcccgaacagcttggaattagcgaaaaagtatcacgacatgacggcaaatgcacagccgacatcgccgcatagcgcatatcctaatcacaaaaggggaaaatcaatcgtattcatcgttatcaggaggtaattttatggcgaaagcaatgtctgaattcactaccgatctgcagcattccggcatgccggcgaaggatctcgacgaaaccatcgaattctatacgaagaagcttggtttcgaactggccggactgtttcataacggcgaaaatcgttgtgcattcctgcgttacggccatctgaccatcgaaacgtgggagggcgatccggctccgctgaccactggtgccatcaaccattgggcattcgacactcccgacatcgaagctgcattcgaaaacgcgaaggaactcgggctgaatttcaaagataacgaaatccagcatatcgacagcttctgggagcatggcatccgctacttcaacgtatacggaccgaacggcgaaaccattgaattctgtcagattgtcaaataactatcgttagatgattgccgtcaaataatcgttgaaaacaaatacaacaggcgaaacagacggaagcaaacaaagaagcgtgcgctgaaccttatatacgggttcggaacacgcttctttttgttatgcaatcgatgcgattaatatgtgcgcaaaagcggtcacatatcgcatagttcgcgtacgtacggctccacaaaacgcagggccgcgccgataatgtcttgatggtcgagcgccattcccttgcgcagggtgaaatccgtggtgccgaatggcgtatgttccaccacgcgttcgcgtagtccggccatatcgtcatcatcgagatattgtgctgcctcaccgctgatgatcacgtcaccggccagtaccgagcgaatattcgttaccgccagcgccacataatccagccattgcgagaatcgtttgcgatgctcctgctcgccttgttccaacaccgagaagaagccgggcaggctttcgccgtcttccatcagcgtttccggcgagcaatacgtatccatgcagccctgttgtccgcagtagcaggtgttgcctcctggaatcagcgtcatatgttcgattgagccattgcattggtttggcccttggtaaagcgatccgtctacgatgaccgcgcctccggggcgtcgctcgaggtagatgcagacggcatccttcagattgtggtcgaaccagagttccgccatggcagaagcgtcggaatcgtgaatcatcagcgacggatagttgaggccgtggctgagttcgctgagtttcaggccggtgttgttcatgattttgccgaaggtgatcgactgcccgtctgccgatacgatgccttgcatgcagaaggccacgcctagcaccgtgctgccttgtttcgccagttcctgcgcgaaaccgttgatgatgtcgttcatgcgctggtagtaggcgtcgttgttgcgataggggagtgtgcgctgtctggtggccacggatttgccgttcagatcaatggcgatggccgtgattcgtgtggtttggattcgcacgccgatagccacgctggagtgtgccgcgaattcgtagatttgcgctttgcgtccaccggtggatttctgcatctcgcctttgacgatgagcccgtcggcctccatggcgcgcagattctgcgtgatggttggcaggctgagccctaattcgtgttcgaacatctgcttggtggctgaaccttgggtgtagatgaacgtggtcatggccttgaaattggcttctttgactgatagggcggattgggctttcactggttgatccttcctgcgcaacttcttttccaagactacttcataaaagtcctttccttatgtctcgtgttggtctgagatatcaggtattgcaaaaaagtatcaaaaacagctgtgcataaaggattttctgccacttttctgcgtcgaaaatatatttatcaacaaaaaaagttgagacggtgacaacgacgttctaccaagaaaagagacatgttatgaagataggtctgccgcgcacgctattggccggcttggtcgccatagcggtgttcatgaccggcgatggctttgaattgacttttttgtccaaatacatcgtggaccagggattcagctcttcgcaatcgtcgctgatgttcaccatgtacgggctggtggctgcgcttgccggctgggcgtccggtgtgctagctgaaatgttcggtgccaaacgcatcatgcttatcggcgcgagcgcctgggtcgttttgcacctgctgttcgttggtgtggcgttgccgagcggcgtctatccgctgatgttaggcgtgtatgcgttgcggggtgttggctacccgctgttcatctactcgttcgtggtgttgatggcgcaaaccatcgatcctgccaagctcgcgtcggccatggggtggttttgggccgcctactcgttcggcatcggcgtgtttggcgcatatttgccgagtttcaccattccgatggtgggcgagtactattcgctgtggctttcgttgccgttttctatagctggactgctgatttgcctgctgatggtgccgaaaagcaagggttctggcaactcttccatgagcaatgcagacaagctgcgcgagcttagtcgaggagtcaccattctggtgcataatcgccaaatcgctttggctgcggtggtgcgtgtgatctgcaatctgacgttgtatggctttcccgtcatcatgccactctacttggccactaccaacaatggcggcggtgcttggtttaaggtttcgcaatggagccagatttggggattccagtttgtggtcaccattttcggcaatgtgttctggggtcgtatgggcgattcgcatggttggatgcggcaaatgcgctggtttggctgctggttctgtgtgatcggcacgctgggcatgtattacattccgcagtttttcggggcgaatatggtgcttatgtgtgctgatgcggttgttcttggattgggaatttccgctttcgttcctatgggagccgtgtttcccgcgttggcgttggaacataagggtgctgcgatttccgcgcataatttcgcttccggcctggctacgtttttcggtccgctgattgcgacggtgctggtttccactatcggattcggcggcgtgtgctggacgtatgcgatctgctatgcgatcggatcgttggtcacgttcggcattcatcctcatcaacccggatttgacgatcgcggccatcgcattgccgcgatcgagcgtaactaatcgcaattgaatatcaattgctcgatcatcatttttctcaaaaaacatcattatccacaaaggagaataatcatgaaggcagtcgttctcgaagagcagggcgtcatcaatgtgcgtgaggtgcctgacgtccccgcacctggtctaggcgagctgaagatcgcgccgcataccgttggtgtgtgcggttccgacctgcactattacactcatggtcgcgtgggcaaatatgtggtggagcagccgatgattctcggtcatgaggcttccggcacggtggttgaggtcggtcctggcgtcgaaggcttcaaagtgggcgatcgtgtggccatggagcccggcattccggatatgagttcgcgtgccagcaaactgggcatgtataacgtcgatcctgcggtgcgtttctttgccactccgccgattgatggctgcctgtgcgaaacggtgaaccatcctgcggcgttcacctacaagctgcccgacaatgtgagcttcggtgagggtgcgctgcttgaaccgttggctgtgggcatgtggtccgccaccaaggctcgtatcaagccgggcgatgtctgcgtggtcaccggatcgggtacggtcggcatgctgaccgcgtcgtgcgcgttggcaggtggcgcttccaaggtgctgatttctgatgtgtcggcaatcaaattggcgattgcggctcagattccaggtattattccggtggatctcaccaaagaggatctggtggagcgcgtccgtgaggaaacggggggttggggtgctgatgtggctttcgagtgctcgggctcgccgaagtcatacgagacattctggaagctgattgctcccggtggcgctgccgttatcgttggcattccggtcagtccggtggctatcgacattacggaactgcaggctaccgaggtgcgcatcgaaaatatcttccgttatgccaatgtgtatcagaaggccatcgacctcgtggctaacggtaaactgaatctgaagccattcatcaccgacacctatgcgatggaggatgccaaggcggcgtttgatcgcatggccgaggggcgtcctggagatattaagctgcagattaccgtgaataacgactgacgttacgcacgttacggaacgacgaaaggggtctaggccatgggtgctgttgtacaagtcaacgataatcggcatgggaagacggctttggctcagacctcttttggtggattcgtgccgaaaggtggaagttcgaacgattccggcgtattggagatcattgtgccggacgcgcaggcttcggtgcgttgggtgaagcatggctacccaagctcgttggcgaaatggcatcatcatcctcatattgaaattcatctgattcgggaaggtaccggattgatgatggcgggcaatgccgttgttccgtatgaggccgggcaggttgcgctgattggttcgaatcttccgcataattgggtgtccgacatcgctccgggggagcggcttcgtcagcgtgatgtggtgtgccatgtgcgtccggaaaccatacgtctgctgatgtctggatttccggaaacgtctggttttgcaatggtgttgaggcgtgcggggcaggcgttggtgctgagcggtgaatccgctcgtcaggccggttcgattctggaaagcatggaggaacatagtcttgcttgccgtgttagtgatctgattcgtgtgttggatgtgttcgcgcatgcctcagcagatgaatcctatacagtggttgcgtccggatacgatccggctgtatgcagtggtgcggaaagtgtggtcaacgatgccattgagtacatttcctcgcatctgagcggtgaaattagcctggatttggccgctcgtcaggctggaatgagtgtgtcggctttctctcgtctgttcaaaagggccgcaggaataaggttttcggattttgttcgacgattgcgtatcgggcatgcgtgcagattgctgacgaccacgaatcaaagcgtcgcgtcgattcgtcgtgcttgcggatatggaaacgcttcgaatttcaatcgtcgtttctttgaagaaacaggcgaaactcctactggctggcggaaaaaatacattggacggacaagataagtaaataaactttgtaaaagtttgatatgattgatatcatatagaaaatacttttataaaagatgaggaggtgagacttgagaaagtgtgtgtgatttatgataaaaagcaacaaaaacgctcaaaatgatgtttttaaagctttttctcttcacaaaagaacgcaatctaaacattaaatgaacagaatataatatttctcttgcgacacgacgcagtggaaaatcatattgcatactcactaaagtgtgtcctaggtcacaaaagaccagcaacgcgtccatccgcttcgaggcgggtggaataacgggaaactactttgcaaacccccaaagaatcgaggaggacttcaagtggcagacgcaaagaagaaggaagagccgaccaagccgactccggaagagaagctcgccgcagccgaggctgaggtcgacgctctggtcaagaagggcctgaaggctcttgatgaattcgagaagctcgatcagaagcaggttgaccacatcgtggccaaggcttccgtcgcagccctgaacaagcacttggtgctcgccaagatggccgtcgaggagacccaccgtggtctggtcgaagacaaggccaccaagaacatcttcgcctgcgagcatgtcaccaactacctggctggtcagaagaccgtcggcatcatccgcgaggacgacgtgctgggcatcgacgaaatcgccgagccggttggcgtcgtcgctggcgtgaccccggtcaccaacccgacctccaccgccatcttcaagtcgctgatcgcactgaagacccgctgcccgatcatcttcggcttccacccgggcgcacagaactgctccgtcgcggccgccaagatcgttcgcgatgccgctatcgcagcaggcgctcctgagaactgtattcagtggatcgagcatccgtccatcgaggccactggcgccctgatgaagcatgatggtgtcgccaccatcctcgccaccggtggtccgggcatggtcaaggccgcatactcctccggcaagccggccctgggcgtcggcgcgggcaatgctccggcatacgttgacaagaacgtcgacgtcgtgcgtgcagccaacgatctgattctttccaagcacttcgattacggcatgatctgcgctaccgagcaggccatcatcgccgacaaggacatctacgctccgctcgttaaggaactcaagcgtcgcaaggcctatttcgtgaacgctgacgagaaggccaagctcgagcagtacatgttcggctgcaccgcttactccggacagaccccgaagctcaactccgtggtgccgggcaagtccccgcagtacatcgccaaggccgccggcttcgagattccggaagacgccaccatccttgccgctgagtgcaaggaagtcggcgagaacgagccgctgaccatggagaagcttgctccggtccaggccgtgctgaagtccgacaacaaggaacaggccttcgagatgtgcgaagccatgctgaagcatggcgccggccacaccgccgccatccacaccaacgaccgtgacctggtccgcgagtacggccagcgcatgcacgcctgccgtatcatctggaactccccgagctccctcggcggcgtgggcgacatctacaacgccatcgctccgtccctgaccctgggctgcggctcctacggcggcaactccgtgtccggcaacgtccaggcagtcaacctcatcaacatcaagcgcatcgctcggaggaacaacaacatgcagtggttcaagattccggccaagacctacttcgagccgaacgccatcaagtacctgcgcgacatgtacggcatcgaaaaggccgtcatcgtgtgcgataaggtcatggagcagctcggcatcgttgacaagatcatcgatcagctgcgtgcacgttccaaccgcgtgaccttccgtatcatcgattatgtcgagccggagccgagcgtggagaccgtcgaacgtggcgccgccatgatgcgcgaggagttcgagccggataccatcatcgccgtcggcggtggttccccgatggatgcgtccaagattatgtggctgctgtacgagcacccggaaatctccttctccgatgtgcgtgagaagttcttcgatatccgtaagcgcgcgttcaagattccgccgctgggcaagaaggccaagctggtctgcattccgacttcttccggcaccggttccgaagtcacgccgttcgctgtgattaccgaccacaagaccggctataagtacccgatcaccgattacgcgctgaccccgtccgtcgctatcgtcgatccggtgctggcacgtactcagccgcgcaagctggcttccgatgctggtttcgatgctctgacccacgcttttgaggcttatgtgtccgtgtatgccaacgacttcaccgatggtatggcattgcacgctgccaagctggtttgggacaacctcgctgagtccgtcaatggcgagccgggtgaggagaagacccgtgcccaggagaagatgcataatgccgccaccatggccggcatggctttcggctccgccttcctcggcatgtgccacggcatggcccacaccattggtgcactgtgccacgttgcccacggtcgtaccaactccatcctcctgccgtacgtgatccgttacaacggttccgtcccggaggagccgaccagctggccgaagtacaacaagtacatcgctccggaacgctaccaggagatcgccaagaaccttggcgtgaacccgggcaagactccggaagagggcgtcgagaacctggccaaggctgttgaggattaccgtgacaacaagctcggtatgaacaagagcttccaggagtgcggtgtggatgaggactactattggtccatcatcgaccagatcggcatgcgcgcctacgaagaccagtgcgcaccggcgaacccgcgtatcccgcagatcgaggatatgaaggatatcgccattgccgcctactacggcgtcagccaggcggaaggccacaagctgcgcgtccagcgtcagggcgaagccgctacggaggaagcttccgagcgcgcctgatcgcaatatcgcaacgtaactccttatataaaagatgtgaagtgaagcgtatataagaagtcgtgcaaaaggagcctgatgggaaaccatcaggctccttttttatagtgagggggaagtggaccgtcgccgttaccttccgcgttcttcatcgaaagaagacgcgtgattgtgttggcgcgacaccgcgaaaaacgttggaaaaaccgcgacacgcgcgaattccatatgttcacccctgatgcttagataaagaagttgcctgattttagggctcgcaaattgtaattcaaaaagcgagcgtggcacagcggctcactccggtgagaagctgcatggctgcgcactgatgtggtatggccacggaacttccacggttccgggggtcttctgcgccggtgcccttggaagcaggctggtaaacagtaaataacgaatcgctagaaagggcggaaggcaatggcgggacagaaaatccgcatcaggcttaagtcctatgaccatgaggtcatcgaccaatcggcgaagaagatcgtcgaaacggtgacgaacgcgggcgcaactgtggttggcccggttccgctcccgaccgagaagaacgtgttcgtcgttatccgttctcctcacaagtacaaggattctcgcgagcatttcgagatgcgcactcataagcgtctcatcgacattgtggacccgaccccgaaggccgtggactccctcatgcatattgatctgcccgcagacgtgaacatcgagatcaagctgtaagggaggagggaaccattatgtctaatcgcactgcactgctgggcaagaagctcggtatgtctcaggtctgggacgagaacggtttcttcgttcctgtgaccctcgttgacgtgtccaccaacgtggtgaccgctgtcaagtccgaagagtccgacggctacaaggctgttcagcttggctacggccaggttgacccgaccaaggtgaccaagccgctcgccggccacttcgccaaggctggcgtcaccccgcgtcgtcacctcgctgaggtccgcaccgataacgccgaagagttcgagccgggtcaggagctgaccgctgagctgttcccggaaggcaccctggtcgacgtgaccggtaccaccaagggcaagggcttcgcaggcaccatcaagcgttggggcttcaagtcctatcgtcgtacccacggctctcacaagaacgagcgtcgtcctggctctgttggcgcatgcgccaccccgagccgcatcctcaagggcaagcgcatggctggccgcatgggtcatgtgaccaacaccgcgctgaacctcaccatcgtttcgtcggatgttgagaacggcgtgctggctatcaagggcgccattccgggcccgaagggcagcatcgttctcgtccgttcggcagtgaagggagcctgataaatcatggcaaacgttactctgaacgtcaccgataaccagggcaaggccaccggcaccgtcgatgccccggctgagatcttcggcttctccgctgaagaagttcagtcccgcatcccgctgatccaccaggtcgtcatcgcccagctcgccgctgctcgccagggcacccacgccaccaagactcgtggcatggtttccggcggtggccgcaagccgtggaagcagaagggcaccggtcgtgctcgtcagggctccatccgtgcaccgcagtggtaccacggcggcaccgtgttcggtccgcagccgcgtgactactcccagcgcaccccgaagaagatgaaggccgctgctctgaagtacgtgctttccgatcgtgccaatgccggtcatgtggccgttgtcgacttcggtgtttccgaagccccgtccaccaaggccgccgttgccgctcttaccccggtgaccgagaacaagttcaccaccgtggtgctctctcgcgagaatgtgaacgaatggctttccgttcgtaacatcccgaccgttcacccgatcttcgccgatcagctcaacacgtacgatgtggtcaccgctcagtacgtggtcttctccaaggaaggctttgatgctttcctcgctgcgaaggctgagccggctgcaaaggaggcctgattttcatggtcgctattcacaagcccgcacacgacatcatcctcaagcctgtcgtttctgagaagagctacgctctgtccgatcgcggtcagtacaccttcgtggtggccccgaacgcgaacaaggttcagatcaagcaggcaatcgaagagatcttcaatgtcaaggtgacgaacgtcaacaccctcaaccgcgccggcaagcgccagcgcacccgcaacggtttcggccagcgcgtcaatcagaagcgcgccatcgtgaccgtcgccgagggccagacgatcgacatcttcggtaactgaaggctagccgagaaaagttaaaggaagaactagattatggctatccgcgtttataagccgacgactgcaggccgccgtaacgcgtccgtctcggacttctccgagcttacgcgctccacgcctgagaagtcgctggttcgcaagctcagcaagactggcggtcgtaactcctacggccgtatgacctcccgtcatcgcggcggcggtcacaagcgccagtaccgtctcatcgacttcaagcgttgggacaaggacggcgtgccggccaaggtcgctcacatcgagtacgacccgaaccgttccgcccgcatcgcactgctgcactacgcagacggtgagaagcgttacatcatcgctccggaaggcatcaagcagggcgacgtcatcgagaccggcgctcaggctgatatcaagccgggcaacaacctgccgctgcgcaacatcccgaccggtaccgtggtgcacgcgattgagctccgcccgctgggtggcgccaagatcgcccgctccgccggtgctgccgtgcagctcgtcgccaaggatggcgcctacgctcagctgcgtatgccgtccggcgaaatccgcaacgtggacgctcgctgccgcgcgaccgttggtgaggtcggtaattccgatcacgccaacatccagcttggcaaggcaggccgcgctcgttggatgggcaagcgcccgatcacccgtggtgagtccatgaaccctgtcgatcacccgcacggcggtcgtacccgcggtggcaagccgccggtttctccgtggggcaagggcgaggttcgtacccgccgtccgaagaaggcttcgaacaagatgattgttcgtcgtcgcccgaatggtaagaaccgtaagtaagggagtgtcgagtagatgactcgtagcatcaagaagggccccttcgtcgacgcccacctgcagaagaaagtcgacgagcagaacgagaagggtacgcacaacgtcatcaagacgtggtcccgtcgttcgatgattacccctgatttcatcggacacaccttcgccgttcatgatggccgcaagcatgttccggtgttcgtcaccgaatccatggttggccacaagctcggtgagttcgccccgaccaagaccttcaagggtcatgtgaaggacgacaagaaggcacgccgctaaaggagagtaaggacacatggaagctaaagcaatcgctcgtcacgtccgcgtgacgccgcgcaaggctcgccgtatggtcgacctcatccgaggcaagaaggcgaccgaagccatcaccattctgaagttcgctccgcaggacgcatccctcccggtgcgtaaggtcctggagagcgccatcgcgaacgctcgtgtgaaggccgacaaggccggcgagccgttccgcgagaacgacctggtcgtgaaggagacctatgtggacgaaggcgtgacgctcaagcgtttccgcgcccgtgcacagggccgtgccgctcgtatcaacaagcgcaccagccacatcacggtcgtcgtcgctaacaaggaaggaaaccgctaaagatgggtcagaagatcaatccgtttggctaccgcctgggaatcactgagaaccatcgttccaagtggttctccgattccaacaaggttggcgaacgctaccgcgacttcgttctcgaagatgacgccatccgcaaggccatgagcaaggacctcgagcgtgcgggcgtgtcccgtatcgtcatcgagcgtacccgcgaccgcgtgcgtgtggacatccacaccgctcgtccgggtatcgtcatcggccgtcgtggcgctgaggctgagcgcgttcgcgccaagctcgagaagctcaccggcaagcaggtccagctcaacatcttcgaagtgaagaacgccgcactggacgcccagctcgtcgcacagggcatcgctgagcagctcaccaaccgcgtgaccttccgtcgcgcgatgcgtaaggcccagcaggatgccatgcgtgcaggcgccaagggtatccgtatcaagctctccggccgccttggtggcgccgaaatgagccgttccgagttctatcgcgagggtcgcgttccgctgcagaccctgcgtgccctcattgattacggcttcttcgaggccaagaccacttacggccgtatcggcgtgaaggtctggatctacaagggtgatatgaccgagcgtgagttcgaagagcagcaggcacagcagagcaacaaccgccagggtcgtcgcggcgatcgtcgtccgcgtcgcggccagcgcaacgctgctccgcagcagaacgcagcagcagaggctccggccgctgctgaggcacctgccgcaacggaaacgaaggagtgagctgagaatgcttatcccaaagagaaccaagtatcgtaagcagcaccgtccggtccgccgtggcatgtccaagggcggcaacgagatcgctttcggcgatttcggtatccaggctctggctccggcttatgtgaccaaccgccagatcgaggccgctcgtatcgccatgacccgctacatcaagcgtggtggccgcgtgtggatcacgatcttcccggatcgtccgctgaccaagaagccgctcggcacccgaatgggttccggtaagggtactccggaattctggatcgccaacgtccacccgggtcgcgttatgttcgagatcggtggcgtgtccgaggatgtcgctcgtgaggctctgcgccgcgcaatcgacaaactccccatgaagtgccgtgttattgctcgtgaaggcggtgacatctgatggcagtcggaactgcagactacaccatgaagaatctcaacgagaagaccaacgaggagatcgagggcttcctcaagaagtccaaggaagagctgttcaacctgcgcttccagtccgcgaccggtcagctcgaaaacaccgcccgcctcaaggcggtcaagcacgacatcgccaggatgtacaccatcctgcgcgagcgtgagctcggcatcagccaggcccccgaggcgaccgaaacgaaagctgaggagaagtaatggctgaagagcgtaacttccgcaaggttcgtcgcggttacgtcgtgtccgataagatggacaagacgatttccgtcgagctcgagcagcgttcgacccacccgctttacggcaaggttgtgcgctccactcgtacggtcaaggtccatgatgaacacaacgaggctcacattggcgacctcgtgagtattatggagactcggcccctgagcaagaccaagcgttggcgtctcgatagcattatcgagcgcgctaagtaaataagttcggcaaggctccgtgagtcaccccgcctgcttctagcaggcaggcggggtgcttggggagaaccagctcggctaaggagaatcaatgattcagcaggaaacgcggcttcatgtcgccgacaacacgggtgcgaaggaactcctcgccatccgagtgctcggcggatcgaagcgacgctatgccggcatcggtgacgtgatcgtcgcctccgtcaaggacgccatccctggcgggtcggtcaagaagggcgacgtcgtcaaggctgtcgtcgtccgcactgtcaaggaacaccgtcgtgtcgacggctcctacatcaagttcgacgagaacgccgccgtcattctcggctctggccgtgaaccgaagggcactcgtatcttcggaccggtcggtcgtgaactgcgcgacaagcgcttcatgaagatcgtgtccctcgccccggaggtgatctgacatggcagccaagattaagagcggcgacctggtcaaggtcatccgcggcaaggatcgcggcaaggaaggcaccgtcaagcaggtgctcaaggacgatcgtctgatcgtcgagggcgtgcagatcgtcaagaagcacgtccgcgccacgcagcagggccagcaggctggcatcgtggctgtcgaggctccgattcatcgctccaacgtgatggtcatcgatccggagaccaagcagcccacccgcgtgcgcatcgtcgaaaaggaagaggctcgtgacggcaaggtgaagaccgtgcgcgtacgtgtcgccaagaagtccggaaaggagctggcatgaccgataccactgtcgaagcgccggcaactccgcgcttgaagcagaagtacaacgagcagatcgtgccggagctggagaaggaattccactactccaacccgatgcaggtcgctcgcgtccagaaggtcgtcgtctccatgggcgttggtgccgcggctcgcgactccaagctcatcgaaggcgctgtcaaggacctcactctgatcaccggccagaagccgaagatcaccaaggctaagaagtctgtcgcgcagttccacctgcgtgagggccaggccatcggcgcctacgtcaccctgcgtggcgagcgcatgtgggagttcctggatcgccttctgaccatggctctgccgcgtatccgcgatttccgcggcatcaacggcgaccagttcgatggtcagggcaactacaactttggcctcaccgagcagtccatgttccacgagatcgatccggattcgatcgatcaccagcgtggtatggacatcaccgtggtgaccagcaccaaggacgacaaggaagctcgcgtgctcctgaagcacctcggcttccccttcaaggagaactgatatggcaaaaaccgctcttaagaacaaggcggccgctaagccgaagttcaaggtgcgcgcctatacgcgttgccaggtctgcggtcgtcctcactccgtctaccgcaagttcggcctctgccgcatctgccttcgtgagaaggcccaccgcggcgagctgcccggcgttacgaagtccagttggtaaatatcgacgctgaaggtccgcggcccgatcgcctctaaggcgtgagggcggcggaaaccatggcgagaaagggcgttagcccaaatgacaatgacagatccgatcgcagacatgcttacgcgtctgcgtaatgcgagcgcggcaaagcacgagaccgtggatatgccgtactccaagttcaaggcgaacatcgctgagattctgaagcgtgaaggctacatcaaggacttcaccgccaaggaagccaaggttggccagactcttgaggtcaccctcaagtacggtccgaacggcgagcgttccatccagggcatcaagcgcatctccaagccgggcctgcgtcgttacgcaaagtccgatgctctgccgatgccgctcggtggccttggcatcgcaatcatctcgactagctcgggactgctgacccagaaggaatgcctcgaccgaggcatcggcggcgagatcgtcgctttcgtttggtgagaaaggagagctgaaacatggcatcgcatattggtaagctccccgtcaccattccggctggcgtggaagtcaagatcgacggtcagtcctttaccgccaagggcgctaagggcactgactcctacgagattcctgaaggcatcaccgcagtggtcgaaggcaacgaagttgtcctcaccccggctgatgacctgcgtccgacccgtgcaaagcacggcctggctcgctccatcgtggcgggcatggtcaagggcgtgcacgagggttatgccaagactctggagatcgtcggtaccggttaccgcgcccagatgaagggtaagggcattgagttctccctcggctattcccacaccatcaccgtcgagccgccggcaggtatcgaattcgaactgccgaacccgaaccaggtgatcgtcaagggcatcgacaagcaggctgttggccagtgcgccgctaacattcgtaagcttcgtgctccggaaccctacaagggcaagggcatcaagtacgcggatgagcacattctgcgcaaggctggaaaggctggtaagtaatgagcgtccagattctcggtaagggcaagaaggtcgcgcttaagcgccgtcacgctcgtctgcgcaagcacatcagcggtaccccggagcttccgcgtctggtggttacccgttccaaccgtcacatggttgcccagatcatcgatgacaccaagggtgtcaccctggtgagcgaatccactctgaccagcgatttcgccggtttcgagggcaccaagaccgaagccgccaagaaggtcggcgaactgatcgccaagaaggctcaggacgctggcattaccgcggtcgtgttcgatcgtggcggcaacaagtatcatggccgcgtcgcagctgtcgctgaaggcgcccgcgagggaggtctggcactgtgagcgacaacgaaaaggaaacccaagtggctgaagaaactcagaacactcaggctgccgctgagtccaacaacgaggaccgcaagtcccgtcgtggccagcgcggtgagggtcgtcgtggcgagcgtcgcaaccgtcgtgaggaatctcacgagaacgagatgctcgatcgcgtggtgaccatcaaccgtgtgtccaagacccacaagggtggtcgtacgttcagcttcgccgccctcgtggtggttggcgacggcaagggcaccgttggtgttggctacggcaagtcccgtgaggtcccggctgcaatcgccaagggccagctggatgccaagaagcacatgttcaccgtgccgcgcatcaagggcaccgtcacccacccggtgatcggccacgatgccgctggcaccgtgctgctgcgcccggctgctccgggtaccggcgttatcgccggcggtgcagtccgcgccgtcatggaatgcgctggcatcaccgacgtcctgaccaagtcgatgggctccgccaccgccgtcaacgtggtgcgcgcaaccgtcgacgccctcaagaagctcgaagagccggaagagattgccgcacgtcgtggcatgtctctcgaagaggtggctccggacgcgctgctgcgtgctcgcgccgaaggcatcgccgaggcccgcaaggctcgtgaagaggctcaggccaaggctgctcagaaggacggtgagtgatgactaacctgaacatcaagctgcaccacggtctggtgaactccactccgaagcagcgtgctgcggctcagactctgggcctgaacaagatcggcaagaccgtgactcgtgaggatactccggcccttcgtggccagctgcaggtcctccgtcacctgatcaccgtcgaggaggctgactgattatggcagacattctgcagatgcatgacctgaagccggctccgggtgccaacaaggatcgtatccgcgttggccgtggtgaaggctccaagggtaagacctcgggccgtggcgacaagggcaccaagaagcgctatcaggttcgtccgggcttcgaaggtggccagctgccgctgtacatgcgccttccgaagctgcgtggcttcaagaacccgttcaagaaggaataccaggtcgtcaacgtggctgttcttgcggaactgttcccgcagggcggcgagatcaccgtggctgatttggttgccaagggtgccgtccgcaacggcttcccggtcaaggtcctgggcgacggcgaggtttcggctgcctacactctcaagggtgtcaaggcttccgcttccgccaagtccaagatcgaggctgctggcggctccatttccgaggattgattccaacggaatgtagctgactgaagctcagacatgaggcttcccccgctttagagcgggggaagcctcattcgtttgcagtcaaaatgcaatcatgcatggaaaaacaaaaaacagacgaataatgacgaaaacgccatatcggtagacgccgtacgctagactcgagcgttagagtctgtttttgcacgtgtgcgcaggtgcgcacgacgatggaaggaaccccaggtgaggacgttaatccaggccttgaagaccaaggaattgaggaataaaatcctcttcacccttggtatcatcatcatttatcgtatcggttcattcatcccgacccctggcgtcgattacaccgtcgtccagcagtgcgtcggcaagatgaacaacgcttctgagaactttatcggtctggtgaacctcttctccggcggcgccatgctgcagctgtcgattttcgcattgggcgtcatgccgtacatcaccgcatcgatcgtcatccagctgctgcgtgtggtcatccctcgtttcgaggcactgcacaaggaaggccagtccggcgaagccaagctgacccagtacacccgttatctgaccatcggccttgccgtgctgcagtccaccaccattctggtgaccgcacgttccggcgcgctgttcaactaccagtgctctcaggttgttccggacggttccgtgtggaaccttgtggtcatggtgctcatcatgaccggcggcaccggcctcatcatgtggatggccgaattggttaccgataagggcctcggccagggtatgtccatccttatcttcatgtccatctgctccggcttcctgccgcagctgtgggagatcggctggggcaccaacggcaccgatggcaattggggcaagttcgccgcggtcgtcggcaccctgctggtcatcatgatccttgtcatctacgtcgagcttgcccagcgtcgtattccggtgcagtacacccgccgtatgatcggccgcaagatgtacggtggctcctccacctacctgccgctgaagatcaacatgagcggcgtcatcccgccgatcttcgcatcctccatcctggccgtgccgacgctgatcgcgcagttcggcaattccgaccagtcctgggtcaagtggatcaactccaacctggccaacaccacatccgtgtggtacatcgcactgtacgcgctgatgatcgtgttcttctgcttcttctacacggagatcaccttcaacccggacgagaccgccgacaacatgaagcagtacggcggcttcattccgggcatccgcgcgggaagcgccaccagcaactacctgagctacgtgatgaaccgtctgaacacggtcggcgccgtctacctgctgttcgtggcgcttatcccgacggtgctcatcatggcgctgaacctgaacaccaagctgccgttcggcggaaccaccatcctgatcatcgcaggcgtcggcctcgacaccctgcgccaggccaaggcccagaccgaacagttccagtacgctggcttcctgttcgaggacaccgaccacaaggaaggtaagtaaccacttgaatcgtgatgtcgtttccgttgatcgggagcggtatcacgatttttatgttaagtaatccatcatccgaaaatccccgttgaggggaatgaacgaaacggagaacaacacatgcgactgctgatcatgggcccgcagggcgtaggcaagggcacccaggccgctctgctgagcgagcactacggaatcccggcgatctccaccggcgatatcttccgctacaacatcaagaacaagaccgagcttggcgtcgaagcgctcaagtacatcgacaagggcgagcttgtgccggacgagctgaccaacaagatcgtcaaggaccgtctggccatggacgacgccaagaacggctggattctcgatggctatccgcgcaacgcctcccaggtcgaggctctcgacgccatcctgggcgaactggacaccccgcttgacgcggtcgtcgcactggatgcagatcacgacgtgctcatggagcgtatgaagaagcgcgccgaaatcgaaggccgctccgacgacacccctgaagccatcgccaagcgtcttgacgtgtacgccaaggagaccgcgccgctgctggacatctaccagaagcgcggcctgctcaagacgttcaatggcgtcggcgccgtcgacgagatccaggccaccatcgtggcggagcttggctgaaggaaaaaccaagcagaataacatatttccaacgaaagcgggaatcgcgacacgccgaacgtgtcttgattcccgctttcgtgtattcttgcaagttggtgtgtcttcgggcacgcatagtaatcgccaaggaacggaacgaggctcatggctaaagacggtgtgattgaagtcgaaggacaggtagtggaagcactgccgaacgcgatgtttcgtgttgaactcgaaaacaagcatatcgtgctcgcaaccatttcgggcaagatgaggaagaactacatccgcatcctgccgcaggatcgtgttgtgctggagatgagcccctacgacctgaaccgcggccgtattacgtaccgttacaagtaaaggtacacaagcaaaggaaaaccatgaaggtcagccctagtgtgaagaggatctgcgagaactgccgcgtgatccgtcgtcacggccgcgtcatggtgatctgcgtcaacccgcgccataagcagcgtcagggctgagagcagatccagcggcataaacagtacaggcgctgagtcacagcccgtgaaagcgggatgaaccccgggtacgcaggcccgggccgggaaaccggacgactcggtgcaagacctgcggaaaacagaaggaatcgcaatggcacgtcttgccggagtcgacatccccaatgagaagcgcatcgagatcgccctcacctacatctttggtgttggtcgtactcgtgccaaggaaacgcttgccgcgaccggtatcaatccggacattcgcgtcaaggatctgacggatgagcagctgattacgctgcgtgattaccttgagggtaactacaagatcgagggtgatctgcgtcgtgaaatcgatgcggacatccgccgtaagatccagatcaactgctaccaaggccagcgtcaccgtaagggacttcctgtgcgcggtcagcgcaccaagaccaatgctcgtacccgcaagggcccgaagcgcacggtcgccggaaagaagaaggccaccaagtaatcggtggctgacagttcaagccacgaggcgtaagcctcatcgtttgaacatcaaagcaaattcgttattaggaaacgagggtcaatggcagctcaaaagcaagccgcgcgcaagccgcgtcgccgcgaccgcaagtcggtcccggttgggcaggcgcacatcaagtccactttcaacaacaccatcatttcgatcaccgacccgtccggcgcagttgtgtcctgggcgtccggtggcgatgtcggcttcaagggctcccgtaagtccacgccgtacgccgctggcatggccgccgaatccgcagcccgcaaggctatggagcacggtctcaagaaggtcgacgtgttcgtgaagggcccgggttccggtcgtgaaaccgccatccgttccctgcagtccgccggactcgaagtcggttccatcaccgacgtcaccccgcaggcacacaacggcgttcgtcctccgaagcgccgtcgcgtctgagcactagaagaaatcatcaatccaacgccgcttatggccggtgagtgcaccaccggcctgaagctgaaaggataaccacagtgcttatcgcacagcgtccgacacttaccgaggaatctctcaaccctcagcgttcccgcttcaccatcgagcctcttgagcctggtttcggctacacgcttggcaactcgctgcgccgtaccctcctgagctccattccgggagcggctgtgacttcggtgcgtatctccggcgtcccgcacgagttcaccactctgccgggtgttgaagaggacgttaccgaaatcctgctgaacatcaagggcatcgtgctcaccagcgaatacgatgagccggttgtcatgtatctgcgcaagagcggcaagggcgaggccaccgcgggcgacatcaccccgccggccggcgtcaccatcgccaacccggacatgcatatcgctaccctcgccgaggatggcgaactcgagatcgagttcaccgtcgagcgtggccgcggctatgtgcccgcccagatgaacaagcaggataacgccgagatcggccgcattccggtcgactcgatctactccccggtgctcaaggtgagctatcgtgtggaagccacccgcgttgaacagcgcactgacttcgacaagctcatcctggacgtggagaccaagccggctatctccccgcgcgatgcagtcgcatccgcaggctccaccctggtggaactcttcggtctgtgccgtgagctcaacacccaggctgagggcgtcgaggttggccctgctcctgtggcagaggaaaccaacccggagatgaacatcccgatcgaggacctgaacctcacccagcgcagctacaactgcctgaagcgcgagggcatccacacgatcggcgagctggtcgcccacaccgagcaggatctgctcgatatccgcaatttcggtatgaagtccatcgatgaagtcaaggagaagctccagtctctgggactcgccctcaaggcttccccgctgggtaacttcgatgccaataatctcgaaggtggcaccttcttctcgccggaagacgagtgatccgccacttttgacctaaccgcttcgttggattcggacgttcgggcaactgcccacctgaatccaacggggctttcaaggagaaacaatgcctacaccaaagaagggtccgcgtctggcctccagcccggctcatgagcgtcttatgctcgcgaacatggccaccagcctgttccagaacggccgcatcaccaccaccctgccgaaggccaagcgtcttcgtccgctggccgagcgcctgatcacgctcgccaagcgtggtgatctgcacaaccgtcgtcgcgtgatgcgcgtcatccgcaacaagtccgtcgtacacaagctgttcaccgagatcgccgagcagatggagcagcgcgaaggcggctacacccgcatcgtcaagattgctccgcgtcgcggcgatgccgctccggcagccatcatcgagctcgtcaccgagccggtgagcccgaagcaggccgtggtgaaggaagccgaagccgcaaccaaggttgccgctgccgaggctccggaagccgccgctgaagaggctactgctgagaacgccgagtgaatcgctcttagctgattgaaggccgggaatcgcaaggttcccggcctttgccatatctgctgccaagactgtcgcgccacatgcctcactatgccagccatttgctatgctcaatgccgtgagactacgcatcgatttggcatatgacggtaccggcttctacggatgggcgaaacagcccgaaatacgtacggtacagggcgaaatcgaacgcgtgctgcataccattcttcgcgtaccggaaggagacccgaccgaaccgctgcgccttaccgtggccggacgaaccgacaccggcgtgcacgcctcgcatcaggtatgccatctggacgtcaacgaggacgtgctcaaacgctgcgtcggccacatggacgtgccgcccgtcatcgcgcttacccgcagacttcagcgcatgctgccggccgatatcgcaatccgcggcatcgcacccgctccggacggtttcgacgcgcgtttctccgcgttggaacgtacctacgtgtaccgaatcgccgataggtcaagcgaggtggacccccgtaccagaaacttcgtattgcatatcgacgatgaacttgacctcaaatccatgaacgaagccgctgcgatgacgatcggcctgcacgatttcggctcgttcgccaccccaaatccgggcggcaccaccatacgcgaggtgaagaccgcgtattggcgtcgcgtgccgcagcggacgcttatcgacgacggcatgacgatgggggagcggtaccgtacgccgaccgtggaatcgggcctcgtctgcttcgtgatcgtcgccgacgcgtttgcacgcaatatggtgcgctccctcgtcaacggctgcgtgcaggtcggtatcggcaaacgttccctcgactggtttgcaggaaaaatggcggctccgctgcgcgaaggctccacaggaccgatcgcgccgcaaggactgacgctggagcatatcgaatatccggccgacgaccagctggcggtccgcgccgaagccattcgcgccaagcgcacactgtagctttattgcgattgtcacagccaggttacgggcgcttgtcatgtccattgccgagacattgtcgtaacagaccgtttcgttttccggaaacgctggttcgttaggtttttcttccatcaaggcacgatgcctcagattggcatgcgttcgcatggggtggaagggagcgcggaacgatgattgaatccgccgcacgaaggttggcttcggaactggtcgatcgtcgggagtcgatcaaccgggagctgagccgtaatggcgtacggttcggcatctacaagaacggcgagtaccatgaccggctgtttccgtacgatccgattccgcgcatcatcgaatcggacgaattcgacagaatggaagccggactgaaacagcgcgtcaacgcgttgaacgcctacctgcgcgacatctactccgacaagcaggccatcaaagacggcatcgtgccggaagaatacgtgtacacgtccgcgggatactttccgcaagtcaacggcgtgacacctccgggcggcgtgttcgcgcacatcgccggcgaggacctggtgcaggggcaggacgggcaatggtgggtgctggaagacaatctgcgcattccatccggtgccagctatctgctgttcgcccgcgatatcgaacgcagaatcacgcccagcctgttccgcaacgtacgtgtgcgcgacaatcgcgattatccacgactgctgcgccaatccatggatttcgtctccaccgacggcatagcagtggtgctcacccccggcaggtacaattccgcgttcttcgaacatgcatacctggccgagaaaaccggcgcggcgctcgcgttccccgaagacctcgaagtcgtggacaacaaagtgtacttcctcgactatgccggcaggaaacaccgcgtcggcgtggtctaccgccgtctgtccgacgaatatctcgacccgttcgcgttcaacccggattccgtgatcggcgtgccgggaatcctgtccgcctacaggtcgggcaatgtggcgatcgtcaacgctccgggcaacggcgcggccgacgacaaggccatctactatttcgtgccgaacatgatccgctattatctcggcgaagagccgattctgcacaatgcgccgacctacatgccgatgttcgacaaggaccgcaaggaggtactcgaccggctcggcgaactggtcatcaaggatgtggcggaagcgggcggctacggcgtcgtgttcggctcatcgctcgaccggtcgcaacgagaggaactggccgaacgcatcaaggccgaaccgcgccggttcatcgcgcaggaggtcatccaattcaaggacatcgacgtggtggaccccgaaaccggacagatgagctcacgtaaatgcgacctgcgcgccttcgtggtgaccggcaagaacacgcacgcatggtattcgggactgacacgctactcgtccataccgggccagatgatcgtcaactcatcacagggcggcggtttcaaggacacctgggtactggccaaagagaccggcgtggagcatgattacgcacccggctcggaggtcgtgcgcgtgctggaacagtcccgcaagcactcgctggcactcgtcaccgcgtcgaaggccgacaacctgttctggctcggccgctacacggaacgcgtattcaccacgctgagccaattcttccccttctacgaccgtgtgatggacacggatgtggacgcgttccgaccgttcgcccgcgcgctcgacctgccggaggatttcgaggatttcgacgcgttcatccacagcttcctgtacgacgagaagaatccggattccgtacgcagcgccatcgtctacgcgttcaacaacgcggtgattctgcgccccgaacttggttctcgctcgttgcagcaggtggagttggccatgagctccatagtggaggcatccgaatacggcggcacggacgcggatatcttcaaacaccgcgacatcgcggacaacatgctcgccttctggggaggtgtggagaattcccccgtcgaaccgactctgaaatcgttcattttcgtgggcaaatatctggaacgtctggatctgtacacacgattcggatattccgtggaagagctcaaggcgccgctcgccaaactgggcagctacatcctgccgttgaacggtctgccggtaccgcaatgcttcgccgaaggattgcgctggctggtcggccagctgccgcagcggggatatgcggagcttgcggaaaaactggggatgctgctgaaagatttcgatgggcgcatctccacgaaggatctgaaggatctgggcatgctcaacacgatggacatggacgccgcgcgactgtgaagaatacgtgccacagccatcgcacggtgcgtgtataacggctagaacaaggcccacggcgtggaaaacgccgaaggaacgacaataatcgctgaggagacgatgtgaagaaactggtgtttgactatgagatgaagctctcattcagctcgcccgtgaccgaccatcgcttccaactgcgctgcattccagccaccggcccacgccagcaggtgatcgacgtggcagtcaaaatcgaaccggatgtggaactcgaaaccgccatcgattccttcgattccgtggtgatgaccggattcattcccgaaccgcacaccatgttcaactactcggtgaccggcatcgccttcgtggacaacgcgcatatcaaatccgaaatctacaagccgctgtaccgcttcaattcggcgttgacagtgccggggccggccatcgaagcgttgatcggcatctgccatgaacgcatcgtgtccctgcctgccgactgcacgccgatcgaccaagcccgtgaggtgatggacgaggtgttcaaaacgttcgtctacacgccggcctccaccaccatccgcaccaccgccgaggaagcgttcgctcaacgcaagggcgtatgccaggattacgcgcacgtcatgctgtccgtgtgccggcacgtcggactcactgcccgatacatcgcgggattgctcggcggcgagggcgccacgcacgcatgggtcgaaatctaccatgatggacgttgggtcggtttggaccccacacacaaccgtatggtcgacgacaactacatcaccatcgcccatggccgcgattaccgcgactgcatgctcgacatcggcatcttctccggctgcgacgtcaagcaggaccagtgggtcaacgcttccgtgcacgagcagggatactgattccccgacgttttctcgatgccggattccgtatttcggcagatgcaaagcagataaacaaaaaggccgaaacgccattgtttcaaccttcattgcatgcggataaggcgagattcgaactcgcggaggggttcgccctcacacgctttcgaggcgtgctccttagaccgctcggacacttatccattcgtcacctgaaaacaagcaacttgataattgtgccacagtggtggcgattgtcaaatcggactggctgcaacggtgtgatttccggcgtgtcttgatttgcgcccgactgtgcgtccttaggcgaacagcgcttcgtcgaaggaaggatagccccaatcaagcgccaattcgacacggtccgcaatcagaccggcaagcacgcccagggattgcgctcgcgaatccgtcgactgttttgcattggtgacgcgtgactgggaatgatcgttcgcggcattggagcttccggcgattgccgttatctcgcttcgcgcgcagttcatttcgatggtggcgtcggtcggtgccgtaaggccggtggcggaatcgagcatcgtgtcggggtgggcgagcaaggcggtggcctcgtacgttttcctacgatcgtcaatggcgcccgagaaggatgcgaaccgttgcgatgtggtcttatgacgatcgctgatatccagcgtcgcatggccgctgttgcgggccgccagcacttccatggcgaatccggcacggtcttcgtcctgcgcggcggtggcaagggacttggaatcgacgtcaagcgattcgacatcgtcaaaacgcgacagcgtgatcggcgcgacggccaccgacagttgatcgcccagtgcgcgagccatatgacgtgcctgcgcgctgcgcaacgtgccttcggcaaaacgcgccggacattgcgccgcggtgttcgtccatgcggagaccgcctgctgcgccgagaaatagcggcggatgatgtgctgatgctggtcgtgtgcgatcttgttatcggcggtggcatcgaaataggccttctcgcacgggctttgccgttgttcggcttcagccctgcctgcgatcctgggcatggagcatgccgtcagcgccggcatgaggatagcggtgcaaagcaatgcgcagacgcgtttcgcgataaaagaaaccgagcggaaagaaggggtacgtgtctgcatgaatcattagactaatatctgactgtgaccattgggccatgcgctcggaataacttcatataggaggtcttggaaatatggaactggacctggcaggaatgcaccagctcgccgctgggcagggaattgatcccgagacgctggatgccgcactctcggaagcattgcgactggcatatctgaaaacccctcacgctgcgaagcacgctcgcgtcgagcttgatccgcgtgcgggaagcttcaccgtatgggcccaggacgagattcctggcgagccgactgaagacgatccccatcccgcgccgactctgggcgaggaatacgacgacactccgcacgatttcggccgactggccgctgcgaccgctcgtcaggtgatcagccagctgttccgcaaggccgaggatgacaaggtgttcggcgcgttctccggtcagaagggcaagctcatcaccggcatcgtgcagcaggacgtcaaggacacatccaacgtgcacgtggccgtcggcgacgtcgaagccctgctgccgcgccgcgagcaggtgcccggcgaacgctaccgtcacggcgaacgtatccgcgtgtacgtggtgaacgtggcccgtggtctgaagggcccggaaatcgtggtgtcccgttcccatccggagctggtccgccgcctgttcgaacgtgaggttccggaactggtttcgggagccgtgtcgattatggccatcgcccgcgaggcgggcgcccgcaccaagatcgccgtccgtgccaacaccgaaggcgtcaacccgaagggcgcgctgatcggccccggcggagcccgagtgcgcgccgtcatggagaacctcggtcctgagaaaatcgatatcgtcgactggtccgcggatccggcgaaattcgtcgccgcggcgctgtctccggccgtcgccaccggtgtgcaggtgatcagcgagaagaacaagacggccatcgccttcatccacgatgaccagctgtccctggctatcggcaaggaaggccagaacgcacgtcttgcggccaagctgaccggctggaagatcggcatcgaatccgctgaggcgcatgccaagaagatggccgaatcggcggaccattccgatggggaaaccgaggaataaacaacacttccggtagacaacaagcccgtggacgtacaatccacgggcttgagtatgctggactcgacaatccaaagcgtgacggccatgctgtcatgcccagggaaaagacgaggtatcacgaacatggttgcacgatgagaaggaacaagctcgccgtgaatcagtagcggtcgcgcccgtatgcgcgcggcccaagataggagaattgagtgccgaaagcacgcgtatatgaacttgccaaggaacttggcgttgacagcaaaaccgttttaagcaaacttgaggcgatgggcgaattcgtgaagtccgcatcgtctaccgttgaacctcccgttgcacgcaagctgaggaacgcattcgcgtccagcggacagggcaacgcatctgattccaagaagccgggccatacggccaagaagcctgccgaaccggcatctcattccatgccaaagccggccgctccgtcagcaccgaagccggctgcccccgcagcgccgaagccgcgtcatgccgcttccaagtccgatgccccgaagccgggtcatcgcgcgccgcgtccaggcgaatcccgccagcatggcaatcgtcctaacggcaacgccccgcgtccgcagggtggagaccgccgccagtccggtcgcccgacggccgttccgggagctcgcccccagcatggcaacgccccgcagggcggcaacaacgccaacggcgcgaagccgcacaccccgggaccgcgcccgggcaacaatccgttcagccgcaagcagggcatgcacaccccgactccgggtgatattccgcgtccgcatccgatgaaccgtccgagcgtcaacaatggcgaaggacgtcgtggcggccgtccgggtcagggcggcggccagcgtggcggcttccgtggtcgtccgggtcagggcggcgcgaagccgggccagtggggccagcatcgtccgggtcagggcggcggccagcgtcccgccggcggcggcaatcgtttcggcggcaatggcggcggtttccagggcggcaacagcgctccgagcaatggtccggcacgtggtggccgcggccgcggcggcgctgcaggcgcgttcggacgtcagggaggcaagtcctcgaaggcgcgtaagaaccgtctggcgaagcgtcaggaattccaggagatgaaggctccggtcatcggcggcgtgcgcattccgaccggcaacgggcaggaagtccgtctgcgtcagggcgcgtccctcgccgatctggccgagaagatcaacgtcaatccggcggcgctggtcaccgtgctgttccaccttggtgaaatggccacggccacccagtccctggatgaggccacgttccagatcctcggcgaggaaatcggctggaacatcaagatcgtgtccgccgaagaggaagacaaggagctgctgcagcagttcgacatcaacctggacgaagaggaactgcaggaggacggggatctgaagccgcgtccgccggtcgtcaccgtcatgggccatgtcgaccacggtaagacccgactgctcgacaccatccgccgcaccaacgtcatcgaaggcgaagccggcggcatcacccagcgcatcggcgcataccaggtgaccgtcaaccttgagggcgagccgcgcaagatcacgttcctcgataccccgggccacgaagccttcaccgcaatgcgtgcccgtggcgccgaactcaccgacgtcgcgatcctcgtggtcgccgccgacgacggcgtcatgccgcagaccgtggaagccatcaaccacgcccaggccgcgcatgtgccgatcgtggtggccgtcaacaagatcgataagccgggcgccaacccggacaaggtccgcggccagctcaccgaatacggtctggttccggaagaatacggcggcaacaccatgttcgtcgacatctccgcgaagcagggcaccaacgtcgacaagctgctcgaagcggtgctgctcaccgccgacgccgagctcgacctgcgcgccaacccggatatggacgcccgtggcgccaccgtcgaagcccgacttgacaagggccgtggcgccgtggctaccgtgctggtgcagtccggtaccctccacatcggcgatgccatcgttgccggcacctcctacggtcgtgtccgcgccatgctcgacgagaacggcaaccacatgcaggaagccggtccgtccaccccggtgcaggtgctgggtctgacctccgtgccgaccgcaggcgacctgttcctggtggcctccgacgaccgtaccgcacgtcagatcgccgagaagcgtcaggccaccgagcgtgcggcccagctggccaagcgccgcaaggtcgtttccctcgaaagcctcaaggagcagttcgccaagtccgaggtggatatgctcaacatcgtcatcaagggcgattcctccggttccgtcgaggctctggaagattccttgatgaagatcgaggtgtccgacgaggtcggcatccaggtgatccaccgcggcgtcggcgccatcacccagaacgacgtcaacctggccaccgtcgacaaggccgtcatcatcggcttcaacgtccgtccgaaccgccaggtggcggatctggccgaacgcgaaggtgtggagatcaagtactactcgatcatctacaaggccatcgaggacatcgaagcatccctcaagggcatgctcaagccggaatacgaagaggtcgtcacctcccactccgagatccgcgagatcttccgctcctccaagttcggcaacatcgccggcgtcatggttcaggacggcgaggtcaagcgtggtacgaagtgccgtatcctgcgcaacggcatcgccaccgtcaacgacctcgagatctcctcgctgcgtcgtttcaaggacgacgtcacctccgtcaaggaaggctacgaggctggcatcaacctcggcaccttcaacgacatcgagatcggcgatatcatcgagaccttcgaaatgcaggaaatcgagcgtaagtagccgagtgcttcgagcttcgcatcgataactaggtaaggaacgcccacagccggttcacgactgcgggcgttccgtgatacaacaagaacttttcaccaaaaggacagcaatggcaggaaccaatccccgcgccgcgcgcatcgcggcgttgattcagcgtgtgatcgcatcgtccatggaggcgcagctgcacgacaagcgactggccaacgtgaccatcaccgaagtgcgcgtcaccaacgatctgcagatcgcgaaagtctactggacccagctcggccacgaaggacacgagcagggcgaacgccgccgcgcgcagcaggccctgaaccaggccaaaggacgcctgcgttccctggtaggcaccaaggccggactgcgactcaccccgcaactggaattcatcttcgacgaagtgccgggcgaggcccatgagatcgaggacatcctcgcgctcgcacacaagcgcgacgaagaactcgccaagtcccgcgccaacgcgcaatacgccggcgacgccgatccgtacaagcacgacgagcccgatgatgacgacttcgacgatgatgacgatgtcgaggtcgaggattgggacgatgacgacgaagcctgacaactccggtctgctggtcatcgacaagccgcagggcgtcaccagccacgatgtggtcgcggcggtgcgtggcgccctgcacatgaaacgcgtcggccatgccggcacgctcgacccgatggccaccggcgtgctggtggtcggcttcggcaacgccacacgtctgctcaactacatcgtcgaccacgacaaaacctacctggccaccatcagactcggccagcgcaccaccacggacgacgccgacggcgaactgctgccgggggagggaactatcgccgaattcccttcacgacagaccgttgaagacgtcatcgcccatcatttcaccgggcgcatcgagcaggtgccgaactcctattcagccatcaaaatcaacggccagcgcgcctatgatctggcccgagaaggcaaggatgtggacctcaaggctcgtccggtgaccatctcggaattcagcgtttcggcagtgcgatacggctatgcttcgaccacatgcgcgggatcaccgcttgccgatgccatcgaaatcgccccggaggaatcctggcatgccgaaaccgacgggcaaaacgaaccgaacatgcagccagtcatggaactcgacgtgaccgtgacctgctcggccggcacctacatccgcgcactcggccgcgatctgggcgccgaactcggcctcggcggccatctgaccatgctgcgccgcatccgcgtcgggcgtttctcggtgaacatgccaaacgtcatgaccgcccatacggaagccaaaaccttcaccaaccgcgaaggcatcgaagtgacacgcaaccgtgcggtgcttgacgatgccgagcatgccgttgaccacgcactcgacctggtcgccagcgcggccgcttccatggacatgcttcccgtcaccgaacaggaggcgacggacctgcggttcggccgtagaatcgcccacgacatccatacgaccatggccgcgtacgttcccgaaaccaacgatctggtggcgatcgtggaacgcgccaaacgtggcgagaccaagccggtcgcggtcttcaactgaaacaatcaagaccggccggcacgcaatacgaacacgacaaacacacggacaatacgcaaagaaggacacatgaagacgatcacgcttacccccgatgccagcggcatggtggattggccgaccctgagcaacgacaagaagtccgtggtgaccatcggctcattcgacggcatgcatcagggacatcaggcggtcatccgccgtgtggccgaactcgccgaacaggagcaggcgttctccgtggtggtgctgttcgacccgcgtcccgcgctggtgcacgcttacgccgccaaacatgacggtcaggaaccgcccgcaggcacgcctgacacgcaggcgctgaccagtgtgaacgaacggctgcgcgccatcgacgccatcggcgtggactacacgctcatcgtgcgctacaccatggcattcgccgcgaaatcatatcgcttcttccttggccagatggtcggcaaactcggcatgcgcacgctggtgctcggctccgacgccgccatgggcgcgaaccgcgccggaaacgtgaaggccattgagaatctggcgctcgccaccggcgtgttccagctggaggtcgtggacgatttcggtccggggctgacccgagtgccggtcaatgcgaagccggtgatgccgtccgaacccggcgagccttccgaccctctggagggggcttccaaggccgaacgacgcgcatggagcaagaagcatcaggccaaggaggtgcgcacgtggagctccaccaatgtgcgctatctgctgagccaaggccgtatcaaggacgcagacgcgatactcggccacgcgcatgccgtggaaggcaccgtggtgcatggcgaggaacgcggccgcaccatcggattcccgaccgccaatctgagcgagaacgtcgccggatacctgccggtggacggcgtgtacgccggctggctggtcgatttgggggagaagtccgctgacggtggcgaagaagccggggagaagccggccgacggcgtatcgcagcagtatgatgcttcgtccgtcaacgcgcgcgtggacatgcagtcgccacaccgctggccggcggccatctccatcggcaccaagccgacgttcaacgaggacggtgacgccgaacgcgtggtggaagcctacgccatcaccgatgactggttggacctgtacggccatcaggcgcgcgtggaattcgctggattcctgcgcccgcagatcaaattcgattcggccgacgatctggtggtcgagctgaaacgcaacgtcgaggagacgaagcgcctcaccgcttgagacggatcggttcgattgatttgattggttcgattgacgcgaatcattgacgccatccgtgttttgttacccaaacgggctttcccgggttgcaaaaagcggatggcgatgccgtttgggcatcggcgacctatcgcagaatcgcggccaacgcgtcctgcaacgtatccgcctgcaccacgcccattcccggcacggcgacgttcttgcgcagcgtcggcacaacggcggtggtgaaaccaagacgcgccgcctcacgaagccgatattccagtctcggcaccgggcgcacctgcccggtcaacgaaatctcgccgatcgcgcacgtcgtgcggggaatcggtttcgatttcgcagcgctcgccaacgcggccacaatcgccagatcgcaacccggctcacgcgcctgaccgccggcgattgtggaaatgtacaggtcgttggccagcagattgatgccaccgtgacgatataacaccgccaccagcatggcgatacggttggagtccacaccgttcgccgcacgacgtggcgtcggcagcaccgacttggtgaccagcgcctgcacttcaatcggcagactgcgatgcccatccaacgtgaacgtcacgcacgtgccatccacctgcgtcgccgcagaaccattgccggttgataggaacaggccggacggatcggtcacctcctcaatgccctcgccgctcatatcgaaacagccgacctcatcggtcggtccgaaacggttcttcactgcacgcagcatacgcaacgcggtttcggcatcgccttcgaactgacagaccacatccaccagatgctccaacgtacgtggacctgcgatcgaaccatccttggtgacatgacccaccaaaagcactggaatatcaagggttttggcggtgtcaatcagcgcgctcgccacttcgcgcacctgcgtggatccgccggagatgccatcgacgtcctgcgagacgatggtctgcgccgaatcgacgatggccaacgccggcttgaactgttcgataagccccaacaccgtggacagatccgtggtggaggcgagcagtagattcggctccatggcgccgatgcgcgacgcgcgcatgcggacctgcgcctgcgattcctcgccggaaatatacagtacggtattgcgctcggtggcgaacgccgtcagcctcgccacattgccggcggtttccagcagcaatgtcgatttgccgatgcccggctctcctgcgatcagcgtgaccgatcccggcacgatgccaccgccgagcacgcggtcgaattccgaaaatcctgtggcgattctggagatgttctccgtgcctatgtcggtgatcggcctcgccgcggacgatgcgaccggatgcgattgcgtgcgcgaggtccgtcccggagccgcggtacgcgagcctgccgcgggacgggcttcatggaattcctcaatggtgccccattgaccgcattcggggcagcggccgagccacttcgggccgctccagccgcattcggaacagaggaattgcgaggacgtctttgccatatcgccgacaatacggaggttttgggacaagacgttcgcgggtggcgtactcgttgcacagacattgcgctgaaaaccgtttcgggaactggattccatgacttcgaggggatggttgcgcgtcttatggctgtgaaagaatgacaagcatgtctgatacgcagaattcctcttcgcatggcaaattgattgccgccgtcgtagcagccgcgcttgtggttgtgcttgctttgatttccgcatttgtgtggcctggttgggccttgaacaagaacggacaggccggtcaggccggtcagacgagccagcaggcttccacttcgaacggtacggacggcgacaagacggagcccgccaaaccgtcgatcgatgccgtggcattgcccgacggggccagcgagctgctcaaggccatgccggattccgtattgaattacgcgcgtaccaaggctgacgccagcacgacgtggtccagcacctctcccgtcgaggaatacgcgttgacgtattccaccggcaagaaaggacaggacgtcacgctggaagtgggccagtggaacgacggcgacaaggcgaaatcccagtacgacacgctggctgaagccatgaccggcaaggagctgggaagcggcaacgtgaaggtttccggcaagacgaccggcgcctacagcgccaaagccgatccggacgacgataccaaggccgttgccgtgtggcgcaacgatacggtggttttctatgccaccggcgcgaagaacgacatccagcgtttctaccagcagttccccctgtaacgtcgacggaatcgtctcgatggcgaatcgcggccggctgatggaatatcacgcggaaaacgaaacgtgattttccaccatatgaatgtctgcgcgcgtattcgtccccgaagcagtgtagtattgggcaagttgcaaacttttaccctttgagtttaaggaacggaggctgagatgggctcggtcatcaagaagcgccgcaagcgcatgagcaagaagaagcatcgtaaactgcttcgtaagactcgccaccagcgcaagtagtcttcaggcgcgtgtgaagcgtccgctcaaacaaaatcccgcgattcctttcggagtcgcgggatttttgctatctgcgcggcggtgtcggccggtatattccacaccagccgacacgcctgcctgtcaggatctcacttgttggggttgtccatcacgcgcgggccgttcggatcgccgacgatgacctggtccaccatgttcaggaacaggccgtgctcgaccacgccgaccgtggtgatgaggtcctgcgcgagctcctgcgggtggtcgatgcgctcgaggtgcagatccaccacatagttgttctcatcggtgcgcaccggctcgccgttcgcgtcgagacgcagcaccggcttgtagcccttggcctcgaacttcttgacgacctggcctgcgccgaacggaatcacctcgaccggcagcgggaacttgccgatggtgtccacgaccttggactcgtccacgatccacacgatcttgttggagttggtggccacgatcttctcccacaggagagccgcaccgccgcccttgatgccgttgaagttcttgtccacctcgtcggcgccgtcgatggtcacgtcgatatggtcgacgtcatcgatgttgacgatcttgatgccgtagccttcggcctgctcctgggtgcggcgggaggtggtgacgcccgtgaactcgaggccttcctccttgacgcgacgaccgagctcgtcgaccaggaaacgcacggtcgagccggtgcccagacctgcgatcatgccgttctgaatcagctttgcagcctcgatgccggccgccttcttcagcgcgtcctgctgtgccttgtccatgatcctccttcgatatggggttaagaccgtctccatactatcggatgcgttgattttcaaggcgcgaatggttggttgcgggagcaggtgtctgttttggactgcggaaaagttttcacggaatgtttcacggtcctgcgtgaggtggcgtgcaaaaaaagacgcgcatgaaatgacatgtggggagcggcttgcgtaaagcggctccccacatgtctcgctcagctatgtttgaccgcgaacggcgcctcgtccaataccagcgtgccgtcacccatcacatagccttccacggcgatatacccacggatgagacgtggattgccgtcgaaggtcgggctggattccggtgggggagtgaaccgcaccgtacccgacaccgacaggcccgatgggcttggacgatgcggcagtttcggcagatcctgcgattgcgatgaagctgcctgttccggtgccgattcttcgtcgtcttgcgattcgctgcgcgattcgttcgcattctgcggtacggccgtgctgtccgtgtccgtgccgtccgcgttgccagtcaccggcttgtcgttctcgtcgccttcacggggaaaatagtcgggtttgaccagcatctgcgcataggattgatgcggttcaccggattcgtccgttttcccggattcgtccggttcggctggaccgcccgcgtccgggaagctggattcgggtatgaccttcgtcgcttcggtctcaagcattgtggtggtttccgccggttcggtctcgagcacggtcgtttccaccgcatcatctgcgtcgtcatcggttgtctgtccgaaatccgcaaggtcgtgggaaacgccttccggctccgccagcatgctggcgatcgaacgcggcttcgtgctgttgctggaattggcggtatcggcaccggaatcgccggtgccggtcgtggcggaatcgccttgtccgcgtcccatgtggtattcggcggcgctgatcgcaccatccatcagcatcctcgcatcctcgggaacatcggtgccacgcgaatactcggaagccagcagcgactgccatccttccaacggcagatagccttcgcgcacatgcgaacggcaatcgcccgcatacgtgcgtgccagctcgtccactttctcgttgcccgcgttgccggcatgacccttgacccacacgaatcgcaccgaccccgccctatgcgcgatctcattgtcgatggcgcggatcaaatcggcgttcttcaccggtttcttctgcgaattcttccagccgttgcgcttccaaccctgcacccacttggtggagcagttgatcgcatactgcgagtcggtctcgatcaccaggtcttcggaaccgggatgcgctcgcaacgcctccagcacggcgcataattcgccgatctggttggtgccgttcgtcgcgccgccggcatcgcaatcgccggcatgctcgtgccccggcttgccgcctgccgcgggctcgtggtcggcccaggcccaacccatcggaccattcggattgccaagcgcggaaccgtctgttgaaaccgtaatcgtcatgcttctaccctacgaaagccgcgcgactcgccgtttgcccgtcataccgcatcgtccgccatgcggtatcgcctatcgataccgcatggcaacggcatatgcgattagtcgccgagacacagcatgacggaggcgcggaacatgccgtcgctgtgctcgaaggaggccgtgccatggtgccgttcggccgtctctcgtacggtggcggtgcccagccccgtgccaccatgtttggtcgagacgagatcgccgtcgatctgttcgatgctggtatcggcttcgccgtacgtgttgtccaccgtgatgaacagggccgccggagggccggaacgataccggatgcgcactttgagccgcctctcgccctgcgtttgctgggtgatggcctccgtggcgttctccagcagattgccgaccatggagcataattccgcgttgttgatgttgatgtattgcggcaccgccgctttgacgtccacatccgcacccaaatgccggacccaatcgcaatagtagacaagcaccgcgttcagcgacgcatgctcgcaatactgcattggtgccggttgcagcagccggtgtttggacatctcatccagatatgagcggatgccatccatgtcttcagccgcggccaacgcctgcagtgagtggatgtggtgacgcacgttgtgcttgatctgacgcgcctcacggatccgctcgttcatgtgttgcagctgcaacgtctgcaaagcctcataatgctgtcgcctgcgggccgcgagcagacggtccgactgctgaatcatgtaccagatgaggaaatacgccaacaccatgaaacaggaatagaccaccgccacggtgaacgcgatttccagcatatgcgagtccagcagcgtggaattgtccgccggcatgcaccacaccacaatcgcggacgaaacgaacggaaacagccagataagctgccagaagcctttgctgatggatggggaatcgaatgtggctggaatcgaatcatgcagcggatgccaaagcgagaccagtgcgatgacgtcaagcagcagcagattgaccagtcccggccagccgacgcggagattggttgaatccgcgccaagaacggccacatcgatgacgagcgacagatagtagacgatcgccaccatgtaggaagccgtggccacaatcagcaacagttgccgccatggcagttcggtcagccatcgcaggaccagcagcacaagcggcgcggtcggaatgaccgtccacagtgatgggatgcccagagtgccgcacagcacgccgcatagcaggaaccagaccagtccgatggacatgaacagtgtgccgttacggcgtggattgtccatgtgactccatgccatgatgaggcacaatgccaggccggacaacgcgttgagctgctctccgatggcgaagaacagacctgacggggtggtttgggcgatgccgttccggatgatttcgccgagtggtgcgaacatgtcagtcctccgtacgcatgcgggtgaacgtgtattccgcgtatgcgcggcaggtggtggtcaccgccgttttcgtgatgggaatgcgtttgccgcctttcatgacgaactgcgcgttggtgatgccggacacgtagtcgaagttgacgagcacgcctcgcgcggtgcggtagaagttgtcgaacacggtgagccgtcggtccacatcggagaaattggtgcggattttggtctgggtgccgtccgcgaacgtaaattccacgtagtgcgcgttggacagggcgtatgcgatgagccgccggtccatggtcacggccggattgccgaacgccacatgccagctggaatccaccgtgccgggcgactgcgcctttgccagatgggtgaccggcggttttgccttcagctgctcctcgacgcgttccatggtggcttcgaaggttttgcgattgacgggcttgagcagataaccgctcgcctgcacctcgtagccgagcaccgcgaaatcggtgctggacgtgatgaagacgatcgcgcagtcgtcgttctgattgcgcagcagccgcgctatgtccaatccggtggtggcatgcggcagattctcgtcgctgagataacagtcgagcagcagcaggtcgtaacggctgttcttccagctttcgatgaacgatttcgcgtcggggaaaacgtcacagaccgtttgcatggcattcctgccggcggttgcgccgacgttccggccgttgaagtattccgcgcacatggtggcgatcagttcgcgttcggcagggtgatcctcgacgatggcgatgcgcacgttccctccttgctgtgccgtgattgcgcggatgacgttccggctctgcttccaagcgtaccgggagagggaaatacggggtgccgcggagcttgcgtttcatgccagaaaagcacgtttcgtgccatacggcggatatcgacaacgaaaaagacccgctccatacggaacgggtcttttcgcgctacgccttgattacttggcggaacgccgtatcactcggccagagccttgtccacgacctcggtggcctcggcgagcaccttgtccagagcctcaggggattcgaagctctcggcgtacaccttgtagatgttctcggtgccggacggacgggcggcgaaccagttgtccttggtggtgaccttcagaccgccgatcttggcgtggttgcccggagcctcggtgagcttggcggtgatgtcctcgccggccagctgggtggcctcgacgtcgtcgccggtgagcttggcgaacttctgcttctgctcgagggtggtcggggtatcgacgcgcttgtaccagctttcgccgaaacgctccacctgctcctggtgcagctgggccgggttcttgccggtcttcgcggtgatctcagcggccagcaggtccggaatcaggccgtccttgtcggtggtccacacgcggccgtccttacgcaggaaggacatgccggagctttcctcgccgccgaacgcgacctcgcccttgaacagcgggtccacgaaccacttgaagccgaccggaacctcaacgagcttggcgtcgatggaagcggccacgcggtcgatcagggaggaggagaccagcgtcttgccgatgccggcgccttccggccagcccggacgattgccgccgaacagatactccacgcacacggcgatgtagtggttcgggttcatgacgccccagttcgggcagacgatgccatggcggtcggcatccggatcggtgccgccgaccagatcgtacttgtcccaagcgccgttgttgagggaatcgaccagacccttcatcgcgtacggggagctcggatccatgcggatcttgccatcatggtcgatggtcatgaagctccaggtcgggtcgacctgcggacgcaccacgtcgatggtcaggttgaacttctcgttcatcagcggccagtagttgaccgaagcgccgccgagcgggtcgatgcccaggcgtacgccggaggagcggatcacgtcgaagtcgatgacgttctccagatcggccacatagtgctcacggaagtcgaaacgctcgaccagatcggacttgacggcctgctcgaacggcacgcgcttgacgttcctgaaatcgccgagcagctcgttggcgcggtcggcgatggcgttggtgacgtccgccggagccgggccgccggtgaccggatcgtacttgaagccgccatcggtcggcgggttgtgggacggggtcacgacgatgccgtcggccaggccttcgccggtgaagcgctgggtgccgtcggcggcgcggttgtgggtcaggatggcctgggatacgaccggggtcggggtgaagtcgtcacgggagtcgatgcgcacggtcacgccgttggcgacgagcacttcgatggcggtcttccaagccggttcggacagggcgtgggtgtcgcggccgatgtacagcgggccggtgacgccggccttcttgcggtattcggcgatggcctgcgtgatggccacgatgtgggcctcgttgaatgaggtcttcagggacgaaccacggtgtccggaagtgccgaaggagacgcgctgctccggaacgttcgggtcggggacgacgtcatagtactttccaatgacctcgtcgacattgatcagatctgctggggtggcgggcattcccgcattttttgcaaccataccttcattgtgccacgagtttgcgcggaacgcggaaagccatcccacaatgtgcgatgaatacgttttctttttgacgtctcggcgtgtctccagtatggaattggggtttcagtgtcccgatgcccgacgatttgcgcatcgcacgccgatagtgtatcgtttctaacgaattcgactcatgcagggttgcaagtcaacatttttagacgcaagacctggaatgtggcattggtttgccatgttccgggtctttttttgttgcaaaaaagccgcgctgcgtcatcgaatcccatcggaaggaaatagaaaggaatcaggatggctgactctctcgcatcgcagatcatcactgcgatcggcggacctgaaaacgttcgcagtctgacgcattgcgccacccgactgcgcttcgagctggcggacgcgtccaaggtggaccagaacgccctcgaacatatgaagggcgtgcttggcgcggtcccgcaaagcggtgaccgtttccaggtcgtcatcggcggcggcgtggccaccgtatacgaaaacatcatgcatctgcccgaaatggcgaacgccggtgccgcctccgcatccggcgaaggccagaagagcaacgccgacgtcaaggccgaggcccgttccaaggcacgcggcaaggtggcatggctggactccttcttcgagtatctcgccgactccttccgcccgatcctgggcgtgctgctcggcgcctccatcatcatcgccctggtcaacctgctcatctcactgaacgtcattccgaatgacgaggcctccgccggctgggtgttcgtcaaggccatctggaagggcgtgttctacttcctgccgatcatggtcgcctacaacgcctccaagaagctcaaggtcgatccgtggctgggcggcgccatcatggccatcctcatgaccccgcagttcaccagcctgatagacgccaagaccaccacgtgcgtggagaacgcggctctgggcaccaagtcctgcaccgccaacatcttcggcattccgatggcgttgagcgactacagcggcaacgtgttcgtgccgctgctcatggctgccgtgctcgccctcgtctaccacggattgaagaagatcattcccgaaagcgtccagctggtgttcgtgccgttcttctgcatgatcatcgtcggcgcgctgaccgccttcatcatcggcccgatcggcgtgtgggtcggcaacggcctcggcgtcggcctggcttggatgaacacccatgcaccgttcatcttcgccatcatcatcccgctgctgtacccgttcctcgtgccgctcggcctgcactggccgctcaacgccctgatgctcatgaacatccagacgctcggctacgacttcatccagggcccgatgggcgtgtggaacttcgcctgcttcggtgccaccgccggcgtgctcttcatcgccgtgcgtgacaaggacaaggacatgcgccagaccgctctcggcgcgctcgcagccggcctgcttggtggtgtttccgaaccgtccctgtacggcatccacctgcggtacaagctggtctacaagcgcatgctcgtgggctgcggccttggtggcgtcgtcattgccgtcctcggctggctcttcccgtccgtcaccgccgccggccagaccgtgcatggtgtgaccaccaccgccttcgccttcacctcgctgctgaccattccggtcttcgaccagatgtgggtgtacgcggtgtccatcgcggtctccttcctgacctccttcttcctgatcatcaccttcgactaccgcaccccggaacagaaggctgaagtgctggcccgcgccgccgccgatcagaaggccgccgctccggcggtcgaagccaaggaagccgctccggctgccaccaccgccaccgcgactgctaccgccaccaagaccgaagctccggccgctgccgccgccgcgaccaccgtggtgaacgctccggtcgccggccacgtgatcgccctggacgaaaccggcgatccggtgttcgcctcccgcgcgctcggcgaaggcgtcggcatccagccgaccgacagcgaggtcgtggccccggtctccggcgtgctgcagaccgtcgccgaaaccggccacgccttcggcatcaaaaccgatgacggtgtggaagtgctcgtgcacgtcggcatcgacaccgtgaagatgaacggcgagggctttgtcgtcaaggtcaaggccgatgagcgcgtgaatgccggcgatccgctggtttccgtcgactttgctaaagtgaaggacgctggatacagcaccaccacgctgatgacggtgctcaacaccgccgccctcacctccgtcacgccgaagaccggcatcgacgtcaaggcaggggacgaggtgatcgacatccagcgctaacctgtcacacagaggcgaaaaaggggtcgacgtggacgttcttcgcgtattcaacaacaatgtcgtattggctagagacggtgatcgtgaggtgattctcacaggccgtggaataggcttccaagccaagccgggacaacatgtggatgacgcgaagatcgtccgtcggttcatccccgtcgatggcaaggatcccgaccacatggcgcaacaagtggccgggatcccgcccgaaatcatcagactcgtcacggacgccatgaaccgtacggggctgaaagaacaggcagacaagcagccaaccctggtcatggcgctcgccgaccacatctgcggcgcgatacaacgcgcgcaaagaaaacagaacatcgaatatccgctcgaagcggaagtacgttccctatacgccgacgaatacgccaaaggcgtggcgatggtcgacgcgatgaacacgtatttgggtggcgcgttgccccgcagtgaggcggtggcgctcgccttgcatttggtgaatgccggattctccggcggcgacctgtccgccacctacaccatgaccggcatcatccagcagatgatcgccgtcatcgaaggcgcgtacggcatcacgcttgcgcaggacagcgtcaatgtggcgcgattcatcacgcatctgcgttacctgttcgtacgcatccaccagcatgagcagctcgacgatgagccgcaaccaatcatcgaatcaatcaaaacctcatatccgaaggcttgccagtgcgcaaggcagcttgccgtggtggtgaagatgcgtcttggttccgaccttacggaagccgaaatcgcctatcttgccctgcatgtggcgcgcgtgaccaacggagtgaatcggcaggtcgactgagtttccggtatcttccgatattcagcagcccgttccgcgcattcctgacggttcctaatcgttcgactgttcggccggctgcccgcttgcctgttcggtcggctgcggtttcgttggcgtagccgacatattcgcgttcaacgccagtatgccggtatcttcggaagcggcctccggcacgcgcacgcatagggcctgacgttccacgctgaaacggatgtgcttcgtttcaggcagcatatcgccatccacctgcgccaaaacaggcctctccaaagtgatttccgcgctgacgccctgtacctggtcgacggtggagttcgtggacagcggactctgctgagctttgccggtgatggtctggtgcagcacgtcgccgaacagattcgcccaaccgatcaggccgccggacgtgtcgatgatctcgtagtcgaggatgccatcgtcataggaagcttcgggcatcagcgaaaacatggggatctggccgcaattgcccgccatgaacgtgcggaacgtgagaccacgcgtggaatgcgtgctgccgtcggcgctggtgatggtcacattgcccttgtacttcggggcgaacagattcttcacgcccgacacgaaataagccagccagctgatgttcttcttcaattccggatcggtgtcgtcgatcatcagtgcgtcgaaaccgatgccggcgatgatgaggaacgcatgcccgtggtcggtggtctcatcatccagaagggtcagacggcccacatccaccagacgggagccgtgcgacgtggccacggtgagcgccgcatcgatatcgtccacgggaatgcccatattgcgggcgaacagattgccggtgccgatcggcacgatgcccagcgcatgcccggtacccgacagcgcgctcgcgacggtacgcaccgtgccatcgccgccgacagccaccaccacatcggcaccatggtccaacgcttcgaacgcgcaggcgcgaccgtccttgtcgagctgcgtttcgatgaattcgatctgggtgagatgcttcgcctcgcagaactccttgatatgctgcttgcgctgttccgcctggggctttgaaggattgactatgaacgcgtaatgcacttggtcatcgtcacgcttgtcaagcttctccgcgagcgtacggtgcttgtacgcgcggtatccgaagaaggcggccgcgcatacggcgaccacggcgatgatgacgagcaggacgataactggcataggcatgcctctattgtctatgcgattgcgcaaaaagacgaattcgacatgaaaaattcggcgttccctcacgttatatccaaaaatgagaacgatggcgtcagtgtctgctttcggcactaggctgggaagcatgcttgatattcaattcattcgtgaacatgctgacgttgtcaaggaatcccagcgtaagcgtggcgaatcggtcgaactggtcgacgaggtgctgcgctccgacgaggttcgccgttcctctctgaaggaattcgaagctgcccgcgcgcagcagaaggagatcggcaagaaggtcgccgccgcccccgccgacgaaaaggccaagctgatcgccgcaaccaaggaactctcccagaaggtctccgaatacaaggccgcagccgacgccgcagccgaggaatacaccaccgccatgtggaagctgtccaacatcgtcgagccggaagctccggaaggtggcgaggacgactacgtcgtggtcaagaaggtcggccagatccgtgatttcgcagccgaaggcttcgagccgaaggaccacctgacgctcggccgcggcgtggccggtatcgatatggagcgcggcgtgaaggtcggcggctcccgcttctacttcctgcgcggccaggtggcccgcatgcagatcgccatgctcaccatggccgtcgaccaggccgaggaacacggcttcaccctggccatcaccccgacgctggtgcgtccggaagtaatgcgcggcaccggcttcctcaactcccacgccgacgaaatctaccgcctgcgcgagccggacgaccagtatttggtcggcacctccgaagtggcgctcgccggcatgcacgagaacgagatcctgaaccttgagaacggcccgctgcgctactgcggctggagctcctgctaccgccgtgaagccggcgcagcaggcaaggacacctccggcatcatccgcgtgcaccagttcgacaaggtggagatgttcgtctacgccaagcaggaggactcctacaaggagcatgagcacctgttggccatggagcaggaaatgctcggcaaggtcgaggtgccgtaccgcatcatcgataccgccgccggcgatctgggctcctccgcggcacgtaagttcgactgcgaggcttgggtgccgacccagggccgttaccgtgagctgacctccacctccaactgcaccgagtatcaggcccgtcgtctgaacatccgcgaacgtatggaggatggcaacacccgcgccgtctccacgctgaacggcacgctggccaccacccgttggctggtcgccattctcgagaaccaccagcagaaggacggctccatcgaaattccgaaggccatgcgtccgtacatgggcggcaaggaagtcatcgagccgaccaagtgggaagcctgattttccaagacgttcgcgtctgatatgaatccgtgaaagcggcgttggcatttgtgccggcgccgcttttcgtatgttggacggtcccagtgccgtttgtgtcgttctgggcagatgcgtgtgcggttttctgttggaagcgacggggatggaggctgtgccaggtgtcgcacttccgcgcactgtggtatattggcgtttcgtgcgtagcagcgatgttaggcgcaaagggtagatgtctgagcggtctaaagagacggtcttgaaaaccgttgaggtgcaagcctccgcgagttcgaatctcgctctgcccgcaccaatcaagggcttaccgaaggatttttcggtaagcccttttccatgccgtttatggcgattgtcgttgtcgtggcggcaacgtcacacaatccgtcgatccgcggcccaacgggtgagctcggaacggttcgacagctgcagtttgcgcagcaccgagctcatatgggtctccacggtcttgatggagatgaacagttccgaagccacctccttgtacgtgtagccgcgcgcgatcagccgcatgacctcctgctcgcggttggacagccggtccagctcgtcatcgtggatcgggccgccgaacgcgccgttcgcgctcgggccgttctggaaggcggacagcacgaatcccgccaatttcggcgagaacacggcgtagccctcatgcacctgcttgatggaggacaccaggtcgtcgccggaaatagtcttcgtcacatatccctgcgcaccggcgcgaatcaccgaaccgacgtcctgcggcgaatcggaaacagacagcgcaagaaacacggtattgggggagtaaggccgtgatttcgtaaggatttcggtgccgccgccgccctcgccgcccggcacatgcacgtccagcagcaccacgtccggtttggtctgcgcgatcatcgccaccgatccttccacatccgcggcctgtccgaccacgtcgaaatgcggctgcaacgtggcgatcacgcccgcacggaacatttcgtggtcgtccacgacggcgattctgatgcgctgttcccactcgctcattcctgctccttggttcgattgattcattgccgcacctgctgcatgtgccgtgttcattgcgccgattgcacgcccgtatcgccgtccgctgtggtggtcgtagcgctgtccgcatcctccgccgctcctgaaatcggcatgtgcatgcgcacctccgtgccccagccgggcctcgacacaatctccactgtaccgccgcggcgcttgatacgtccgatgatggactcgcggatgcccaggcgattcgctggaatggcgtcgacgtcgaagccgtcgccatggtcgcgtacgaacacctccaccagcttgtcgccggcctcgcagtagacggacaccggttcgccgccatgcgtcacggcgttgacgagcgcctgctgcgtggcatccaacaacgcgtcggtctgcgcgctcggccgcgcgtcgcccaccgtcaccacctcgatcggcttgccatgcgtgtcctccacatgcgccgcgatctgcttcaaaccggcgttgacggaacgatccgacgtggtgcgctcctgatatagccattcgcgcaactcgcgttcctgctgcctcgccagtgaaaacacggtctgctggtcatcggcatgcaactggatcagcgccagcgtctgcagcacgccgtcgtgcaggtgggcggtcatgtcggcgcgctcctcctcgcgctccttcagcgcgcgctccgtgcccaaatcacgcaccagcgtcataatccacggcacaatcgccagcaacacgccgacaagcagcgccaaaccggcgacgagcatggtgaacgtggcgtgccgtgcggactgcataatgcgcacgtgggtggcgatgtagatcgcgtacgcgacgaaaatgaccgcgatgccgccgagcatcgtccataattggccgtccttcgcgttgaaccgcagccaggagacgccgacgccgaccacgccgagcagcaacggcacaatcagcgtgccttcaatgcctttcgccgccatcgccacgcataggcccagcataagcagtcccgccatggccagcagcgcgggtctcggcgcgttggcgaacatctgttccaggctttcggacgattgtgctccgctgccggattgcatgccgtccgcgttgccgtcgctgtcttgcgattgcgcgccgccgtttccgacgttccttaggtttcttacgttcctcacgttgccgtgggacagcggcgcgttctcgacgggctggctgccggcgatgacgtacgcctgctggaccgggtctccgacgggtacggtgatccacagaaaaatataggcgatcgcgcccgcaccgaagaaaaacgtggtgaccacgaaaatgaaacggatgagatgaacggacacgcccagatgtatgctgatggccttggccacgccagcgacctcgcggccgtacgtcgggcgcagcaatggcagtcgcgccggcttggacggcacgggacggccttcgcgcagggcctgttcgtagcaccagcgcatgtagaccgcgctggcctggtcgtactgttcctgcgtgtaccgcggtttggctaaggacttcatgcttccattgtgccctgtcggggatgccgattcagggctttcagctggtgttcagggcagattcagggtgttccccgatacgtatgacggctgcggattgctgtaatggagatatgagcaacgcaaacaacaatccgcaaggcggcagtgccgctggttctgccgaaccgcaatcgcagccacggccgccgatgtatcagccgcagccgaatcgcggcaatcgattcttcgcatggatccgctccagccggatcacgcgcggccgcaaccggtggatcgcaggcgtgtgcgacggcgtggcgcgccgcttgggatggaacgccaccctggtccgcgcgctggtgattctcacctcgctactgttcggcgccggagcggcgttctacgcattggcttggttcctgctaccggacgagacggatggccggatcctgtgcgaggagctggtcaacggccattgggattggaactgcgcgggcgcgctggtatgcgccgcggtggcgctgtgcctgcccggcgccggatggctggcgttcggcgtggccgtgctggtgttctggctgctggtgaaccgccagtcgtatgcggcgagctggcagccgccgcagcagggcggatcgtggcctgggcagcctgctcagcccgttcagccgggacggccggtgcggcctgcgcaatcgcaatatatgccgcagccgatgtccacgaacacggccaccactgcaaacatgcccggcacgccaggccagccgatgccgcagccgacgtgtcccgcgccttccggctaccagcagtacgcgcgtcccgtccaatcgctataccagacgtttcagcagccggtgaacccgcctgcagcgtttgccacggccaatgtgccgccgaccttcaccgttccgccgacggtggcggcgccgcagtcgaaacgcgcccgccgcaagccagccggaccgctgctggtactggtgacgcttggcttggcattgctggcgatcgccggatctggctggtacgccattacgatgccggttgattgggattacgccttgcgcgtgctgcgtctcgccacactgtgctgcggcggcatctgcctgggaatcggcgtggtgatcgtcgtgcttggttgcatgggccgtcgcaccggcggcctgcatccgctggcatggtgcgcggcgttcatggccgtggtgatgacgttctgcacgagtgcggtggcatgggaaagccgcgattggatgatgtcgaatgactaccaccgcacgacggtctccggcatcgtgacatggagcgacaccagcgacgcccagatgaaacgatacgaacagggactggtggtggtcggcaagaactacgccaacgatgtgctcgacatcgatttgagcggatatccggcagcgcatggcaagcacaaggtcaagctcaacgacggcacgtacggcgaaagctcatgtccgacagggaagctgaatctggtggtggtgaacgcccaggtggtggtcacgctgccggacggatgccagtggtcggtcagcgatccggacgacggctacaccaacgtcacggattacataggagggccggacgggattacgttcttcaacggcacgggcttcatgggcctgtccctcgacgagaacgatgattcgggactcggccatcatggcgtgaacaagggcgttccggcgctcaacggcaccaccgatttcgacgattccggcgatgatgatgcgggcgatgccggttcggatacggagaacgattcgcaggattcggtatacgccggcacggatctcgacaaggcattcaaaacgatctacgagaacaagtggtattggccgtcgatcgattcggacaaggctccggaggaaccggatctgtatgtcaacgtcgatggaacggtcggcggcagtgtcaccatgcagtacacgtccgacagcaagctgccagtgggaacgacgggcggccaatcgcatggcagcgtcgatggaaagaacgtcgggaaaagcgccagcggaaaggaaacgaaatgagtgacgagaaaacccgtgaagtgccgttgaccgacgtcatgggaatcgcggaggtctcggacgagcccacggaaaccctgccggccgtcgacgatccgggcgaggcgaagaccgaatcgttccagaagccgttcgacggcggtccggaagcgcagaggaagttcgaatcgcaggacgaggccgaatcgctggaaacctccggacaagacatgcgcggaagctttgcgggccgttcggcacgtccgaccggttccgtcaaatcggctgatccagccaaatcagccgagccggtcgacccctccaagcaagtgcgcatcggcaaaacggacggcgagctggtaatccgcccgtccggaccaagcaccggaaccatcgtgctgggcgtgttcttctgcctgatcggcctgatgtccatgctgtgcctgctgcccatcggcgcatggcggtggatgccgaatccctcgacgctgttcttctacgtggtcggcggtctcggcgcgctgctgctcatcatttccgtggtctgggccgtcgtcgccgcggtgcgtctgcgccgacgggaacgccagtcagcagaacagtccccagaaagccagcagcgccaacgatagcgccgccgacaccaccacacacgtggccacgatgacatggccggatccgatgcatgcttttccatcttttcctatatcgcatcggcttccggctgcggcatcgtggccattattcatatccgcatcgtcatctatgcttgcaatcgcgcgattcctagcatgacgacggcacgcgtccacgatgatttccgccaacagccaggcgaacgcgacaaggctcagccatgtgagcatgacgatggcatgccagttcttggcaagcgccgccgaattgtcggtcaacgagatcgcatcaatgatgacggtgaccagatacgccaggaacacgccggtcgtgccgacggcaaggagggtgttgagcgccagtgcgacgcgcatgccgaccgggaatcgatggtcggttattgcgattggacgtgccgcattcggttgtgtggatggacctgtcggtgtggtcgcatccgttgaaaacattgaagtcgaatccgttggctccgccggttccgtcgaagccgaatcgtgcgatacccgccgtgacgcacggcgctcgcgcacccagccggcgatgagcagaattggcgcgccgcacatcgccagcagcgcgcagagcaggcaaaccgcgattgcgccgacaatcacacccatcgacttcaccagcgcgggcggggtcttcagcggtgccgcgaccgtctgattcggctgcgttccggcgatcatcggcgttgcccagccgttcgcacccgtgccgctcgtcaccgcgttgatccaatcctccagatcgtgcgtgtaatgcggttccaacggcagtcccggaaccgtctgattcgaaccggttcgaagctgatggttcgcgtcataataccgcagcgtcacattcgtattgccagcctggtttgcggctttgatcagcagccgcgcgccctgttcgaccggcatggctgtgtccttgacgccatagttgataagcagcggcatggtaagcgatgtgcggtatttggccgcgtcgaaatccgcataggcgagtcccatgcgttgtgtgccaaggctggtgatgcgcggaataagctgcttgacggcatcgggtgcgcccgcggcggtcagataattggtggctgcgagcgtcatctgctgacggcccgaaacgaccgggggagaggtgaggatggcgaaggcaagatccggatgctgttgcgtcagcacggtggcgatccatgtgccttccgattcggcgtagatgccggtttccgatctgctcacgcccggccattttctcaggatttccagcgatttcgcatagtcgtgcgcgctggacacgtagtcgcggtgcagcatggtgtagttgtcgagccgcttgtccggcacgagagtggtgatgccggccgacgccatcgcgttcgccacgtcgccgaacgcctccgacgatttgccggtgcccgaaccgtgcaggaacaggcatgcgggatgatctgccggcgcgtcgagcggctcgcgaacgatggcattcacggttttgctgccgtccaacgcgaccgtgatatgcgtttccttggtgcggtacgcgccctcctgcggggttttgagcacggcacctgtggcctggtcaacggcttggatagcggtattggtcgtggtgagcgtgatatggtccgtgaacggctcgacctgccatttcggcgccatcgcattgccgagcgcgcataggaccatggtcagaagaagcgccagcgcggtagtcgccgcgcaggtgacgagaattcgtttcacaatgcttcgcacggtacgccactctagtcgtattcggcgtacgtggcgcggaaaacacggaatcatggggaatccgcggaacgatcgcaattcctgcgccgcgagtcaatgctcccgtgccgtaaaacaatacgaaatcaggggaaaatcgcaataatcccctccacaatccacctgtggatatgtggaaacccgtcggtttcgccgcacctttccgccaaaccgacgctgagcgtcctccagccgtcggtttgatattgcgatttccgccaaaccgacgcttaggccctcctcagcgtcggtctcgcggattgggggcgatgggatcgacgctgagatgggatttgggggagaaggatgggaaggttgggatggggctaggcgcgggcttcgtagcgacgggtgtagagcaccagcaggatgacggcgagcaggctgatcggcgcgcctgcgatgccggtgaaatggtaattcatcgccgtcgcggtcagtgccgctccgccgacgatggaaccgatcgcattgccgaaattgaaggcgatttgtacggcggcaccggcaatcagctcgccgccgccttcgcccgcctgcaccatcagcagttgctgtggcgatgaattgaagaacagcgcgaaaccgatgatgaacgtcagcaacgcggtggtcgcatgattaccaggcaacaggaagaccagcaacagtccgcacaaggcgatgccgtgcgatagcgccgcggtcgcgcccgccttccacaggtcggtcagcctgccgcccacgatgccgccgaccaccatgccgaggccggcgagcaccatcagcatcggcaccatcgtcgccgaccatccgccggttttctgcaaccacggcgacacgtagctccaccagcagaagatgcccgaattgccgaagaacacggccagcagaatcagccacgggccgggatgggtgaggaagcggaactgccccttgatgccggcgtccttgatcggatcgatggacggcacccacgaaatcaccacgacgatcgtcataagcgcccaggcggccagaatcgcaaacgccagccgccaggacatcgcctcggcgagcaacgttcccgcgggcacgcccagcatgttggccaccgtctggcccatcaccatcatggacacggattgcgcctccttgcccttgtcggcaagcgttttggcgatcagcgtggccgtgccgaagaacgcgccatgcggcaggccggaaatgaaacgcgccaccagcagcatcggcgagcagaaggagacggcgctgagcgtgttgccgaccaacgcgatggccatgaacaggatgatgagatgcttcggcggcaccttgcggccgaacaccaggatcagtgtgccgacacacacgccgatggcgtatgcggagatgtaatggccggccgcgggaatgctgacatgcatggcggtggccgtctggggcaggatgcccatcatcacgaattcggcggcgccgaggatgaaggcgccggaggccagcgccagaatgcttctcttcatggggattccttattttggattgtccgccgaaccagcacttggatggtgccaagcgtcggttcgatattgcgattcccgcgaaaccgacggtgagacggtgccaagcgtcggtttgatggaaaggcaaagaaaaaggcggaaccgaagttccgccttagttgtcgggctggcgggatttgaacccgcggcctcttcgtcccgaacgaagcgcgctaccaagctgcgctacagcccgtttggcaacagttggatatattacacgattgggcgctgtatgcaaggtcggcgtgtcgcgtgttgtgtagtggcttctcggtacacttggggcttatgactgagaccaacgaatcccaagagaatcagaacgaagaagaggccgcagttcccaccatgaccacggtggaacgcgccgaaatgctgctgcagcaggatgctgcgattcgcgccaagatcaacggcggcgccgcgctggacgaggccgtggacccgtccaataaggaattcggcccgctggcccacccggaacaggtgcagatgcgtgtggccaagcgcgccatgatgcttaaggaaggcatccagccgtacccggtgacccttgacgtcaccgccaccatcgaagaggtccgcgccaagtatgacggcaagctcgaagcgggcgacgagaccggggacgtggtcggcatcgccggccgtgtgctgttcctgcgcaacgcgggcggcctatgcttcgtgcagctgtccgccggcgatggcaccaaaatccagggcatgatctccaagaaggagatcggtgccgactccctgaagcagttcaagcagctggtcgatttgggcgaccacctgttcatcaagggccgcgtgatcgcctccaagaccggcgaactgtccgtattcgccaccgaatgggccatcgccgccaaggcattgcagccgctgccggccctgcacaaggagctcaacgaggacacccgcacccgcaagccgtacatcggcatgatcgcggacgagaagatccgcaacatggtgcgcaaccgttccaaggccgtcgcctccctgcgcaagaccttcgccgaccatgacttcctcgaggtcgaaaccccgatgctgcagaccgtgcacggcggtgccgcggctcgtccgttcaccacgcacatgaacgccttcgaccttgacctctacctgcgcatcgcgccggaactgttcctcaagcgttgcctcgtcggcggcatcgaccgcgtgttcgaaatcaaccgcgacttccgcaacgagggcgtcgacgccacccacgcgccggaattcaccatggtcgaggcctaccaggcctacggcaactacgacaccatcggcgcgctcgtcaagcagctcgtgcaggacaccgccatggacgtgttcggcagccacaaggtgaccctgctggacggcaccgaatacgacttcggcggcgaatggaagaccatcagcatgtacgactccctctccgaggccctgggcgaggaaatcgtgccgaacggcggcccggacaaccccggcacctccgtggagcacctgggcgagatcgccgacaaactcggcgtggaacgcgacgacgtggagaaccacggcaagctcgtcgaacacctgtgggagcacttctacgaggacaagctgtacgagccgaccttcgtgcgcgacttcccagtcgagacctccccgctggtcaagggccaccgctccaaggccggcgtggtcgagaagtgggatctgtacgtgcgcggcttcgagctggccaccggctactccgagctcaacgacccggtcgtgcagcgtgaacgtttcgtggcccaggccaaggatgcgctcgccggcgatgaggaagcctgcgacatcgacgaggacttcctggaggccctcggcgtgggcatgcctccggcaggcggcatgggtatgggcatcgaccgactgctcatcgcactgaccggcgccaccatccgcgagaccatcaccttcccgcttgtgaagccgctgaactgaggcggagcctcagttcaatattcggcttcacgcgaggcggtcgaagaggaagccctgtgggcttccgtgccgccggagccatccttaaaaaataaaagagcaattactaaagggcgttcccaatacgggagcgcccttttgcataccctcgcacacccaacatctaacatgagattcatggaaatatcgacttggattcgcggcgctcgcctgaaaaccctgccgctggcgatcgccccagtggttatcggggccacgctgtcgtggcggggcgtgtttctttactcgcagggtggcgatatatggcatgagccgtgtccgttcttcggcgggcagcatgacttgagcgaattgaaattcggctcgctggtcggcgaatgccagcgttccgcaggctggttcatcttggtggcggtactgtgcggttgcgtggcgttgttcctgcaggtcgccgcgaatttcgcgaacgactattccgacggcatacgtggcactgacgaggggcgtgccgtcgattccgcacggtcatttgcaaaaacaccatccgcggaatcgacttcgactccggaaatgcttccggcatcgcagccccagcatggccccgcccgtctcgtcgcgtccggcgtgagtccaaagaaagtacttgccgtggccggaatcaacgcgctgatcgcctgcctgtgcggtctggctgtcgttacattgaccggctactggtggttcatcctggtcggtatcgcctgtctcgtggccggctggtgctacgtcggcggcaaacacccctatggctaccactatttgggtgagatattcgttttcatctttttcgggctcgtcgccgcctgcggcacgatgttcgccctggccggcacaatctcgaccgaaggcatgctcggcggcgccaacgtcggcctcatcgccgtcgcggtcctgtgcgtcaacaacctacgcgacgtcgaaaccgaccgcacgcacggcaagcacacatggatgaccgctttgggccggcgcaacggcacggtttttgcgattgcgctgctgtccgtcgccgtgctgttgctcgccgcttatatactgctgctgtcgacgcctgcgatgccgacaatcgcaatactggcggtcacgtgcgcgatgtgcgctgccgccgccgtcgcgatcgcaagaaaaaaatacggcgaggcgctgccgctgtgcacgttctcctcactggcgctcgccgtaacgtacgtgtgttgcgtggtgtttgcctagcgctgcaacgacagtgcaacgaaatgaaaattgttgcaaaacgtggggcgtcaatcgtcggaaacggcttgttttgggtgtgccaagcggtagacttgcaagcatgacttacaaactagtactgctccgtcacggacagagcgcatggaataaaaccaatcagttcaccggctgggtcgacgtcccgctgaccgagcagggtgtcgaggaagccaagaacggcggccgcctgctcaaggagaagaacgtcctgcctgacatcgtcttcacctcgatgctgcgtcgcgccatcaacaccgccaacgtcgcgctggacgaggccgatcgcctgtggattccggtcaagcgcagctggcgtctgaacgagcgtcactacggcgccctgcagggcaagaacaagaccgagatccgtcaggagtacggtgacgagaagttcatgctgtggcgtcgttcctacgccacaccgccgccggagatcgatccgaacgacgagtacgcgcagaacaacgatccgcgctacaccggcgatccggttccggaagccgagtgcctggccgacgtggtcaagcgcgttgagccgtacttcaagtccgacatcgagccggagctgaaggctggcaagaccgttctgatcgccgctcacggcaactccctgcgcgccatcgtgaagatgctggacaacctctccgaagaggagatcgccaaggtcaacatcccgaccgcaatgccgctgctgtacgagctggacgagaacttcaagccgatcaagccgcgtggcgagtacctggatccggaagccgccgctgccggtgctgccgccgtcgccgctcagggccagaagtgagtttgttgcgattgggcgcgtgaatagtcgcggctgatcgcatgaaacacatacgaaaaggtgggaacctgtataccgtaggttcccatctttcgttattgccggcgcctttgtcggtaagtctttttcacgttgtatctgcgttttgctgatgtcgccttgcctgcgcggctcggcgggtgccgtgcggcgcaggcaaggcggacaaaacggaatcgcaagaacgtcagatcacgccgtattccttgagcaatgtcggaatatcagtggaatccagcttcttcacgatctgtttcaacacgcccctttcgatggggttgagcttcatatcggtgatcggtttgccgtctcgcagcatcaccgtggcgttgagcaggttgcgcacgtcgtagaccgaaccccacacctccggcacgccgcggtccacgtcgcacagcgtgtacacggcctccatgccggtgcgcatcgaatattcggtggtgaagatcgtgtcgcgcggcgtctccgcgaattggccgaggaatgcgaaattcaccgcgccatccggcaccacatcggggcggtcgccggcggaacgcggcatgaagaaggcatcgatgtacggcatcatcaccggaaccgtgttggcgtggttcttcgccaagtcggcgattttgtcggtcggcacgcccatgtggtacagccattcctcgcagatctcctcgccggtgcaatcctgcatcggcttcttcacatagttgccgggcttgtcggggaacagaccatacacccatacgcacagctggtccttcggctggtctcggaactgctgctggcgattcagcgtccagctcatcagccaattggaatcctcaacggtgacgatgccgccggtcaccacacgtccggagaacggatcgcgcttgcagatcttctggatgtatggcggaatctcgccgtccaacgtggtgacggtggcgctcatccacttcgaatgctccgggtcggagcagaacacgtccggatgtccgaagctcggatcctgcgccgcgatgcgacgccacatatcccaaccgccgccgggcttgatctccggagcccacgcggccggctcggtctgcgaacccatcgaggagttctccacgcagccgccattggtgatgaacaccagatcgttctcgcccaaatcgatgctgcgggtcgtgccatccgccttggtcaggtcgatgcgcgtggccatcttcttggtcggcgagctgaacggattgcgcggatacgcgccgtattcggcctgcttcctcaaaatcgtgtcctgcccggtgccggtgcgctggcgtacgggacccatgccgccgccaatcgcgaaatcgacgttctccaccttcacgttgtagtggaactgcacgccgaagccttccagatacttgatcatcggcagaatcatcgactcgtactggttgtagcgggtgaaccgcaacgcgctgaagtccggcagtccgccgatatggtggatgtagcggcggatgtacagcttcatctccaacgcgctatgccagttctcgaaggcgaacatggtgcgccagtacatccagaagttcgtatcgaacacctcatcgtcgaagaagtcggagatcttcttgccgtatagttcctcgttcggtgtgaagaacagctccatgatctccatcgacgccttgtcggacagcgcgaacttgccgttcgtgccgccgtccacgccgcgcgccttggtggaacggcacagcgaatagttcggatcgtccttgttgagccagtagtattcgtccaacacggacacgccatccgtttcgatggacgggatggaacggaacaggtcccacatcacctcgaaatggttgtccatctcgcggccgccacgcatcacatagccgacgccaggaatgttcgcgccatcgcaggcaccgcccggaaccgggtccttctcgaatacgtggatgtggtcgccgggcatctgcgcgtcacgcaccagatagcaggcggcggacagcgctgcaagacccgtgccgatgatgtaggcgttcttatcgtcgattccctcgggcttccttggccgggcgaacgcttcgtaattgccgttggaatagtacatgacttcctcctttggatgccgctgggcactattgtgccgcgtcgtgggacacaagtatacgggcatgaactggacgcgatgtctagtttttacgactatcggaggaatttcgcttataggtggcggattgcgcctgcatgcgaaagtgattttgcctatatgtggcagatttcttttggaaaaggatgttcggtggcgggatttttacccccttatgatgtttttggccgaggtcatctgccacatataagcgagatgggtggcttccaaacggaaaccacccatctcgtcaaggaaaatgcaagaagaggtgaggaaccctcagtcgatgtcggtgccttcgtcgcgggtcggctccttggacgggtcgaaaccggagacgatgaacatcacgcggcgggccgcggaaacggcgtgatcgccgagacgctccatgaagcggccgatcaggaccacgtcgatgagctgctggttggtgcccttccaatcctcggactgggccagttcgaaggtcttcttgtgcagagcgtcgagcttgtcgtcgttgagaatgatctgctcggcggtcttggtgtcgcggtcggtaagcatggaaaccacctggtcggccacattgtcaaggaacgcctgcatttcggcgaacagcggctgggcatcggccggcagcggggaagcaggataggtgcggcgggccgcttcggcgatgtgacgggccagatcgcccatgcgctcgaacgttgcggccagacgcagggtggagacgaccacgcgcagatcggtggccaccgggttctgcttggccagcagcttcacgcactggtcgatgacgctggattcgagggcatcgatttcgatgtcgccgtcgatgacggcctgggcggcttcaagattctggttcagcaacgcgtcgccggcaccattgattgccttgcgaacgtcttgcgccatgcggtcgaggtcatcggcgactgccttgagctcttcattgaagataacgcgcatatgcttgcctttcaaatgcttcacgtatgtcaatatcgggttcggatataacctctctcaagtgtattagggaagtggcggattcgcacgtgacggacgtgttgttccgccaatgttcaccggcacgttcaccctgcgttcacgaaaatcgcgccacgaccattcatcggggaacgtcagggtgtgcgagaatgaagacatgtttgaatccgtaggcacgtggtggcgcaatctgacacatcgccatggtgacgatcgcaacaatgatgatactttggacgacgcgacgaacacgttgctgtccatactgccgctggcctccatcgtggtcgacgagcatgacgaggtgatacgcgcgcatccggacgcctacgcccttggcgtggtgcgggacgacgccatcgccgatgacaccgtggcaagcgcggtgcacgaggtccgtgcccacggcggcaagaagcagttcagcctgaccacgaccacgttgcatgagccgaagaaggctccgaaagcagggaagccaaccatgcgggaggttgccaaacaggcgttgatcggccaatcgccggacaagccggtgaccacggtgtcccgcccgaactggctgaaggtgatcgtaggcaggctcaacgaacgctttgtggtggtgctggtttccgacgtgagcgaaaccgtccgtttctcccagatccgtgattccttcatcaccaacgtttcggagcagctcctcaagccgacgcagtcgctggaggagcttgcggacgcgttggaacatgactcggacaataaggccgcgattgaggggaacaccgtaaaactgcgccaatcctgcgctcgcatggaacatatggtgtccgacctgctgctgcttatcaaggcgcaggaaccgattctgccgacggcgagcaaccgtatcaacgtcatggaacaggtgaaaaccgtcgtcgacgcgcatcgcgacatggcgcaacggcgcggcatcgacattgaaatcgatggcgacgaatcactggacatcaacggggaaggcgagcagattcaggccgcggtcgcaaagctgctcgaaaacgccatcgcctattcaccggacggcaagggcataaccgtatccgtcaagccgaacgaggacggcaccaaagtgctgctcagcgtgcttgaccgtggttgcggcattgcgcagaaggagcaaagccgtattttcgaacggttctaccgtggcggcaaccagaatgggcattccgaggaaggcatcggtttgggtcttgccatcgtcaagcatgtggcgttgacccaccatggctccgcttcggtgtggagcgctccgggacagggcagcacgtttacgttggggctgccggtcgccagaaattagcggcgattgcagagcgttgggacacgccatatacggcaaagggccgcttccgcaggttggtgcggaagcgacccaatgttgttaccggttatttcgcgattggctgaaccgccggtcgggttattcgccaagacggcggtagtcccaccggtcgaaatgctcccaaaccagcatgagcacgccgatcaccgtgccggcggcgcacatggtctgcaatcgttcgacattgatgccgaaggccagcagaatcatgcagatcaccaaggcgatggcccataatgcggtgccgaacgtgaacaccttccgcaggtcgacgcgcaccggtttgggggagggtttgcgcacgcttgggtcgataatcggagcaaatttcataccgttaccttacctcggtgcgcgcgtcacaggtgctcggccacgtaatcgacgcacttcgtaagcgcctcgacgtcgctcggctccacggacggaaacacgccgatgcgcagctggttgcggccgagcttgcggtagccgttggtgtccacaatgccgttctcgcgcaacgcggcgaccacttgggaagcgttgatgctctcgtcaaggtcgatggtgaccacggcgttggaacgtgcgttttcgtcggaaacgaacggctgcgcgtaatcggacttctccgcccactggtacagcagcgacgcggaacgtgcgcaacgcgccgtggcccaggcgaggccgccattgtcgttaagccagcgcacctggttctccagcatgaccagcgtggccacggcgggcgtgttcagcgtctggtccttacgggagttctcgatggcggaggtcagggacaggaacggaggaatccagcgtcgcgcgcccggcaggctgacgcttttagcgatgccgtaggcgcggtcgatcgcagccggggaaagcacggcgatccacaggccgccgtcagagccgaacgccttctgcggggagaagtagtaggcgtcggtctggctgatatccacgttcagcgcgccggcgccgctcgtggcatcgatcagagtcagcgcgccctgctccttggaaccttcgacacgcttgaccggggccgccacgccagtggacgtttcgttgtgcgcccagcagtaagcgtccacatattcggtgagctccggcaggcgatacgtgcccggtttgcccgcgaagatctccggatcctcaaggaacggcgcggattgcgcggacttggcgaatttcgcgctgaaggagccgtacgtgccgaacgccgccttgcgggtgataagtgacgcgcaggcgatgtcccagaacgcgctggcgccgccgttgcccagcacgacctcatagccgtcgggaatctggaagaaattcgacaggccttcgcggatggagccgaccacctgcttgaccggggtctggcggtgcgaggtgcccagaagattgcgcgcgcccgcgtcgagcgcctggacttgctccggacggattttgctcggccccgagccgaaacgtccatcctccggaagcatgttggtaggaatgttcacagtgttcgtcatgtcatccaagggtagtcagaaggtcggattgcgcgttgatatggccgttttccggacgttcctccacccgtggcgaattatttgcgcaaggacggggtcttgatgataatccctatgtcggtgtacccttacccttgtgacggttctgtaaccgtgcgcggtcataagctgcgacggtttcgcaatccgcaaggagtgattaatatatgaggcatgcggcgcataaagctgccaaggtttcgcacgcgcaattcagcctatccaaggcgttgttcacggcgaaccggggctcccataccgctaaggccgtgcgaatggcacagctggcggaaggcggcgccgtagtcggactcgctccggaagtcgtggataagctgaatgaagtggctccaatgagccgccgtaccatgcgtgaggccgccaaagccgcttcccgcaaatccgcgttggtgacctccgcttcgttggcggcgcttgtcggcaccgcggcgaccgcgttggcgttcagccagcagaacgcatcccgactggtgcttgcggacgacggtaccgaaacgtcccagatcaaacgtgtgtccgatggagcggcatcccgttccgaaggacgtaccgcccttaaggaactggcttccaccagcaacaacggcggttggcagctgggagacaccagcgcctccatggacgccagcctgatgtccaagtccatcgccgacaatccgaacgtcgccgtcctgatggaccaagacagcagcgccttaccggctaacttcaatccgaaccatgccaccggagacgtcggcaacgcctacgagttcagccagtgcacgtggtgggtgtatgtgcgccgccatcagctcggtctgcctgcaggctcccacatgggcaacggctgccagtgggccgattcggcccgcgccttgggctattgggttgataacacgccgcgccatgtcggcgacatcatcgtgttcgccgcaggccaggaaggttccgactcgtattacggccacgtcgccatcgttgagaaaatcaacgacgacggctcgatcgtgacctctgaatccggcgcctccctcaatggcggcacgtattcccgcacgctcacgaacgtgggcgatttccagtatattcactactgagtttccctaccgacgaccgtgccccttttcttgtaagagggatgctgtaagctaaggattcgatgaagcatattaagcattgttccgtgattgctgcgctcgccgcggccgctcttactttcgccggggtggcacctgccgcgctggcagccaatgatggcgccacgcaagatgctgtcgttgctacccgttcgttcccgaagaccaacgccgtgaagaagaacatcctcgcggaggcatcgtccacccaggtcgaatccgattccgactggggcggtgtggaaagcctgaacgttccccaaaccaaatctcaagccgaaaaagacgccgaagccgccgcagcggcagcggaacagcagcgtcagcagcaggcccaggctcaagcacaggcccaagccgcttctcgttccgccgctcgaagcgacctcagcagcagcggttccttcaccgtgacgccgcctgatggggccagcgtgtccagcctgctgacgttcgcgaaccagttcgtcggcaaggttccgtatgtgtccggcggcaataccccgtccggttgggattgctccggtttcgtgcagtatgtctacggccagatgggcgtttccctgccgcattactccggtgctcaggcgactgtgggtcgcgcggttggcagcctcgccgacgcgcagccgggagacatcatcgccaatgcgcagcatgccgcgatctatgtcggcaacggcatggtcatcaactcccagctgaacggcacccgctacgatcccatcgcatgggtgttccccagcagctacagcattcgtcgaatcttctgaagctttgacattgagctaagggcgtatttccgtgaggaatacgcccttttgctttgttattttccgcgtcgttacttgaaaaccgcatgtcgcgcggtatggtggaagtcaggtgcaacgcatagtcgcgttgccgcaacctgattcaagggaggtcgctcatgatcaatgacaaggcaatcctcgtaggtgtcgatggatcccacgccagctacaaggcgacatggtgggcagcgaattacgcgaagcatgcgggactgaccctgcagatcgtctgcgcatattcgctgccaagctatgcggcagtgtcgttcgatgccacgtatacggccatgggcgatgacaatgccgcgcacaacgatgcgcaggagattctgtcgaaggccaaggccatcgccgacgagcagggcgtcgaggcatcgacgttgatcgtcaccggagatcccgcatccgtgttcgtcgaactgtcgcgcaactacaacctcatcgtcattggcaaccgcggcaagggtggtctggccgaacgactgctcggcaccaccagctccagcctgccggcatacgcgtactgcccgatcgtcgtggtgccgtacaccgacgacgaaggcaacctgatgcacttgaacaacaccatcaccaaggtggcagtcggctccgacgaatccaagtggggtctgaaggcgttggagatcgcggccgcgttcgccgattcgtggggcgccgaactggacgtcatctccgccgtgccgaacatgaagggctctgaggacgaaggcgtcatggcgtccttccaggaggatctggatgtgcgcatcaagccgcttgaagcggcatacccgagcctcaagatcaacaagcagatcgtgcccggccccgcagccggcgcgctgaccaaggccagctacgaccatgacgtcgtcgtggtcggctcccgcggacgtggcggtttcaccggcctgctgctcggctccaccagccaggggctgctgcagcatgcggtcggaccggtctacgtggtgccgcgcaagtatgtggaagccgcggagacccgtctcgacaccgtgccgagctcgcctgccgacgtcacgccgaaggcgatcgacgacatcaagggcgtcgaggaagtgccggtcgacaaggccaagccggaagtggtcgaagccatcgaaacgaagatcgatccggaccgtcagtgacggtacggcaaatcgactgaaatcgatataaaaaccgcatagaagagggtggctgcgattccaacgaatcgcagccaccctctaactatgtgcggtacgtgcctcagtgcttgacggtgacgttcatacgcaccggcgtcggctcgacgtacgtatgcttgaccgtgcagcccttctcgatatgacggctgacgcgatcggcgagcttttcggcgtcctcgtcgctcaaaccggcgtcggtggcgtcgatgaccacctgctcgtcgaaaccgatgtaggcgtcggtatcggcatcatacgtaccgtccaccacgatcttcgcgcccttgccatcgcccagcgtatgctcgacggcgaactggctggacagcgcggcgcaaccggccagcgcgaccttcatcagatcgcccggcgtgaactggccacggcccttgccgaacttgatgtgcgcgccatcctcgctgaacgcgtcccaggaaccgtccttgttgcgctctacccacagcctcttgcccatggaaactcctcatgtcctgtggcgcgccgttcgcgccaatccgtgataccaatctagcgcatcgaaacggacgtgggggagtgcgttccgcaagatgaagcgatacggttttgtgattcgttgcgattgcgctggaggccggcggacggccgggatgcgcgttggcggcacactcaaggccgttcggccaagcttacggccttacaacgcgcatcccggccgtccgcctccacgccaccggctaaacttgcctattatggctttgacttccgaacaactcgcagacattcgtactcatattcccgcacgtccggaaacggacattcccatgccttacgaggatctggtacgcaaaatccttacggaaggcacactgaaatccgaccgcacgggcacgggcactatttccctgttcggccagcagatgcgtttcaatctcaaagacagcttcccactgctcaccacgaagacggtgttcttcaaaggcctggcctacgagctgctgtggttcctcaaaggctccacgaacgtacgttggctgcaggagcacaacgtgcacatttgggacgaatgggccgacgagaacggcgatttggggccggtctacggcgcgcagtggcgtagctggccggcgccgacgccggacgatccgaaccgcacgatcgaccagatctccaatgtgctcgacctgatccgtaaccaccccgattcgcgccgcatggtggtttccgcatggaatccggcggaagtggagaatatggcattgccgccatgccacgccctattccagttctacgtggccgacggccgcctgagctgccagctgtaccagcgttcctgcgacatattcctcggcgtgccgttcaacatcgcctcctattcgctgctcaccctcatgatggcccagcagacgggactcgagcccggcgaattcgtttggaccggcggcgactgccacgtctacgacaaccacatcgaccaggtgttggaacagctgagccgtacgccgtacccgtatccgcagatccgcatcaggaaggccgattcgctgttcgactacgattacagcgatttcgaaatcgtgaattaccagcatcatccgaccatcaaggcaccggtggcggtctgaggttgttgccgccgtctggcgcgtctgcgccagacggtagactactgaccctagttccgacttcaaggagtgagtgaaatggagcacgatagtagccgcagtggctatcacgaacccgagcccggacttgccgggcgtgaagacgaggaggattggggcgacgatttccccaaaaccttctctgtgaatctgatttgggcgcaggcctgtgacaaggaaggtcacgacggtgccattggattcgaaggcggcatgccatggcatctgcctgaggatatgaggcatttcacggagctgaccgtctcccatccggtcatcatgggccgcaagacgtgggagtcgctaagcccgaagttccgtccgctgcccaaccgcgacaacatcgtcatctcgcatgacccgtcctatttcgcgccgggcgccaccgtggtggattcgctggatgacgcgttggatctggcccgtcaggaggccattccggatgacggcttggaccgcagtgaaatctgggtcatcggcggagccaaagtattcgaggaagcgatgccattcgccgacaaggcgtatgtgacgcagatcagcatgcacgtgaacgccgacacctacgcgcccgatatccacgcattggtggaatccggagcatggcgcgtggccgaggaaggcacgtggcagaaggcgcggaaaggaaacgaccaagtcgaaggcttccgtttcgtgacgtacgaaagaaaccacgaggagtaacttttcatgtataccgtgatgaccgtgtgcacgggcaacatctgccgttcacccatggctgaaatcattctgcgcgccgaattcgagcgccgcggcttggctgacaaggtcaacgtcgaatccagcggcgtcagcgacgaggaatacggcaatccgatcgaccgccgtgccgtcaaggtacttaaggaacgcggctacgagctgccatcgcaccatttcgcgcatcgcatcacgcgcgacgaaatcgaacgcaccgacctgttcctgccgatgaccgcctcgcacatgcgcgcgctgctccgtcagctgccgcaagccaagcgcagcgaagtgcacatgtaccgcagcttcgacccgaatctgccgaagccggccgcgggacgtgaggacagcatcgatctggtggatccgtggtacggtggtccgcgcgaattcgaagtggcgatcgaccaaatcgaagaggtggcgccatatatcgtcgattgggtcgaacagcagttgcagaactgattttttattgcgattgcggcatgcttgatggtttcaagcgtgccgcttttgttttttgcgatttattgcgatttttttttgggggggggctggctgtgttgtgaagttgcgatttttctgatgttgcggtgtttggtgggattgaatatacggcgtttttgcgatgttgcgattgcggggtgtccggtggaggccggcatatgcgttgcaaggcacactcaaggccgttcggccgagcttacggccttgcaacgcatatgccggcctccacctcgtttttattggcaggttgcgatgttgcttcgttctgtgggtaagttgcgttttttgatttttgtggggcgcctcgtttttgtgggcaagttatgtcttgacggttgggaagcgtggattggcgtgggaggggagagtgagggtaaaagaaaaaccccggcggattgggctggggtttggtggcgaccacggccggacttgaaccggtgacctccgccgtgacagggcggcgctctaaccaactgagctacgcggccgttgtttcagtcttgcgactgacaacagatagaaatactacgacaaaatcgcaattatgcaaaactgcggcgtgtcacggtgtgttgggcgtggcgcgccgcggtttcgcgggaaaggagacgaatctcagtcggtctgcttccaggtgtcgacgtcgatgtggtgctccgggttggcctgccatgcgtcccaagcggacttcacaatgtcctcgacattgtacttggcgtgccagcccatctcctcgttgatgcgcttcggggagccgatcaggtgcggcggatcaccggcgcggcggcccatgacggtctccttgaacggcagaccggtgaccttcttgacctcatcgacgatctggcgcacggaggtgccctcgccggtgccgacgttgaacgcgtcatactttcgctcgtcgcggtccagatacttcagcgcggcgatatgcgcgtcggccagatcggacacgtggatgtagtcgcgcacgcaggtgccgtccggagtcgggtagtcgtcgccgaagatcgccggggccttgcccttcttcagacggtcgaacagcatcgggatgaggttcaggatagccggatcctcaagttccaccgggccgcagccggccacgttgaagtaacgcaggccgcagaagcggatgccatacggttcctcgcaggcgcgggccatccactcgccgaacagcttggtctggccgtacgggttgatcggcagcatcggcacgacgtcttccggcaccacatcgaccggcggcacgccgtaggtggcggcggaggaggagaagacgagcttcttggcgccggaatcgcgcatgccgatcagcacgttgagcatgccgttgaggttctgctggtagtaccacagcggcttctcgacggattcgccgacctgcttgcgggccgcgaaatgaatcacggaatcgacgccttcggccttcatgatctccgcgaggcgctcgccggcgcccggagcggcgatgtccatgccgtacaggcgggagccttcgatgcgggtgggcttgccgtagctcagatcgtcgacgacgacaaccttttcgccggcctgatgaagtgcgtgaacgacgtgggcgccgatgtatccgcacccaccagtgacgagaactgtcatgttctggcctttccttcgaatgagcagtgaaatgcaacagttggtgaaaatgtcaaccattgttcacttttgctcaggtttgttaccttttgaacaatttgagtataacacgtgaacacgaacgcacactaacggctcgttcctgcgtttcctctataaattagggtatgcaacatgacgaaaacacgccgaccgatggtcgcaaaacagaagaaaacgcacagaatatacaacatgtgcagtcggccgctgctgacggcaggccggccctctacggtcgcaaggtgctgtccttcgtgcggcggtccgcccggctcgacgcgcgactgcagcgggcctgggacacctacgccgatacgtatctgctgaacatcaacgcgggcgaagggtccctcggcgtgcgtgagggtttcgtgttcgaccaagcctatatccgcgaaacgtggggcaataccaatcctctgatcgtggaaatcggctccggacaaggcgagaacgtcgttgccgccgcagccgcccggccggacgtcaacttccttgcgttggaagtctacgatccgggcgtggcgcacacgctgctgctcgccggcaagcagaacctgaagaacctgcggatcgcccagatcaacgcgccagaactgttcaaggcggccgtcgacggctcgatcgccgaagtgtggacgttcttccccgacccgtggccgaagatgcgccatcacaagcgccgcatcgtacagcccgagctcgctgcggacatccaccgcgcgttgacggacgaaggcgtgtggcgcatcgccaccgacatcgaggattacgcgctgcacgttcacgaggtgatggacgagctggacggcttccataacgacggcgcattgaccgtgagcctgcccgtcgagcacgtcggcaaaggcaacgcggatgaggcggccgcattgcgacacgccgatttcgctgaatccgagcgattcgatggccgtgttttgaccaatttcgagaagaagggacttgccgccgggcgcgtgattcacgatttcacctatcgtcgcgtgtaatgcgataaggcttggaatttcagtgttttacgaggattcctgtcttattgtggcggtgtgtgacaccggcgcgacacgccgaggtttgcatgtcggccagattcgcgtatagtagggcaagttgtcaagcggaaacgctgaaagcgcccccttcgtctaacggttaggacaccagactttcaatctgacaacgagagttcgactctctcagggggtacgtaccttggaaacaaggtggcaatggccgcgtagctcagttggttagagcgccgccctgtcacggcggaggtcaccggttcaagtccggccgtggtcgctggaacagcgcaagttgttcatggctctgtagctcagttggtagagcgaacgactgaaaatcgttaggtcagcggatcgatgccgctcggagccaccagatacaccccggagcaatctggggttttgtttttctcgcatatcttttccgatttacctgcgcgatttccgctcgtttcccagcacaagcgccatccgaaccatatcggcgaaagacatacgcccattacccccaacgaagagggatgttctgtcccctctgtcgctaaactatggtgcaggtagacaaggggttgacggctgtactgttccatgatgttgacctctaaacgggtgtatccctggggtgaggcgagtggagatactgttaatcggcaacaccgacttcgtgacgaagcagtggatcgagcacgcgttcccccacgacaaggtggtggtggccctccgcaaagggaccgaatccagcggcgaggatctcaaaatcatcgacatgcccgaccgtgacgccatgtcggaagtgttctccaactacgaattcgatcgaatcgtctacttctccgaagatctgacgcctcgcagcgaacgtgacggcgacctgggctacctgcgccgactgctgcacaccgtccgcaatcgcaaggtccagatgctgatggtgagcgggccggaatcggaattcacctatccgcaggaaacggacgtgcacgagaccagcaaaagcctgatgtcgcgtgccggcgaagagctcggcctgtactatgcgcgcacctacgatctggaagtgaagatcgtgcgctgcccctatctgtacgcgccgcaacgcaatggcgtcaccgcatatttcaacggcttgttcgaacaggcacaagcgggagaactgcgcttccatgaacgcgccgaacaacgcacctgcttcctatgcgccgacgatctggccgaacttatctaccgcatattcgacgactggaccgccgacagcgagctgttccacgttccgaacgtgttcgacttcacttacggcgatttgggaacgctgatcgcgggatattttccgggaacgaaggtcgtatacggcgaggaccgtccgcaggcataccccgccgacgaccacgaattgcgattgcggtacggcttttcgccacgatactcgcttcgcgaggattttccgcacgtcatcgaaggctggttgaagctccgcgagaacaaaaccgacaagcatccggtatgggatttcctacgcagccacaacaaatggtggaccgtgctggaaatcatcggcgcgttcctgctgacggaatggctccgcacttttacacaaggcaacagccagctggaaaccgtggacctgcgattgctgttcgtggtgatcgtcggcaccatctacgggctgcatgccggcgtgttcgcagccgtactggcctgcgccggcgtggccatgtcctacgcgtcgcagggcgcgtccttcgccccgttgttctacgacacatcgaactggcttgccttcgtcatttatttcgtggccggatcggtatgcggctatgtgcagtcgcgcaaccaggagagcgtgaggttcgtgcgcgacgagaacgggttgttgcgcaatcgtctggacttcctgcgcgggctgtatcaggatatgctcgacgaccgcagacagttgcgcgaccagatcatcggcagacgcgacagtttcggcaaactgtacgccgtgacccgagaattggacgaagtgcaaccgcagaagctgtaccatacggcgatccgcatcatgcaggaaagcctcgatagcgacagcctcgccatcttccgagtggacaacggcggacagttcgcccgtcttgtggcggcgagcccacggttcgacgtcggcagcttccgctccgtacgcgtctcggattacggtgaaatcatcaccgcgctggaacacaacggcatatgggtgaaccgaacgttaaaggacaaattcccgatgtacgccgtcggcgtgcgtgaccgtggcgaactggccgtgatcatcaccatgggagaggccaaaccggaccagatgaacctgtacttccagaatctgttcagcatcatgtgcggtctggtcgaatcggccatgatcagggccttcgaatacgaggacgtggcgcgccggtccatgctggtgccgggaacgaacctgctgaagccagaagcgttcctgccgaaggtgctggctgccaacgacctcaaacacgaccatatgggcgaccatctgctgctcaaagtcgaatgcgagggaaaccttgaggacgtggactccctgctgatgcaaagcatccgccagaccgatgaggccggcatgctgacggatgacggcgtgtatctgctgatgaaccaggcgggggagaaggaactgccgatcatcctcaaacgtctgacccgttccggcttgcactgctcctacgttccgcagacccaagaggatgccctgctttccgaagcccgatcgcatatcgcgcaagccgacgatgggggtgaaagctgatggggtcgacgactatcgccgcgttgatcatcatcgccgtgcatctgctggtctgcatgacgctgtgtctgctgcaccacgtcggagtgctgaaagtcgatggactgctgctcccgttcatggcgttgattcccctatgggggccgttgagcgtggcgctcatgcattcgcgtgccgtgcttcgtgggggacgacggattcccgccggtctgcaggaactgaaggtcgaggatcaggaacaacgcaacattcttgtggacgaccgtacggattacgccaacaccgtgccgttggaagaggcgctgatcgtggacaatccacggcagcgtcgtaatctgatgctgtccattcttaacgagaatcccggccaatacgccaatctgctctcccaagcccgtctgaacgaggacgtggaagtcgtgcattacgcggccacggccatggcgcagatcagcgcgaaggaagacatcgcgttgcagcaacgcatggaggaatacgagcggaaccgcgattcggacgaggcgctcgaccggtaccgtgaggcgctcgaacactacttggaatcctccatggaacaggggtatgccagaacgttgcagatgcgccgatacaccgacctgctcgccgaacggctcaaacggcataacgactaccgcaccgtatgctcgttggcgaagacgcagatggatctcggttcgttcgatgccgcgtctcgcaccatcgaagcggcgctgtccgcatggccgcgtcaaggtgacgtctggctgatgaaactgcgattggaagccgcacgtcacgatggcgaggcggtgcaacgcaccgtccggcacatcaaggacgaccacatctaccttggcggccgaggccacgacatcctgcgattctggctcggcgacaaggaggctgggcgcgcatgatacgttccgcatggcgcatatggaagcgcttccgttggaaaaacctggtccgcgtgtgggccgtattcatggccatcgccttggtgctgttggcgcaaaccttgggcatccactacggcgcgacgaaattcactttgaaatacatggctcgtaacgaggccattccggcccagaacgccatcatggggcagcgcgccacgaacctgatgctcgtggatagttcccaggatggtgtggacgaggccgaaaccatgatgaaacaggtgctgctcgacatgaaagtgccgaccgccaccgtggatctggccaaaaccgatcccgacgacatcccctcattgaatcggtaccgcaccgtgctgatcgtcatgccggaacttgattcgctgggggatgagctggtgtccatcatgagatgggttgaaggcggcggcaacatgatgcttgccatgacgcctgaaaaaacaggctatctggacgcgatcgggcctcaaatcggcatcgaatcctccgcatacgactacgtgatgaccaaaggcatcaagcctgccagggactttatgctgggtggcgggcacacctacatgttcagtggcccgttcaaatcgtcgttgagtctgaacctcaatgagaaggccgccgtcgaagcggtcagtgccaacggccatacgccactgatctggagtgccgatgtgcgttccggacgaaccgtgacctgcaatatcggcatctatggcaaggtggtgcgcggcttctatgcctccgcgttcagcctgctgggttccgccacggcatacccggtcatcaacagcgccgcgttctatctggacgattttccatccccggtccccagcggagacgccacctacatcaaacgcgactacggcatgagcatcaccaacttctattcgaaggtctggtggccggacctgaccaaacttgcggaacgctacggtattcggttcaccggcgtgatgatcgagaattacggggacgatacgaaagacgctcccgtacggcagaaggacgaatcgcatttcatctatttcggcggactgctgctcaaacagaacggcgaaatcggctaccatggctacaaccatcagccgctcgtactgccgaacaccgattatggcgacgaatacgcgtaccatcagtggccgaatcgcaaagctgtcgtcgcctcgctgcgcgagctgatcgcattccaaaagtccgtgctgccggcggccacagcgtcggtatatgtgccgccgtccaacatcctgtccaaggaaggacggcagacaatcggacgagacgtgcccgaaatccgcaccatcgccagcacctacctgccaagcgacagcaaacttccttacgtgcaggaattcggtgtggccgatgacggcatcgtcgaggcgccgcgcatcgtctccggcggcatggtgggaaacgattacatgcggctcgccgcagaatccgaactgaacatgcatttcgtcagcacccacttcatgcatccggacgacatgctcgaccctgaccgtggcgcgaaagaaggctgggcggtctacagaaaaggccttgagaactatctcgactggcttgaagtgtccgcaccgtccatccgcatgcagacaggcacggaatgcgcgtccgcggtgcaacgcttttctggactgactgtcaagatgagggaatccgccaatgagtgggaattcgacttgggcaatttcaaggaccaggcttggctgctgctccgcgcgaaccatggcacgcccggcagaatccaaggcggaagcatgatccggatgacggggaatctgtacctcatcaaggccacggactccacagtgcacgtcgaacgcaaggctggaggcgcggcatgagaatctgcctggtattggaaggttgctacccgtacgtgcatggaggcgtgtccacatggatgcacagctacatcaccgccatgaaggaacacgagttcgtgctgtgggtgatcggcgcgaaagccaaggaccgtggcaaattcgtgtacgaccttccatccaacgtggtggaagtgcatgaggtgttcctcgacgacgcgttgcgtctgagcggtgaacatgcgaaagtgatcttcaccgacgaggaagtcaaggcactgcgtgagctggtgaatctgagcgatcccgactgggacgtactgttcaacctgttccacaacaaaggcgtgcatccgctgtcgttcctgcaaagcaacgaattcatcgacctgtttacgaagatctgcatggaggaatacccgtacgttgcctacgcggatgcgttccacaccgtgcgatccatgctgctgccggtgctgtacctgatgacgggagaagtgccgaaagcgcagatctaccatgccatctccaccggttacggcggcctgctggcatgcttgggcggcagtatcaaccacgcacccgtattactaaccgaacatggcatctacacgcgcgaacgcgaggaggagattctttccgccgaatgggttgcgcccgcgttccggcaacggtggatccgtttcttcgccatgctgtcgcaggagatctaccgtagggcatggcgtgtgaccagcctgttcggccgcgctcgccagacccagatcgacatgggcgctccggcaagcaaatgcctggtcattcccaacggcatccaatacgaacggttctgcgacattccactcaagcctgaggacggttgggtggatatcggcgccgtggtacgtctggctcccatcaaggacgtgaaaaccctcatccacgcgttcagcgaactgtcgaaccgcgtggacaatgtcaggctgcacatcctcggtggtgtggacgaccaggactatgccgacgaatgctatgagctggtgaaacagcttgaagtgaagaaccttgaattcaccggacgcgtgaatgtggtcgaatacatgcgcaaactggatttcacggtgctgaccagcatctccgaaggccagcctctgtcggtgttggaatcgttcgcggcggcccgcccttgcgtgaccaccgacgtgggctgctgccgtgaactgctggaaggcgaggaaggcgacgacctcggcgtggccggcttctatgtgcctccgatgtaccgcgagggccttgcccgcgccatggaacgcatgtgcgcgagccgcaagctgcgcgaagccatgggccaagtgggacgcgaacgcgtgaaaacctactatcggcatgagcgcatgcttgacgaataccgtgcgctgtatctcgataccgccgaccattacgggttggagcactgatatggcgggaatcggattcgaactcaagaaactgttccaccgcaagggcctggtcgccatggtgcgcgcctacggttatgccggtgtgatctgcaccggaccgatgctgctgggcatcctgctgcagttcggcgtgctggcggtcagcggttggtggcacgtgccccgcgcggaccagaatctgctggtctgcatgatcacgtacacgctgctcgcctcattggtgttgaccagcttcctgtccatgccggtgacgcgtttccttgcggacatgctgttcgaacatcatgaggagaccattcttccatcgttctggggatccacgaccctcatgctggcggtgggtgcggtgctgtacgcggtgttcctgctgttttccggcgcgaccctcatgcaggggttactctgcctatggctgttcctggaaatgatcgtcaattggaatgcgatgagctatctgacggccatcaaggattaccaaggcatcatgtggtcgttcgtcgcggcggtggtcgtggcgttcctgtccgcatgcgcgatgatggcgctgggcctgccgcaggtggaaagcctgctggccgcagtggcgttcggctacggcgtgatgatggtctgggacgtggtgctgctgcaccggtatttcccgcaaagctcggaaagcccgtggacgttcctcgcatggctggaccggttcctgccgctcgccctgacgggactgctgaccaccctcggcttgttctcccacttggtgatcacctggtgtggtccgcttggcgtgcatgtgaagggactgttctacggtgccccctactatgatgtgcccgcgttactggcgttcctgacgattctgatcaccaccgtgaatttcgtggtgtcggtggaagtcaatttctatccgaaataccgtgcctactacgcgctgctcaacgacggcggcaccgtgaaggacatcgtggtggccgaacgcgagatgctcgccgtgctcaaccgtgagctgtactacaccgcgttgaagcagctgttcgtcaccgcggcggtcatctcgttggaaaagatggtgttgggcgtgctgccgctcggtttcaacgatggcatgcatggttatttccgtgtgctgtgcgtcggatacgccctgtacgcggtcggcaacaccatgctgatgattctgctgtatttcactgattacttcggcgcggtgtgctgcgccgcgatattcgccgggtcggccacggtcttgactgttatttcgcagttcgttccggtcacgctgatgggattcggcttcctgctgggcgcgtcggcgttcctgctggccgcggtcgtgcgattggcggtgttcaccgacaatctgccgtatcgtgtgctcggcgcgcagccgattgtggcgaccgaaaagcgcggatggtttacgaaactgggcgaagcgttggacgaattcggcgaacggctgcatggaactttcggacggaaggaatcatgagggaaagcgtggaaagcatggaaaggaacggacgaatgacgatgggtaatcggccgtgcggccgcaatgccatattcaaatgcgtggcgatcatcgccacggtcgtgacgacgttctcctgcgtcgcctgcggaaacgctgcggacagtggttccacggcagacaaatcggcggcgcaatcgcaaggaaagcatgagaaagtcaagaaaagcgccacgcaggggcttgacggcgcgcatctgcgtgacaacgactcgctgtacaaggtgtatgacgacagcggtgtggaaaccatgtatctgacggtctcgcgcggcaacaagtcggaaggcaccgaccacagttggagcgaaatcaaccagtattccgtggatgattacgcggccatgcgcaccaaccggtaccaagtcaacggtctgctgcaggtcggcgacgaacaggggcctgtatccggcgaactcggctacggtgaaaaagcgccgaacgccaccgtgcaggtgcgcggccagtcgtccagtctcaataagcagaagaactacaaaatcgagctgaaaagcggcaaaggcaaatggcgcgggcagcgcaccatcgcattgaacaagcatatgggcgaagggctgcgattccgcaacaagatggcatacgacctgatccgcggcatcgaccagatgatgggactgcgcacgcaattcgtgcacctgtacgtcaaggacgaaacctccggttccaactccttcgacgactatggcctgtacacgcaggtggagcagctcaacaaaagcgcgctccaagcgcacggcctcgacaagaacggccagctgtacaaggtcaactacttcgaattccaacgcgacgcggacgtgatcagactcgccgacgatcccaaatacaatctgtcgaaattcgaggagaagctggaggtcaaaggcaacagcgaccataccaaactcatcgccatgctcaaccagctcaacgattattcggtgccgatgagcagcatcctcggcaaatatttcgatacggaaaatctcgcatactggatggcgttccagctgctgaccggcaacaccgacacgcagagccgcaacatgtacctgtacagccctacgaattccgacaccttctatgtgctggactgggacaatgacggcatgctcatgcgcaaggagaaccagctgcgtaacacgtccgaaggttccagctgggaacagggcgtcagcaactactggggcaacgtgctgttccgccgctgcctgcaaaccaagtcgttccgcgacgaactcgacacggcggtgaaacgggaatacaactacatgaacgccaatcgaatcaacggcatggtgagccactacgaatccatcaccaaccagtacctgtggaaaacgccggattccacatacgagccgttgacccgcgcgcagtatgacgtggtggccgggcaactgcacgatgagatcgagcagaactacaaaacctaccgggaaagctacgacaagcccatgccgttcttcatcggcgcgccgcaagccgacaatggcaagctcaaaatcaactgggacacctcgttcgacttccgaggcgaggatctgagctacgacatcaccgtggccaaggactatctatgcaaggacgtcgtctttagcaagaccaatctggcattgccccaaatcgtgatggacctgccgtccgatggacagtatttcgttcgggtgcgtgcgcgcaacacctccggcaagatgcaggacgccttcaactattacgtcacggaacatggcaagacgtacggcacgaaatgcttctacatcaagtccggccaggtcgtggaggacgacaatgggcagtgatgagacctcgacgtcgctgctgcggcgaatcgggcggcgcgtcgggcggcgtatcggcgaggagcttgccatgccgccacgccgctgcgaggaacgttaccgtcacgagctcaaatatctgatttcgtacggtcagaaggccgacctgaacgtgcgcatggcaccattgctcgaccatgacagccatgcccgtgacggcagctatacaatccgcagcctgtatttcgacgattactggaacaccgcctaccaagaaaaagtggacggcgtgctgacacgtaaaaaataccgcatccgcatctacgactacagcgaccgggtgatcaagctggaacgcaagcgcaaaagcgacagttggatttacaaggaggacgcgccgctcacgcacgagcagttcgaccggatactggccggcgacgtcggattcatggaacacagcgaacatcagctgtgccgggaattctacgtggaatacgtgagcaatgtgctgcggcctcgggtgatcgtcgactacgaacgcgaaccatggatcctcgacgccggcacggtgcgcgtcacgttcgacatggacgtgcgcgccgcggtcgacggattcgacatcttcgaccgcaccctgcccaccctgcccgtgcttgagccgggcaagctggtgatggaggtcaaattcaccgaattcctgccgcagatcgtgcgtgacattctgccaggcaaggcgcaggagataacggccgcctcgaaatacgtgctgtgctatgacaaagcctcgtatctgcggggtttcgactactggcaggaaggctggaacgtgccgagcgtgtgacttgagcgcaccggtcggacgtatcgcggaagaccgaaaacagacggacgaaaacgcgcagccgaaaacatcggcaatcgtagaaaacgtaataaccgaacaatcgcaaaagagaaaacgaaaccatgagcgtaaacgacatgatcaagaaatcggtgctgaactccttcagccaatacaacgtgcccaaaatggcgctggccctgctggtggcgctgctggtgggcatcgtcatctactgcgtataccggcggttctacacgggcgtcgtgtattcgcgcagcttcgcggtgacgctggtgggcatgtgcgtgctcacctgcatggtcacattggccatcagcacgaacatcgtgatctcgcttggtatggtgggcgcgttgtccatcgtgcgttaccgtaccgccgtgaaggatccgatggacctgctgtacctgttctgggccatcacgtccggcatcgcggccggcgcgggcatgtatctgctggtggtggtcgccggcgcggtgatgatcggcatgctcgccctgttctattcgcatcaggacaagggccgcgtgtacatcgcggtgatccattacgcttccgacgcggtcggggacgacatcacgcgcgcgttcggccgcacgaagttcttcgtcaaatccaaaaccatgcgtggcgaccatgtggagatggccgtggaagtgttctgcgacgacaaggacatgacgttcgccgagcggattcgtgccatcgagggtgttgaggacgtcaccctgatacagtacaacggtgaatatcacggataggacgtggtgacaggaaggaatctgtttggctgacacaccggaaatgggcaggacgccgtccaccgacgagcttgtgccggagctgacgttcgacgagatcgaccgtgcgttcgacaacaacgagttctgcttctacctgcagcccaaatgcaatgcggctacgggtgccatcgtcggtgccgaggcgctggtgcgttggaaccaccccaaatatggtgtggtatctccgggcaggttcgttcccatgctggaacaggccggacaaatctcccgactggacgtgttcgtatggcgttccgtggtccggatgctggcacgttgggaacgtgagggccgcaatctggtgccgatttccgtgaacgtctccatggtggacatcgaccagatggatgtggcggacacgctcaccggactgctgaacgaatacgatgtcgacgctcggctgctccaagcggaaatcaccgaaagcgccgtggccaggaacctgtccaaagtggaaagcaccatccgcaagctgcatgcggacaacatcgcggtgctgatggatgatttcggatcggcgtattcgtcgctgaacatgctcaaggacatcaacgtcgatgtgatcaaacttgacatgaaattcatcgacctcgatgaggacaatgccagcaaagggctgaaaatcgtcgaatcggtggtcaacatggccagaaagctgcgactgctggtcatcgccgaaggcgcacagaccaaacagcaggtcgaccagctgctgtccgtgggatgccggtacatccaagggtattacttccacgaaccgcttccggtgggacggatggagaagctgttggccgaacgtcccgacgaccggcatttctgggatatgtcaaacgatttcatgcatggcagctatgtgcccgtcaacggccgtaccatgcttgagacgtccgcgctcgccgccagcaccttcgagattctggccaatggcgtggcggaactctcccgactgaatgtgaagacgggcgagtaccgcgcggtcaaacgcgatggcatactgccgacgccggaaaccgatgatttcgaaacctacgtgcagacgctgatcgccgaacgcgtggtgcatccggacgatgccgacaggttccgtgctgatatggatctggcttcgctccgttcgctgctgttctcgcagaaatccgcgttcggagtgtaccgcagtgaggtgctggccagaaccggcataatctccttcgcggtgattccctcacgtgaatgctccgaaagcgatccatgggccgtggtgatggttggccggaacctgccgatagagtcctttgtccggttgaacggcgaggagtaccgacgggattcattgacggggctgctcaaccgcaacgctttcgacgatgatgtggaattcatccaagccacccatgacaagccgttgacggtgatgtacatagatctgattggcctgcatgagatcaataatcatttgggtcatgccagaggcgacgtggtgctgtgcgagcttgcggatgcggcgcgcgcctatttcggcgacgataatatctaccgcatcggcggcgacgagttcgtgatcatcagtttcgcccattcgatggcgcagagcgcccgacagatggaatatatgcgtcaggagctgcttgatcacggttgcgagctgtccgtgggcatggccgaatccgatgacggcgaggatattccggatctggtcaaccaggcggaaaacgagatgcgcaaagacaagaagcgctactacgccagcggcagcggcaaaaggcagttgcgcacgttgaacaagcagcttgaggacatcctggtacgcaacaaagacatggaatcgttgctgcagcatttgaatacacggtattcgatcgcttatgtggtcaatctgcgtgccgatacgcaacggccggtcgtggttcccggctatgtgcaaaaaatgcttgacaaacatggcggttccttccacgagatgctgctcgactattgcgacaaattggtggcgccggcctaccgggacggcttccgcatgctgttcgactatgattacgtccgcgaccggatatgcagggaaggcgctatacggtacgcctatgtcagaaacgacggcgaacggttcctgattacgattttccccgacacccattccgtggacgaggtcatgtgggtgttcgccaaagaagacacgtcgtccgaagaataggatttcgggcatcggacggcatgctgtccggttttgccggtgttgtgggatattgacgaaaaaattgtgtgtcgtgggtgcttcctcgcatggaaaagggcttatgatgaaaccgttggccgcggcaatggatgccgtggtcttcgcttgaacacacagtcgcttaaaggagagcactatggtctatcgcatgattttcaaccagaccgcgtatttcggccgcggagccatcaaggagattccgggcgtcgccaggtcccatggcttcaccaaggcgttcatcgtcaccgatccggtgctgctggagaccggcaccgtcaagaaggtcaccgacgttcttgacgaggcgggcatgccgtatgaggtgttcgacaacgtcaagccgaatccgccggtcgaatgcatccaggatggcgtcgccaagttcgcagcctccggagccgacttcctgatcggcctgggaggtggttccccgcaggacacctgcaagggcatcggcatcgtgactgccaatccggaattcgccgacgtgctgtcccttgaaggcgtggccgacaccaagaacccgtccgtgccgattttcggtgtgccgaccaccgctggcaccgcatccgaaacgaccatcaactatgtgatcaccgacacggccaacaagcgtaagttcgtggccgtcgacccgcacgacatcccaatcgtcgccttcgtggatccggacctgaccgactccatgccgcgcggcctcaaggtggccaccggactcgacgccctgacccacgccatcgaaggctatatcacaccgggcgcgtggagcctgtccgactgcctgtccatgcagaccatccgcatgatcgccaagaacctcgccaagagcgccgatggagacattccggccggcgaacagatggcctacgcctcctacatcaccggcatggcctactccaacgtcggcctcggtctggtgcacggcatggcccacccgctgggcggccgcctcggcgtggcgcacggtgtggccaacggcatcctgctggccccggtcatggaatacaacaaggactacaccggcgagaagtaccgtgacatcgccgacgccttcggtatcgccgacgcctacaccggcgacatcgaaaccgtgcgtgaagaggccgtccaggcggtgcacaagctcaccgtggatctgaagaacccgaccaagatctccgaagttggcgccaccgaagccgacctggagccgctggcccatgacgccttccacgacgtgtgcacgccgggcaacccgcgccaggccacccaggaagacatcctcgccatctacaagagcctgatgtaggtccgactgcggtaggcgcaatcgcaaaaccgcaatcgtaaaaacaaaacggacggcatcgatcgcatggtcggtgccgtccgttcgctatccgcggaaaatacgccgcgaataatcgctatacctaatcgctattcctcgtgcttctcgctccactcctcatcagtgggagtgtcgtcatacagctcatggccttcctgttcggccaattccatctgctcgttgatccacgcggcctcggccggattgatatcagcggtgttcaacaccttctgccacaccggatacagcagatgcatcacaggatataacgcggtgatgaggatttccggcttgtgcttgcggtaatgctgcggatgcgcgttgaacgtgttcttgaaacggcgcatatagttgaggaacgatgccggagacgtgtccatacgacgtgcgctgatgcccgcgatcatccgcggacaatacacggtcttgagatccttgcccaacagatgcagcgagatgtcgatgtcctcatgcatcacatccgccttgtcttggcagacctcgtcggcgatttcgcgccaggcggtggcgcgcagggccatgttggaaccgaacagcagaggttgcccatcatcggccctataaatacgtttgcgggtggaattgtccccgcgaagcccgaaatgacggctcggcaaatcgtaatacatcaccggaccggtggcgcccatcgcatccggatcctcggtgaaaatgccggacaccacctccacccagtccgggcggatcatgcagtcggcatcgaaacggccaagaatatcgccggtggcatgattcaaaccataatcacgcgttggaatcagaccctgctcatcatcctgatgcagcagcttcaccggcgcttccggatggtccttcatgaactgctccaccacggcaacggtcgaatcagtggaacggttatcgacgacaatcacctcatgaggcatcacggtctgccgggtggcgttgagcaggcaatcgttgatacgctcctgttcattccaggcggggatgacaattgaaacgttcagcatggtttcaagaataggttccagcccgtacacggtgcctgtctacaataaggagccatgagcgaacgcgaacagcatatggatacggacaagaggacgggaacgtccggacagtgcggcaataccgacgaaatgcgttgggatctcggcacgctgttccctgcgaaaggcgatccacgcagacctccggaatggctgggtcgcgcgctgctgtacatcgccatcgccatcgtgctgctctccttctgctggcgcagttggggcaaaatcgaatacctcatcatcgacgtcgtcatctcgctgttcctggcgctcgccgtggagccggtggtgattccgctggtcaagcatggctggaagcgttcgttcgcttcgattttcgcgttgctgatgttgggtgtcctgctttgcgtgatgttcggtctgttcggcaatctgttcgtgcagcaggtcatcgctttgtgcaacggtctgccggccctctaccagcagatctgcgatttcgtggcgcaatacacggatttcaagcttcctgagatcaacagtctcggcggtgagattctgaagaacatccagacctcgtgggtcacggatttcgcgggcaccgccatcagcacggtgtccggattcttcagcttcctgctgaacctcatgacggtgatcatgaccacgttctacatttcggcggccggcccgaagctgcgccgcgcggcctgccagtggatggctccctccgcgcagcgccggttcctgttcgtctggaccgtcagccagacgcagatctcatcgttcctgttctcacgtgccatcctcgccgtgctcaacgcgttcttcacctcgatctgcctgatggcgttgcacgtgccgtattggatgccgttggcgttgttctgcggcgtcgtatcgcagttcatcccgatgctcggcacgtacatcggcggcgcgttgccggtgctgttcgcctggggcagctgtggtttgtggcaggcgatcgccgtggtggcgttcatctgcgtctaccagcagatcgaaaacctgatcttcgcgccgaagatctcccgccgcaccatggacgtcaacgatgcggtcgccttccttgccgtcctggccttcggctcgctgttcggcgcgatcggcgcgttcctggcgctgcctatcgtcgcctcgatccagacgatcgcccgcacctacaccaagcggtacgatctggtcgattcgccgctgatggacgatccggttccggacaagaagtcgaagctggtggaaggcgccgaagtcatcagcgagcacctgcacgccgtgccgcgcgccgtgcaggggtcgagcgcgcatgtgccgattcccgacgacgtgcgcttcctgcaggagcaggcgtacaatatcactcggtccgacgagaccggggatgccgacgaatcgcagaccgtcgccattccgaagcgcgtgttggacggggtcgatcgcaagccgctgcggggaaccgcggaagcggacggagcgcagacggaagccggaccgcaggtagcggacgggtcgcaatcgcagggaacggatgacaatccgagaagtaggtggcgttaatggtattgctgagcgtacttgatgtcgtgctggtggttttgggcggcgccggcatgctctaccaagcggtctgcatcgtcatctcgctgttcgccaagccgatcaagttccccgaagcgccgatgaacaaacggtacgcggtgctgatttccgcgcgaaacgaagcgaacgtcatcggcaacctcatcgactgtctgcattcgcaaacctatccgagcgagctcatcgacatctggctggtggccgacaactgcaccgacaacaccgccgaagtggcccgaaacatgggatgccacgtcatcgaacgattcaacaaggagcaggtcggcaaaggctacgcgctgacctatctgctcgaccagatgaacgagtcgggcgcatccgacccgtatgacgcctttttcgtgttcgatgccgacaacaaactcgacaagcactacatcgaggaaatgaacaagggcttccaagccggtttcaaaatcctcaccagctaccgcaattccgtgaacctgtccgacaattgggtgtcgtccggttccgcgttgtggttcatccgcgaatcgcgcttcgtttccgcctcccgcatgtggctcggcaacagctgccacgtgggcggcaccggcttcatgttctcccaggagatcatgcgtcgcaacaacggctggaaattccacctactcaccgaggatctggaattcaccatggacagcgtgctgcacggcgaccgcatcggctactgcggcaccgccatcctgtacgacgagcagccggtcaccttcgcgcaaagctggcgtcaacgcctgcgttggagcaagggcttcctgcaggtgttccgctattacggaccggcgttgatcaagcgcgcggtcagggaacgtgatttctccgccgtcgatttcacgctgctgctgtgcccgttcaccgtgctcggcatcgcacgcgtgctgttgggcatgctgttcgccgcctgcggtttcgtgacatggcaaagccagctgaattcgctgaccggctggacatccggcattgtgatatcggtgatcggcatgatgggactcgccgcattgaccatcgtggcggaacgcgatcacgtgggcgccaccaacaaggagctgctcgcctacgtgctggccttcccgatctacatgctgagctatgtgccgatttcgttccaggcggtgttcgccaagtccgaatggaagccgatcgagcataagggctgaggcttgcccgcggcggtgtgaacggtcatgagatgtttcgtggcgatccatacggtgcggatggtgaaaagatgacgaagagagggtgtggtttggctatggatgacgctggcgattaccgctatacgcgacgacgccgagcaatcacggtggcggtttccgtcgtggccaccgtcgcactgtgcgtcggctatgcagtggccgacatgtgcgatgtcgtaccgggcgtcctcacattgcgccatgtcgaacattcgacggccgccgctgccggccgttcgatcgaggcggccgacgtgatcgccgacatcgacgcttccaagaccatcgatccggccgctgcgcgcgcgctgaccgacgcgttccgagcctcagccgccggcttcggcggcgaattctccatcgccatcgccgacgcgtcgggcaacgtggtcgcggaaaacaacatcgacgtgccccgcacgccagcatccaccatgaaaacgttgacggcgtatgcggccgccgtcgaactcgacatgggcaagaccctggacacgcagacctatctggaacagtcccaggacggcaccgcgcggctggcgctcaaaggcaacggcgacatgctgttgggagccggagcgtccgacgcgaaccacatcaacggacgtgccggattgggcacgcttgccgggcggaccgcacaggcgttgcggcagcgtggcatcacctccgtgacattggcttatgacgacacactgttcggcaacgaccgctggccgcaaggcatcgccgaactcgacacggaccacctgtactacgccccgacagcttccatggccgtggacggcggcaggaattggaacgggacaggtccggccaatcctgatgtgttctcggcgtatccggcattgagcatgcagccggcgcgtgacgcggcgctggtgttccagcagcggctggccgaacagggcatcacggttcagggatttgtatcgcaaggcacggttgcgggggcatcccatccgcttgcctccgtgcgttcggcgtcgttgaacgagattatggcgttcaccatgcggcattccgacaattcgctcgccgaggaattcggcaggctgctggcgttgcaggtcggcgcggacaattcgccggctggcgcggtgcaggctgtaaaaagcgtgctggagcgcaaaggcatcactacgaccgggctcgacatgcgcaattgttcgggacttacggaggattcgaaactgacggcgcgcaccctgctcgaagtgcaactgcgcaatctggctgcgggatcgggggcggccgcagccgaaggaatgtccgtcatgggcttcgtcggcaccgctgagagccgtctgaacgatgctgacgaagcggggctgatccgtgtgaaaaccggcagtctgggcgacgtgacctccatgaccggcaatgtgtcgcggttgaacggcggagcgttgaccttcgcggtgatcgtcaacaatcccaccgatttcgcggcggcgaaggcggccatcgacacattcgtggccggtctgccgaagctgtgaacggccacgtgtgaatcttcccagcggatattcagcatatagccagaaacacgtcattcgcatgtgccaagatggtgggcatgcgaatcgctgacgtacaagaagacattgatcacgagctgatcagcaaagaagagatctccgacatcatcaaccgtgccgcggcacaagccagtgaagactatcgtggcaagaacccgctgctggtctgcgtgctcaagggagccgtgaacacgcttgcggcgttctcccaggccatgagcattccggtccaaatggatttcatgagcctgtcgagctacggttccggcacggagtcgagcggcaagatcacggttcgtcaggatctgtccacggatgtgcgaggacgccatgtgctgatcgttgaggacatcatcgattcgggcatcaccctggcttggctggtcgacgagctcaagcgccgtagagcggcttccgtggaaatttttgcgcttctggagaagccggcacgtcgcaaggtcaatgttgatgtgaaatacaagggacgtgagattcccgatgaattcgtggtcggtttcggcttggattacgacgagtactaccgcaacctcgattcgatcgcggtgctgaagccgtcagtctatgaaggaggtcaggcatgagtttccctggtccgaaccagccgccaagcaatggcggcggcaacaagcccaacgggggtagtaacccgttcaccaatccgtttagccgcaacgatgacggcaagaacggtggcagcggggcgaacggcaacaagtccaacggcccccgtccgttctggcagtcgccgtggctgtgggttgtggtcgtggcattgcttgccgtgaccatgttccagcttttcgccggtgcgggctcgcagaccatcgacaccaaggatggcatgcagatcctcaacggcaacaccgtcgagtatgcgacgatcgtggacaacacccagcaggtcaagctcaagctgtcgagcgattactccgccaccgacccggacaccggacgtacgaagaactacggcaagaacgtgcagttctactacacgtatgcgcagtccgcggccgtggtcaaggccgtgcagaaggccgatccggccaagggctggaccgcgtccatgcagcagaccagcatttggacctacctgctcacctcgctgttgccgttcctgatcatcttcggcctgttctggttcctgatgagccgtatgggcggtgccgccggcggcatgttcggcatgggcggcaagaagaacagcggcaaactgctcgacggccagaccccgaccaccaagttctccgacgtggccggcgaagacgctgccgtgcaggaggtcgaggaaatcaaggacttcctcaaggacccgtcccgttacaaggctttgggcgcccgcattccgcgcggcgtgctgctgtacggccctccaggcaccggtaagacgctgctggcgcgcgccatcgcaggcgaggccggcgtgccgttctactccatggccggctccgacttcgtggagatgttcgtgggccttggcgcctcccgtgtgcgtgacctgttcgatgaggccaagaagaacgctccggccatcatcttcatcgatgagattgacgctgtcggccgcaagcgtggcggttccggcatgagcggtggccacgacgaacgcgagcagacgctgaaccagctgctcgtcgagatggacggcttcggcaacgatacgaacctcatcatcatcgctgcgaccaaccgtccggatgtgctcgatccggcattgctgcgcccgggtcgtttcgaccgtcaggtggccgtcgaagcacctgatttggaaggccgcgaggcgattctgaaggtacacgccaagggcaagccgttcgtgccggacgtcgacctgcatatgatcgccgtgcgcacgccgggcttcaccggcgccgaccttgccaacgtgttgaacgaagccgcgttgctgtgcgcccgtgccggcgcccagctcatcgacaaccgcgccatcgacgaggccatcgaccgtgttcaggccggtccgaagcgtcgttccaagggcatggctctcgacgagctacgcaacaccgcatatcacgagggtggccatgcgctggtcgcggccgccatgaacgacaccgatccggtgaccaaggtgacgattctgccgcgcggccgtgcactgggctacaccgcggtcatgccaaccgaggaccgttactccatgtcccgcaaccagctgctcgatcagatggcgtacgccatgggcggccgtaccgccgaagaggtcgtgttccacgacccgaccaccggcgcgtccaacgatatcgagaaggccacgaacatcgcgcgtcagatggtgctcgactacggcttctccgagaagctgggcgccatcaagtggtccgacgacgagcaaagcgatctcggcgcgctcacccacaagtactccgcgcacaccgccgaaatcatcgacgaggaagtgctcaagcttgtggagaccgcgcataccgaagcatggaacgtcattaacgagaaccgcgacatcctcgacgagctggtacgtcagctgctcgtcaaggaaacgctcaacgagaaggagcttgccgccatcttcgccaacatcaagaaggcgccgaagcgcgaggtctggttgagcgacgagaagcgtcccgattccgacattccgccggtcccgattcccgacaagctgaagaaaagcgcaggattgaccaactgatgagcgataccgatttcgataccctcctcgacgacaaggcccgtgccgctcatgcggccgggcctgtcggctatgacgaggaaggcgtgcgccaggccgtgcgcctgttcttgaagtccatcggcgaggatccggaccgtgaaggtctgctggacacgccggaccgtatcgggcgcgcgtgcaaggagctgttcgccggcctcggacacgggccggaggaagtgctgaaaacccgtttcaaggtggacaccgacgaaatggtgctggtgcgcgacattgagctgttctccgtctgcgagcatcatctgctgccgttccatggcgtggcccacgtcggctacatcccgcagaacggccaagtggcgggcttaagcaaactggcacggttggtggaactgtacgcacgccgtccgcaggtgcaggagcggcttacccagcaggtggccgacgcgttgatggaaggcatcgacgcgcgtggcgtgatcgtggtcaccgaatgcgaccacatgtgcatggccatgcgtggcgtcaagaaggcgcagtcccgtaccgtcacctcggcggtgcgaggatgcatgcgcgacgcggccacgcggaccgaggcgatgagcctgattctgtcgaaccattcgtaagtgcgctttaccgggcggaatcggacagaaccgaacggaagaacggaatgaatgaaggaagaaaaccgatggcgattgatatgaaggcgattcatgatagccagcgcacgttggtgatgggcgtgctcaacatcacggaggattccttctccgacggcggcctctggcttgctccggaggcggccaaagcccatggcgaggcgatgatgaaagccggtgccgacatcatcgacatcggagcggaatccacccgtccgggagccaaacgcgtcagcgaagccgacgagaaggcccgtgtgctgggcgctgtggacgcgctgattcccgaaggggcggtgctgtccatcgacaccacgcgcgcttcggtggcgttggccgcgctcgaacatggcgcgcagatcatcaacgacgtgtccggcggccagttggaccgcgaactgccgcatgtggtggccgaccattccgactgcctgtacatcgtgcagcattggcgtggctggcttgccggcgccgcaggcaatgtgccggacgccgacacctcccgctacgagcatggcgtggtgaatgacgtgtatgacgagctgatgcgtcaggtggatgcggtgcttgaagccggggtgcaggccgaacaggtcatcatcgacccgggcctgggcttctccaagccgggcgtggagcataacctgccgattctggcggcgcttgaccggttcaacgcgactggctatccggtgctgatcggcgcgtcccgcaaacgtttcgtcggctcgctgcttgccggcgccggtgtgaccgagccggacatggcctcaaaagacaacgccaccgcggccatcagcgccctgtgcgcggaacatggcgtgtgggccgtgcgcgtgcatgacgtggcgaaaagccgcgacgcggtcgccgtcggcaacgcatggcgcgagtatgcgaacgcgtgaccgtgcgaatcgcagatagtcacaacatcgcaatcgcggaaataataggaatacggaacgtaggaacggcaaaggaaggctggtatggatcagattcgactgacgggaatccgcgcgacgggcaaacatggcgtgctcgacttcgagcatgagcgggcccagaccttcgtggtggacgccacgctgttcctcgacctcgctgccgccggccgttccgacgatctgaacgacaccgtcgactatggtgcgatcgccaaaggcatcgtggccatcatcgaaggcgaacacgtcgatttgattgaaaagctggccaatcgtatcgtcggcatgattctcggctttccggccgtgtgccgcacgcaggtcaccgtgcataagccgaatgcgccgatcaccgtgccgttcgacgatgtcagcgtgaccgtggaacgttcccgtgaaacagttgacagtccatcgcgtgagcggtcgtcggaacatgggcaggtgcatcatgccatcatcgccatgggaggcaatcagggcgatgtgaccgccaccttgcgtgacgccgttcggtgcattgatgggcttccctccacgcaggtgacgggggtgtcgccgctctatcggaccgacgcatggggcatgccggaaggtactgcggaattccgcaatgcggtcgtgtccgtggataccaggctttcggccgccgaactgctggccggtttgcagcgcatcgaagcctcacatggtcgcgtgcgcaccgaccattggacgtcgcgcacgctcgatttggacatcatcgactttgacgggcaggaaagcgccgaccccgacctgacgttgccgcatccgcgcgcatggcagcgggctttcgtattggggccgtggcttgcgcttgaaccggacgcagaactcgggggagcgcacgccggttccgtggcgcaactgctgcacgaaacgtccgaccgcgaccatatcgatgagatcgcggacgattggatggttgccggagctcaggatcccatagttcgcgattccgacattgggacgtctgcagatgacgttgatgcgattgacgatgccgattctgttgaatccattgattccattgaacttccggaaggtacggcggcctccaaagcagccgctgcggccgcggcgaaaccgggaccggcatcccgtcgagcggtcatttccctggatagcgtttcaactgatgcggaacaccagttccgtcaggcaatcgtggccatcgacgcgcttcccggcaaccaggtggaaggtatttcgccgctgtaccatgtcagccaggtcgacgactatccggacaaaatggccgccgtcatgcagatttccacgcgcatggacgcgcgtgagcttatcggtgcgttggaatcggtgtcatcctccatttcggatgacctcgacctcgaccttgtggacatggaaggcgtggtccgcaacgaacctgattgcatggtgccgtggccgtccgcacgtgagcatgcggccgtgctcgccccatggttcgacatggatccggacgcgaaactcggcagggatccggtcgcgttcctgctggcgatggctccggacgccgcgcaagtgggcatgctgaccgacaattggattatcggagacacgctatgagggcacgcagaaccccttggtggtcattcgtccttgcggccgcacttggcgtgctggccggcatgggattggcgaaatacggcgagatttcaggcctgccgttggttggcgcaccctggatcgtgccggtggtgctggccgtgttgggtggtgtggtgctgtacatggctctgcagattcataaatacacgaccaaagatcccgtcaaacgcgcgcagctcaagccattggacccgcagaaggcgttcggcacgctggtggcctgcaaagcgctcggacttgcgggcgcggcgttggccggctggtacggtgggcagatcatcatgagtctgccgcatggtgaggcggaattctatagccaagccatcatcgaatgcgtggtggcctgcgtggtatgcgtcgccgacatgatcgtcggcatcgtgggggagtggctgtgccgcatcccgcctatcgacgggccggaaagtccggccgtgaaaaaggccgcacagcgcaatcgctatgcggccgccgccacgaaggcgtctacaaaatcggctacgaatcctgccacgaaatcgaaagtctgaacgtcagaccttctttaactccgtctcagtccttcttcggcacgcggaacatcgcttcctgcgccatgcaggccaccagctcgccatcctgtgtgtagaccttcgcttggcccaagccgcgtccgtgcgccgcggtcggcgtgtcttgcacgtacagatgccactggttgatgtcgatgtcgcggtaccaccacatcgaatggtcgatggacgcatacgaaatgcccggcgtggcgatgcttaagccagcacggcgcagaatcggctccagcatgatctggtcgcagcccatcgccagcatcgcacgatgcatgacctgcggcacgtccaccttgccgtcggccttcatccacaccatctgcttgccggaatcctcgctggcgctcttcttgtcggcgccaagcatgatggtgcgcgtcacatggcgaatatcgaacggcgacttctccgcataatacttggcgaacggcgactgttccgcatacggctccatcagttgcttcgcactggtcaggctgtcgggatcgggaatgttctcaggcatcgggtcggcgaattcgatgccttcctggtcatgttcctggaagctggcgattgccgtcaaaatcgagccctgcgcctgcgtgacattcacgcgacgggcggagaaggaacgtccgtcacgcagattttccacgtcgaacagcagatcctgacggatatcgccggccgaaatgaaatagccgtggatggaattcggcagacgggatggagcgacggttctcgacgcggccatcagcgactgcgcgatgacctgtccgccgtagactcggccagtggggaagtacaggctttcgccgttgatatacgtatggttgcgatagtttgagggcgtgcccagctggagcacctttgccagtcgctgcagcggcgtcatgtctgtctgcgtcatgatggcctcgattccttccgcgtgtggatagctctttatgctggcatcgagtctatccatacgtagtaaatttcgtcggattgttttgtaacgagtacgtgagaagaatgaacggttggttagcaacaaacggttgacgtatggcaaagcgccaccgctcgtaatgaagggtggcgctttgctgaaatctgcgcttaacgcgactcgattggatctgtctgcctttagcgggtcagcttgcggtgcaggcggtgcgggcgggccgcatcctcgccgagacgggcgatgcggttctcctgataggcctggaagttgccttcgaaccagtaccagttggccggattctcgtcggtgccctcccatgcgaggatgtgcgtggccacacggtcgaggaaccaacggtcgtgggagatcaccacggcgcagcccgggaaggcgagcagcgcgttttcgagggattccagggtttcgacgtcaaggtcgttggtcggttcgtcgagcagcagcaggttgccgccctgcttcagggtcagtgccaggttcagacggttgcgttcgccgccggacagcacgcccaccagcttctgctggtcggaacccttgaagccgaaggacgccacgtaggcgcgggtcggcacttccactccggccacctcgatgaagtcgagtccgtcggacacggcctcccacaggttcttgttcgggtcaaggccggcacggttctggtcgacgtagctgatcttcacggtgtcgccgatcttgagcgaaccggaggtcaacggctccaagccgacgatggtcttgaacagggtggacttgcctacgccgttcgggccgatcacgccgacgatgccgttacgcggcagggtgaagctcaagtcgtcgatgagcacgcggtcgccgaacgccttgtggatatgctcggcttccagcacggtggaacccagacgcgggccggccggaatctggatttcggagaagtcgagcttcttgttgttgcgtgcctcctgctccatctggtcgtaacgttccagacgggccttgttcttggcctgacgggccttcggcgaggaacgcacccagtcgagctcgctcttcaggcgcttggcgagcttggcgtccttggcgccctggatctccatacgcttggccttggtctccaggtaggtggagtagttgcccttgtatggatacaggtggccgcgatccacttcgcagatccattcggccacattgtccatgaagtaacgatcgtgggtgacggcgatgacggcgcctttgtactggtgcaggaactgctccagccacaggatcgattcggcgtccaaatggttggtgggctcgtcgagcagcagcaggtccggagcctcaagcagcagcttgcacagtgccacacgacggcgctcgccaccggagcacacgctcaccggcgtatccggatccgggcactgcagagcgtccatggcctgctcgagctgggagtcgagatcccaaccgttggccgcgtcgatatcgttctgcagtttgcccatttcttccatcagcgcgtcgaaatcggcgtccggattggccatttcctcgccaatctggttgaaacgcgtcactttttcggcgatcgggccgaatgccatcttgatgttctcgccgacggtcttggtgtcatccagcggcggttcctgctgtagaatgccgacggtgaaaccaggggtcaggtaggcttcgccgttggaaacggtgtcgaggccggccataatcttcagcagcgtggacttacccatgccgttcgggccgacgacgccgatcttcgcgcccggcaggaagctcagggtcacatcgtcaagaatcactcggtcgccgtaagccttgcgggccttgatcatctggtaaataaactcagccaatgttgtgttccatccttaagaaacgttggaattccagcgttttgcgtatgtcggtcgacggaaaatcgcacttgttcgccgtgctgtggcgcgttgccggcgcgactggttgcggacgaatcgcaagtctgctgcgaactcatcgaagccaagtgttttcggaccgtgtccatacgcaaagtaccatcgccgattatcccatatcccgtctacacagcggtcgtgggtcggttgtgtgggaatggaagcgtgcctccgtacgtggttggtggtgatggtggcctgctgcggcggtctccgagcctgggtgtctccgtgtgcctctgtgcgcgcgatggcaccgagttgagatgtcgccggagagaggggagtcccggtgttgtccccgtaggtgcggtggcggtgattttgcgcggtgaaatcgggttttcgcgtacggggtatgtttcgaccgtttgagggcgaaatcgtacctccgtacgtgactttgttgatgattcttcctgttttcccgtgcttttcgagtacggggtggtgggttggctgttttcggcgggcggctattgattggtgggcggcaggccggcgatcaaatgatcacgccatcgcagtggtcgatctcgtgttggatgatctgcgcggtgaaaccggtgaacgctgcgtggcgctcgcggaatttccgatccatataatccacttcgatgcgctggtatcggacggtgcggcgctcgccctggagcgagaggcaaccttccgccgtatcgaacgcgccgtcttcggcggtgatgtgtggattgaacatcacgaaaatgcggccgccgaaatcctcatccacaaaagcgatgatgcgcttgggaacgccgatcatattggccgccatgcccacgcaaccattgcgatgcgcgtccaacgtgtctttcaggtcctgtgccacggccagatcctcttcggtgttctcggctgcggcggacggctggctcaaaaatgggatggacgtcataatctcacgttgcatgtgattcctctcgttggatgttgccggtctgccaatattgtagcgtcgcatggctgcgagacggacggctgggcgaacctgtccattccctgaccgttcgcgtcggcttcgggatgtgaggtgcaacgtgtgcggcttggactggtgcaatatgcttggggtcatggaagacatgttgcaataccgcgaatctatggcgcaggctcttgaactggcccgcaagggtgcgggatgggtggacccgaatccgctggtaggcgcggtggtggtacgtgatggcgaggttctcgccaccggataccatgaccggtatcgtggcccgcatgcggagcgtatggcgttcgactatgccgacgcgcacggcatcgatctgactggcgccacggtcatcgacacgcttgaaccctgctgccatgtcggatcgcagccggcgtgcactgccttgattctggcgcacggcatcgcacgcgtggtggtcggatcggttgacccgaacccgattgtagcgggcaaaggccttcgcatccttgaggaagcgggcgtcgaagtggttcgcgacgtgatgcgggaggaatgcgacgccatcaatcgccatttcttccactacatcaccacgggaaagccgtacattgtggacggcagaaggcgtgcgggtgaatcggactctgagtatgcggtccgtcggcgcgaactatatgccacatatgcggcggtgcttgccggaactgaatcggacgttcctgacgagtctttcgcgcatttcaacggaccggtccaagccgtcggcgcagacgaagtggtgattggcggccacaggccgttactcctggaggccggcgcgctcgcctgcacggatccagacgaatggctgagtgagctgggcaagcgcaaaatcgacagcctcatcgtggaaagcgacgaagcattcgagcggttgtccatggctttgccaaaaagactgaagcgccattcgtgcgttgttggccgtgtatctcgcttatagatggcggattcgtctgcttgtccagtgctatctcgcttataggtggcggatgaattttgcgaagaggtcttaaagggtgtaaatcataccctctaagaccttaatgacgtagaggcgccgccatctataagcgaaatagcatcgggcggctttccgattccgccatctataagcgagatacgtgagactgatatgtccagcacccagcaagcatagtggcgagcacatggtcgggcatggcgcgcatggcctcaggggactcaagctcactcggatcgcaatccagcagcactaggtctgccgcatctccagcttgcaacgtcgtacgccccagggcggtggacgaagcgagagcggtttcgaaatccagacattgctcagactggaaaggctctcgatcggaactctccgtgccgaacaccgctgcggaaatggccagccacggatccaacggcgcgaccggcgcgtccgagcccataagcagtttggttccagacttgtgcaaactgttgaacgcgtagggaattccggcgggattgccccagaatcgtgtgatgacgtcacggtcgtccatggcgtgctgtggctggatgctcgcggcaagtcccaattgcgcaagacgtggaatgtcgcgttccttgagcatttgggcatgctcgatggagccgtgcgcgtgggtacgttccgcgcagtcgagcacgatggtgttcgcttcgtcgccgatggcatgacaggcgatgtcgaagccatgttcggtggcgagccgcatatacgattcgatttgctcgggggtgtagctcagcgtgccgtaggtttccggcgtaatgcccgaatacggtgtggagcagtaggcggatcgggtgttgagcgagccgtcggaaatcatcttcatcgcaccgacatggcccaagccatggcttccgggaagttcgtcgccggtatgccagccgtcgtcgatggcttgctgaagtcgttcggggtaaacgccggcttcgatgcgcaatccgtcaagcccctgcttgaagcggtcaatccacgtgtcgatgttctcggccatctcatagtcgcgcacgccgaccacgcctttgccggcggcgtcctgttccgcgttgcgcagcaatcgcatcagctcgtcagccgcaccggggcctttgtccagcttgcagtaagcgtcgaaccattcaagctcgccgacgagtcccgactcgcctacatgcacgccgagcttacgagccgcggctgaattcacccagccgcaatgcatgtctgcgcttgacagcgccacgggctggtcgcccgacaccgcgtcgatcgcagccaatgtcggttgggcatcatcggcccacagggagtgtctgaaccgcatgccgaccacgtactggtccgggtcgagcgtgccggattcgcggcgttcctccaagtgctcgcgtagcagactcattgcctcatcggcgctgcgggcatcaatcagatcaagccgccccagcgtgtacgaccactgcgtgaagtgcgtgtgacaatcccacaagccgggaatgatccacgtttttgaagccttggctaccgacttttccgaagaccgtacatccgcgatccgcccttgctcaatcgtgatgtcgacagactcatcggaccccacgaaacacacattctcaatcacatacggttcgcccatacatcctcgattcaacaaaatgacctcattgccagccatagtatctttgcaatgcttgcgattgccgcgctcgtctcaatcggctatgcgcactttgaattcctccgctgggatacggttatccgcatcagaaaaggaagggcgcagttatccacttatccactgtttgccggaagccggtaggcagcgcggcgacatttcctctactttggcgctatggacaatggagcacaatattcggaaagcctcgcacggctgaggacaagaaccatcgaacaatgtctcgaagcgcagaggcgcaccggaaggcggctggtgttcgcgcttgataccgcactgagtttacaaggcatcgaactgcctcgctaccggcgcggagggcttttggctgatacgctgcacgcggtgattgaaagtaacggcgtgcgaacgatactgcagggaatttgttttgtgctttggtctggacctcagacgcatatgccgattcatcatggtcgattgcgatgcacggattccgtgaccacatgggccatgcatgccaatcggcttgaagatgaagaattggtggttttgggtgattcgatgatgcggcgtgatggacatatgaaaaaggccacactggaggagtttcggatatatgtcgatagcttgtccgatttgtccaactattcaggctccgacagattacgtgcggtgagaggagtgtcgaaaatgcgtagggctctcaggctgatgcgggagaatacagattcttcccaggaaacgagaagtcgaattgttctgttgtgttatggtttgccttgtccggaagtgaactatgccattcggctcaaaggctattctcatgtatttttcgcggacatggcttatccggatttgaaaatcatcattgaatacgacggcaggcatcatgcctcgcgatggttggctgacagtaaacgtcgggaagcgttggaggatgaaggatggctgtatatccaggtgacggcggaaaatctcagggatgaggattctcaaagggaattggcggaacgtgtggcgcagaggatgtcattgcgtttgggggagcctgtgcggctatgtgggcgaatgacgattgctcagatagccgatggtcggaggaagggcaaccgtctgtaaggcttgggcaagcccatatctcgcttatgaatggcggaatcgggctgcggcatgatgctatttcgcttatagatggcggatgaaatccacaaaaaggccttaagaggtatgaatattaccccctagggccttagcgattcaagaagactgccatctataagcgaaatagcatcggtcgggtgaagaaatccgccatccataagcgagatggcggatttctgcggctcactgcacggcggcgagggcttggtcgaggtcggcgatgatgtcggccgtgttttcgatgccgcagctcaggcgcaccaggtcgatgccgacgccggcttcctcaagctgctcctcggtgagctggcgatgcgtggtgccggccggatacagcgtgcagctgcgcgcatcggccacatgcgtggcgatggacaccatcttcagatggtcgaggaacgcggagaccttctcgcggccgcccggcacgccgaaggagatcacaccgcaggtgccgttcggcatgtacttctccgccagcgcatggtacttgtccgtttcgaggcccgggaagctcacccagctgacgcgcggatcggcgtcgagccacttggccacggccagtgcgttcgcgcagtggcgctccatgcgcacgccgagggattccagatgcatgcccatgatccacgaattgattggcgccggagtggagccgaagtcgcgcatgagctgcgcggtggccttggtgatgtatgcggccttgccgaattccttcgcgtaggtgacgccatggtaggagtcgtccggagtggtgaggcccgggaatttctccgcatgggccatccagtcgaaattgccggaatcgacgatcgcgccgcccacgcaggatccgtggccgtccatgtacttggtggtggcgtgcgtgacgatgtccacgccgtactggaacggacggcagttgatcggcgtcgggaaggtgttgtcgacgatcagtggcacgccgtgacgatgcgctgcgttcgcgaacttctcgaagtcgagcacgataagcgccggattggagatggactcgccgaacacggccttggtgttcggctggaacgcggcctcaagttcctcttcggtgcagtccgggctgacgaaggtacattcgacgcccatcttgcgcatggtcacgttgatgaggttgaacgtgccgccgtagatggcggaggaggcgacgatgtggtcgccgttgttgcagatgttgaacagcgcgaagaagttcgccgcctggccggacgaggtgagcatcgcggccgcgccgccttccagctcgcagatcttcgcggcgacggtgtcgttggtcggattctgcaggcgggtgtagaagtagccggattcggacaggtcgaacagtcggctcatctgttcgctcgactggtatttgaaggtcgtggcctggatgattgggggagtgcgggattctccattgcccggctgatagcctccctgcacgcagatggtgtcgacgttttcgctcatatgttccttctttcgattccgcgcttccgtgtgccgcgcaggtgttgcgccgcgatgcgaacaaacaaacacactgtatcactgcattgataaatggcttgattccaatggaaacgccgtatagtttaacgaattgacaaacttaggtaattcaatttattatgtagaccaagacgggcggaaagcccgctgcgaaataaagctttacgtaagtaaaccaagcaaaggagcattccatgggtctgtgggatatcgataagattccgtacgtcggtcgcgaaaaggggccgcaggagggtcttgctttccattactacgatgccgacaaggtcgttgccggcaagaagatgaaggactggctgcgtttcggcgtcgcatggtggcacaccttcgaccagcagctcgtcgatccgttcggcaccggcaccgcccagcgtccgtggtacggcaagtattccgatccggaggacgaggccctggccaaggtcgactacgccttcgagttcttccagaagctcggcgtcgagtacttctgcttccatgatcgcgacatcgctccggaaggcgacaccctgcgcgagaccgacaagaacctggacaaggtcgtcgacaagatcgaagagaacatgaagtccaccggcatcaagctgctgtggaacacctcctccctgttcaccaacccgcgcttcgtctccggcgcctccacctccccgttcgccgacatctacgcgtacgccggcggccagctgaagcactccctggagatcgccaagcgccttggtgccgagaactacgtgttctggggcggccgtgaaggctacgagaacctgtggaacacccagatgaagcgcgagcaggagcacatggccaagttcttccacatgtgccatgactacgcgaaggaaatcggcctggacgcccagttcctgatcgagccgaaggccaaggaaccgacgatgttccagtacgacttcgatgccgccaccgccatcaacttcctgcgcacctatgatctgatggacgtcttcaagctgaacctggaaggcaaccacgccaacctggccggccacacctaccagcacgagatccgcaccgcccgcgaggccggcgtgctcggctccttggacgccaaccagggcgacaagctcatcggctgggatatggatgagttcccgaccgacctgtacgagacctccaccgttatgtgggaagtcctcgccgaaggccagatcggccctcacggtggtctgaacttcgacgccaagccgcgtcgtacctccttcaccgccgaggatctgttccgttcccacatcgcaggcatggattccttcgcagcaggcctcctggtcgccgccaagatgcacgaggacaaggtcatcgagaacctgcaggccgagcgctacagctccttcgattccggcatcggcgcaaccgtcgagaacggcaccgcctccctggcttccctcgaggagtacgctctggatatcccgcagtccaagctcatcgaagccaccaagtccgatcacctcgagtccgtcaaggccacgatcaacaactacatgatcgacgccctggccgaggcgtgagccgaaaactcactagggttttaggtagcctcgggcgaagtccgagacggtagtcgagggcgagcaatgactgggcgcgcgtagcgttccggaattgcaggaccgaggcatgggcgcagtaaggagtttccgttaggactcctgattcatcgctggatcaaacagtggggctcgactgtgacagagccggatgtggtgtgccgaagcgtcggtgttccggcacaccactcacttttctttccttcctccttcctcaaatttccttcgcacgcaagtcgtttgccggctagatcgccggtgagcggcttgcgtgcgttgttagaccaagcgaaaatttcgattattcgcaatgatgtgatgtatccaaacgttcccgaatgaggcgtacttatgaccacaacgattaccatcgccaatcccattcttcacggaatgcatcctgatccgagttggatttgggatgatgatcttcggcaaatcgtgcttgtgacctccaccttcgaactggttccaggcttgcctatttacgtttccagggatatggcccactggaaacacgtgtcggatgccatagatgaggagttggcaagacgtttgctcattcctttcgtggatgactcgggtggcgtctatgcgccgacgctgcgtaggattcgtggcaaatacgtgattgcctgcaccatcgctcgcatcaatggacgcaaagccatcgcggaaggatgctcccaggccgaattggatgcggcccaggcggcggaaggcaacttcgttcttgagtcggactcgatcgacggaccttggcgtgggccgttctggatcgagggcgccgaaggcatcgatccagacatattcgaggacggggacggcaatgtgtactggacccagacccgtcctgcggtcaatccgcaatgggaaggccagaccgaggtctggacccaacgcattaatccggagacttggacttttgtcgatgacggtcttcctgcgggatcgggcaagacggtaatatggcgcggatacggtatggaatcggtgtgggctgaggcgccgcatctctatcgcgtgggtgattatgtgtatctgatgaccgctgaggggggcaccagtttcgaacatagcgaaatggccatgcgcatctatgcaccgcatggactgcttcgggcgttcgaagcttacgaacgggaagcatccgaatcgggtgagtgcattccgcaggttcgtgacggggaacgctgctatcttggcaccgcaatccgtgccttccacgcggataagaagaatccgattctcacccaccgacatctgggtttgtcggaaccgctgcaatgcgtgggacatgcggacctgttgcttcatccggaactgggatggtggctggtgtgtctcggcgtgagggagacgcggggaaagcatgacggcgaattattgagctacttgggaagggagagctttgtcgctccggtatcctgggaacataatccggccgattggaagctggacggcaacggtgcattagatacgcatgagggtgaccccggatggccagtgacgtgcgctggtcttggccgcttggccgacgagatcacggttactactgaagacgatggcatcaccatcgagcctagggtgaaatcctcgctcgccggtgacgtggaacctgcgctggtggatgtggctgatggctcgacgaacgatgtggtggtgcgcgacgagcgtgatgtcagctaccgcagaatagcgaaactgccgacgctcatgccgattcccatgtccggttctttagtgattcggcagaattccacgcattacgcggtgttttcgatgcatggcacggatgtgcgctacgagatggtgaatggagacgattcgcaagctgggtctgttgccgtacaggctgacggagtgcgtccggcggtacttttcgacgacaaccgcttgtcggtcatcgtaactggcatgcatggtccggttgattctgcgacgttcgtgcgtcaggggcaggtcctgctgagtgtcgatgcccgtttcctcagcaccgaatgggctggtgggttcgtcggttgcatggccggcttcatggcatagattctacggaatttcaggatggttcactgctggtgttccgacgggccgtcttagaacgaggtgaaaacgggtcgaaaggctaggagcgctgtgttctcccttacggttgtgcctgtgaggtttgccccgctgattaaccctcgagttgctgtgtgctgttgcgtaccactagcgatgtcggcatgatgatgtgcggttggatcacgtcgtcggtggacagcgcctcgaccagcatgcgtacggcggcccttgccatgtcttggagcggctgccgtacggtggtcagcgccgggccaaggaatgcggcagtctgcacatcgtcgaatccgaccacggataaatcctccggaatacgtaatcccagctgtcttgccgcctcgtagacgcccatggcctgcagatcgctgccggcgaagattgcggtcggacgatttggtcgtttcaacagggagatggactgtgcgtaaccgccggaagtggtgaaatcgccttcggtgataagttcgggatcggtttcgattccatgttccgcaagcgctgatgtatatccgtccagacgtgctttggaacacatcatttcctccggtccggtgatgatgcctatgcgggtatgtccgagtgcgagcagatgcctggtggcgattacgcctccggtccagttgtccgcttgcaccgacagcgtgtctggatctggattaccgaatggatcgaacaagacgaagggaatacctctggaatgcagtttgttccgttcgatacgtgtcagactggagaagacaagaatggcgccatctgtctgccgacgcagcatgttgtcaatccaggatgagtccgggtgctggcgattgccgccttcggtggtgatgacgttcaaatcatgcaacttggcttcgcgaatggcgccacggagtacttcaagggcccaaacattatcgaaatcttggaacacgatttcgataattcgttggcttttcgcgcctgtcgctttacgggaatacccataccgtttcaacaccgcgttgatggtttgccgcgtctcttcggaaacgtcggctctgccgttgagcgccttggatacggtggaaagggaataaccggtctctttagctatgtcagagagtcgtaccgtagctttctttgtcgtattgcgcatgagtcactccttcttcatgctcatcatatccgaaaacgcgaacgaaagtttcggtttgcgtttttcgaaactttcgatatgttggcaatacttaaaaacgttgtaaaatcaacgaaaaataattagttttctgattttacaaaaaacttgactttgtgtgatttgtttcggtagtctataggtacaacgaaaacgaaatggaaattttcgaagggagtcaaaggctgattctctgtctgccaggggagctgcagcagcattcgttgcggtcatgcttcccgattcgacccattcgagagaaattcctgtcgttgccatcattttgtcgatgatgatttggtcaataaggagaagacaatgaagttcagaaccattgcagctgccactcttgcggtggcgaccatgttgggcatgggtgcctgcggctccagcactggtgctaaagacgataagaccattacgttctggcataacgcaacagctggtgacggcaagcagtattgggaggatatggccaaagcgttcgagaagaagactggtgtcaaggttcagattcaggccatccaaaacgaggatttcgaaggcaagctgaccaccgctatgcaggatcccgcctccggcccggatgtgtacatgacccttggtggagccaagaccaaggacatgattgacgccggacagaccatggacctcactgataagatcagtgacaccgtcaagaagcagatgtcttctgcgctggagtccatgtcctatgacggcaaggtctatggtgttccagtcactgtgcagcctggtggcatctggtattccaaggatctgttcaagcaggctggcatcgatgccgcgccgaccaccttcagcgagctgaagaccgatgtgcagaagcttcgcagcgctggcatcgatccgatcgcactcggcggcaaggatgcttggccggtcggtcactggtactactggttgtccatgcgcgaatgctctccgaaggcctacgccaagggcgtcaatgacaaggacttctccgactcctgctggaccaaggccggagatgatctgaaggatttgttggatgcgaatgcttttaacgaaggattcctcaccacgacggcccagcagggcgccagctcgtccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctttgatgggcgctgtgaccggtttcgctgtcaatcccgaggctccggacgctgctgttgatttcgtcaatttcatggctgagaaatcaaatcaggagaaatacgccactgcgttcagcaccattccggcttccgccgaagcttacgatgcggttaccgatgaaaatcttaaagccatcatcgaagctatgaaaaagtccgatggcatgcagctgtggatggataccgctctcggcggaaatattggcaacgctcttaattccggagtggtgaatctgctttccggacaggggacttcggctgacatcgtcaaggcgatgaaggacgcagcggccaagggctgacagtgaacatggctggttgaaggccaaaggagggtggatagacagattttcatctgccctccttcctattcgagaaacgtatctggtagtggagaaaaccatgtcaagtacaagcaaagacgcggtgacgctgcgcgctaagcggtccaagaaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggttacggacttccctccaagacaggtaaattcgttggtctccagaactacatcacagcgcttaaggatcccgcgttccaggcggcaattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctgcagaagaagggcgccatcaatgagattctggccaacttcggcatcaatggtcccgattggctggccgacccgaagatcgctatttggacgctgctgttgctgatcagctggaaatacgtcggtttcgccgtaattctgatgctcgccggcatgcaatccattcccgaggaactgtatgaagcagccaaggtggatggggcgagtttctggcagatgcagaaaagcatcacgttgccgttgcttgctccgacgttgcggatctgggtgttcctttccatgattggctctctgcagcttttcgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgaacagaaagaagccgagaagcgtgccaggaagcgcgcaaaagaagtgcagcatcgtgaggttgctgccctggcaagtgaggtgaagtgatgactgccgcaacaatcgcaggacattccaacaaaagcgagtacagcaagaagaatggttaccgtaagtcatccaagacgccatggggcaacccaatcgtctacttcttctccctggtgcttgtggccatctgcatcactccggtgttgtacattatcttcggcggtttccgtaccaattcgcagatcaccaaccatccgtccgggatgccgaacccatgggtccccgacaactacaagacggtcttcgaaagtgatattttctggacggaactgaagaattctaccatcgtgggtatcgccaccatggtaggtgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcatcatcttggtgccgttcctacagtcgattcctaatgagcttgaggaggcctgtcttctcgatggatgctcccgccttggcttcttctggcgcatggtcattccgctgtccatgcctggcgtggccaccactggaatcctcaccttcgtgggaagctggaatgcctacatgctgccgctgttcgtgctcagtgatgccaacaagtacacattgccacttggcgtacagatgttcagctccgaacactccgttgacaccgcacaggtgttggccttcacctctctggctatgattccggccctgatctgtttcaccatcttccagaagaagatcgtcggcggcctgacaggtgcggtcaagggctgacgaaatgtgacaatccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccactttcgaatggttcccaggcgttcgcctgcatgagtccaaggacctggtgcattggaacattcttccaagcccgttgagccggtccagccagcttgatatgagaggaaacccctcttcgggaggcatctgggctcctgacctaagctatgcggataacaaattctggttgatctacactgatgtcaaggtggtcaatggtgcattcaaggattgcactaattatttggtcaccgccgaggacatccacgggccatggagcgagccggttcgcatcaacggggtcggttttgacgccagcctgttccatgacgacgacggccgcaaatacttggtgcagcagacatgggatttccgtgaataccaccaccagttcgacggcatcacgttgacggaattcgacgtcgacaccatgaagctcaagccagaaacggcccgcaccatctgggatggcacttcggtgaagatcaccgaaggtccccacctatacaagaaggatggttggtactacctgtttgccgcagaaggcggcacggtgtatgaacatcaggaatctgtggcgcgttcccgtacccttgacgaatactccttcgaagttatgccgaatggcccgttcatcggtaacttcgacactcctgacacctatttgcagaagcagggccatggagcgttggtggacaccccgtccggcgagtggtattacgcctccctatgcggtcgtccgtggcgtcatgataccgaaccggcccatggcacccgcggatggtgcacactcggacgcgagacctccatccagaaagtcgaatgggatgaggacggttggccgcgcgtggtcggaggtcacggcggacagcgttacgttgatgctccgaaagatgccatcgagactttggccccaacaacgcgtgacgaacatgatgagttcgattccggcgagctcggtccgaattggaacactctacgcgtcccgttcaccgacgccatgggcacggtgggcggtggcaaactggcattgcgtggtcagggctcgctgtgcaacctgtttgacttgtctcttgtggctcgtcgctggcaggcatttgatttcgacgccgaaaccaaggtgcgtttcgatccgaagaattacatgcagatggcaggcctgaccaactattacgatgacctgtgctggtcatgggcgtttgtcacttgggatgagaaacgacatgcaagggtcatcgaagtggctcagaacgatttcaaccaatatacgtcgttcctcaaggatgacgccatcgtagtgcccgaagacgccgaagcggtatggctgcgcaccaaggtccgcacggaatactattcctacgaatattccttcgacggagaacatttcaccgagattccggtcaagctcgatgcgaagatcctgtccgacgattacgtgaaccaacgttacggcggcttcttcacaggcgcgttcgtgggacttgcctgcgtcgatctgtccggctacggcgcgcaggccgaattcgactacttcgactatcgggagctttccgataaccagtagacagtgccggctggcgacagagcgtccgtcgtcagccggcatactcgacggcattgaaatctatgggcaatgaggagcggacgagcatggtcttgcgattgccgaaactgcttgacgacggttgcgtgctgcaggccggtgcgaccatacatatctggggcaccggcgaccctggacgcggcgtgctggtacgcctcgatggcaaggaccggactacacgggtgggggacgacggctcatggagcgtgtcgtacggtccgatcacagcaggcggaccgtacgatttgacggtgcgttatgaggacggaaccgaatgcatctcgcgccaatgctatgcgggagaagtgttcctgtgttcgggacagtcgaacatggaactgcccatggcttgggtgcgtgcggactatccgttggagtgggatcgtgagcctgacccattgctgcggcaatacaaagcgattcccgattgcgacttcaacggtccccgcagcgatcatgaccatgcattctggcaggggtgcgatgcggaaacccttggggatttctccgcgctcgcctatttcttcggacgcaggatccgtcggtggctgaatgtgcccgtcggcctgttgaacgtttcattgggcggatcgccgattgaatcctggatggatgccgacgcattgcgggcgttccccgaagcgctcgctgaccttgagccgtatcttggcgatggcgtggcgtcgaagaaaagccgcgattccgttgccgaacgggaccggtggtatcaggcgcttggatacgaggctgtggccgatgcccaccatgaatggctgccattgatcgcgtgggactgtccggaatccaagaacatcgagccgcgcgacgtggcatggcatgacatacgcctgcctggatggtacaaggatcgcggacttgccggtttccgcggcgagattaccatgagaaaaaccgtgttcctgcctccgtcggatgcggggaagcccgccctactgcgtctgggcaccatgaatgatgccgaccatacgtgggtcaatggtgtgttggtcggtgggcgaagcaatgtgtatgagccgcgggactatccggtcgcagccggcgtgttgcgcgccggcgcgaacgaaatccgcatgcgtctggtcgttgaacggcccggcggccgtgtgacgcccggcaaacggatgacactgaccatcggagacgatatcttcgacctgtccggcatttggcagtatgccgtgaccgccgaagctgaccgcgattgcccattcgaggatttcgtcagatggaagccgaccggcctgtacaacgccatgctcgccccgtgttttccatatgcggtgcgggccgtgctgtggtatcagggcgaatcgaataccggcgatcgcgccatgcaatatggtgacgagctgaaggccatgattcaattgtggcgcgtcaaatggcatcagccggatatgccgtttctgatcgtccagcttccaaaattcgacatcgacgccatcgaggatggtggttggccgcttattcgagaacaggaatggagagtggcggacgaacttgaacacgtggctgcggtggtgacgcttgatgccggtgaaagcaatgatttgcatcctcatgataagaaaaccatcgcggatcgtgcattcaatgtcgcgatggattttgtgtatggccagcaggctcagcctcagccggttgttgaaaccgcagaggcggacgatggattgttgaggatgcactgcgtgtggcggaattccatgggcgaacagatgcaatcgcagaatcgccatctgatgacgttggatggtgacgttccgcgagaaattgatttcctgtggcacgactgcgccacttcggtgcgggctgaggcatggctggatggttgcgatattgtggcgcgcataccgtcgcgcatgccggacgaggtgcggtatgcgtggagcaacagcccggaatccggtctcatctgcgacggggacggtgttctgcttccgccgtttcatctgccgttgcccatggttgattaggagcagtcatgcgcagacaagtcatgattcgtcaaggatgtgtccggattctccgacgcggatcctgtgatcaccgtgtttcggggcattccatatgccaagccgcctgttgatgagttacgctggcgtgagccacaacctgctgaagcgtgggatggcgtgctcgaagccggtgatttcgcgccgatgccgatgcagccgctgcccggctcggatgagttctacggcagggaatggcagattgacgctgacactccgatggctgaggattgtctgtatctgaatatctggacgccggccttgcgtggatgcggcagtggttccgagattcgtacggattcccgttgcgatggtcatgggctgcctgtgatggtatggctttacggtggagcgtttcagactggatctacctgtgagaaggagttcaatggagagcagctggcccgtcagggcgtggtggtggtctccattgcttatcggttgaatgtgtttggttttttcgcgcatgccatgttggaaaaggaagcggttgatggacggccttgtgcgaatttcggatttcttgaccagcggatgggcattcagtgggtaaaggacaatattgccttgtttggtggtgatcctgcgaacattaccgtgttcggccagtccgcaggggccgcaagcgcgttggcgcaaagtgtctcgccgatgaacgatggtctgttccaacgcgtcatcatgcagtctggaggtggaactggtctgttcaatcgccatctgtggtctcttgaggatgcgcagcgaaatggagcgcgttttttgaagtatctggaagttgaatcgattgccgaggcgcgttctgttcctgcgactgatctgctggaggcggcggtgacttttcctgcttgcgattggtctgggcagggtgatgatgtcgtatgggctccgatgactaattggattccctgcgtcgatgggacattccttgtcgagcaataccgtgatgcgcttattgcgggacatcgcgttccgtgtgatttgttggtggggaacacgaccggcgagttcatggttccgggccctgatggcactccgtatccggagggtgagtgcggcaatctggatatgatcgatgcatgggtgtcaggcggcggctcggaaccatacaggtatcgattcgatgtggatatgccgggggatgatgccggtgcgtttcattcgtccgatttatggttttcgttcggaacgctccctgcgagctggcggccgtttcgaggctggcattacgatttgtcccatgcgatgaatcgatattgggtgaatttcgcggcgacaggtgatccgaacggttccggattgcctgagtggacggcatgcggacctgatggtcaacgatatatgctgttcggtggatgccacgatacgccgggtaacgtttcatgcgtcatggtcaagtaagtgaatatagtatggtgtgagcgttcactatagtgcggtggaatgtgatgaaggagacggatatgacgcaggagacggaagcgctgatcgcgtccgacgaggatctgaccaaactgttcgccggcaagccgacgcaatatcgcaaatcgaagtcgctgccgaaattcacaggcgaggccatgcgcgcctgcgcgaagatcaaccgcatcttcttcgatgatccggacgaggcgtaccgtttgtttcacgagctggtcccggacgcgggggagggcgtgcagttcacgccgccgttcaatgtcgattatggtatcggattgaccattggccgcggcacgttcctcaacaaggatttcatggtgtgcggcggcggatatgtgacgctcggtgaggattgtctgatcggtccgcgctgcaccatcgccacacccaaccatgccaaggacgctgccacccgcctggcgggctgggagcatgccagtgccgtgaccatcggtgataacgtgtggttcggcgccaatgtgacggtcacgccgggggtgaccatcgggtcgaattccatcatcggcgccgggtccgtggtgacacgtgacattccggagaatgtcatagccgtgggcaatccagcgcatgtgattcgtgagattcccgaacatgaccctgccttcgccgatgtggaaggtttgctgtagttttgcaaacgtttcatagggggtgttgacggcaaatcgatttctccagccatgcgatgcaggtgagcgcgtaaagccttatacggaagctgtcgttcatattgtcgtttctatgagtatggttcatgaatcagcatagggccgggaagccccattgttgggaagcttcccggccctatgcctgaattcctgcggtgatggatcagccgcgggccttggcgtaggcttcgtatacggcttcggtcggttcgccggtctccacgccgtcgatggtgagttgccatgccggaggctcggtttcgccggacagcacccaggcggcctggcgggccgcgccgatggccacgtattcgtcggtggcgggtcgggtcacgtccatgcccagaatgcttggtgccagcgtgcggatagcttcggacttcgcgccgccgccgatgagcagaatgcgcgtgatgcttgcgcccagggatcggatgagctccaggcagtcgcgctgggagcacagcagtccttcgacgaaggcgcgggccaggttctcgcgtgtggtgttggccagagtcatgccggagaaggtggcggtggcattcgggcggttcggcgtgcgttcgccgtcgaagtacggcaccagggtgatgccgttggcgccgggcttggaggcgaaggccagcttggccagttcgtcgtaatccacgccgagggcggcgcggccggcgtcgaggatgcgcgaaccgttgatggtgcaggccagcggcaggtagtgcccggtgcagtcggcgaagccggatacggcgccggtcaggtcgtaggttgggttctcggagatggctgcggccacgccggaggtgcccagggaaatggacacgtcgccgacggccatgcccagtcccagcgatgccatggcgttgtcgccgccgccgggggcgagcaggcagccgccttcgacgttcttgccggcgatggccggatcggccttgacgggggcggcgtcgcgcggccccagcacggtgggcagcacgatggcctcggcgtgcgattgcgcggctttggcgccttccgcggcctcgagcaccatggcgatcaggtcgcggcggtattcgttcgacgcggcatcgtagtagatggtgccggaggcgtcggagcggtcggtgaacagggcttcaagatgggcgtcctcgccttcggcgaccgggccgtaaccggcgatgcgccagctcagccagtcatgaggtaggcagatggcggcgattttcttgacgttttcgggctcgttctcggccacccatgccaccttggtcagcgtgtaggatgcgacgggggaggagcctacggccttgacccaacgctgcttgcctcgggcgattgggtcttccggctcgccgtcttgtgcgggcgctgcgccgagcttttcgatcagagccgcagcctggggcgccgaactggtgtcgttccacagcatcgcatcgcggatcacattgccttggttgtcgaggatcaccatgccgtgctgctggccgccgacggccagcgcggatacgtcgtccaggccgccggcctgctcggcggcctcttggaatgcgctccaccagtatgaggggtcgacggatgtgccgttcgggtgtttggcctgcccgaatcgtacaagctcgccggtttcggcgtccgtcacgcgtaccttgcaggactgcgtcgatgtgtcgacgcctgcaaccagagtccttgccatagtttgtgttgcctccttgcatgtgccgttcgccggtggcgcacggttaatagttagatgaataaactatactatagtagtgtagcatcaggaaaggctccggaacatcggttcgggaaattcatgctgatgcggcaacacggcaaacagggcagggacgggaacggctatggtatctcttcgcaggatcaatcaggacgatctgcgcaatcacaatctttcggtggtgattgacacgctactgcgtgcctccgggccgatgagccgagcggatcttgccaaggagaccgggctgaccaaggcgacgatgtcgttgctggtgtcgctgctgatcgatgcgggcgtcgtcaaggagggtgagccgcagaactcggccagctatgggcgcccgtccacgccgttgatgctgggaggcggcaaggtgtgcggcatcggcatgcaggtcaacaccgacggctatggatgcatggctttggacatcaaccacgacatactcaggcacgaatgggtggatgccgacatgagcggcgtcgagccggacgtcgtattcggcaagcttgacgccatggccaaggcgatggctgaggatctggaatcgaaacgatgcatcatcgcgggcgtctcgtgtgcgctgccgggcttggtcacctccgacaagaggctgctcatggcccgcaatctcggttgggagaatgtcgatctgaccacgttcgacgttatgcgagggtatgacgttaccccgtgcaatgaggcgaagctggccgccatcgcgcagattccgggatatgcctgtgcgcgtgcggacgtgttcgatggcgtggattgcgccgactccttcctgtatctgtcgtgcgatatcggcatcggcggcgcgatcgtccgtgacggtgagatcgtgtcgggaagccacggtttcgccggtgagatcggtcacgtgtcggtgtctttggacggtccgctgtgcggatgcggacgacgcggatgtttggaaacgtatgctggccgtcgcgcgctggtcgaggcttccggagtggccgaaaagaatgcggcttcgagcggtgaggcactggagcgtctgttggacgcatggcattcccatgatgtgcggaccgtggaagccgtcggacgggccatcgacgcgctggcctcggccatcggctccgcactgaatctggtcgatgtcgataccgtgctgctgggcggttggtggaccgatttcgggccgttcttctacgaaacgctcgaaaaccgtttggaatcgcaggtcttgggggcgtcggacatgcaggtgagcgtgtccatcccgttggtggccgaccatccggcgttgtacggtgccgcggaagtcggcttgcgcaaattcatcgacaatccgctgacgttcatcaccgacaaagcatgattcctgagcgccgccgcaacgtcactcgtgcgcattgacatattgcggattctccactttgcccgttccgccataccgtttgaagccccacagcagaatgagggatttcgcatacgccacccaggcgatgccgaagaggatggcgagaacgcgtatgaacggtacgaaatatgacaggccggccgcgagtacgtcgatgacgacgaggacgagcgagcaggggaaggctcgccaggggaacatcgccgatagcgagaagagcctgccggtggtgttggcgaagcgtgcctgcaacggtgcgacgtattcggcgaacagcgccacgaccacggcggcgatgaccagaaggatcagcggtatgtaggaggcgttggtatcccacgccttccagaacgacaggccgaagaggatggcggtggcgaggatggcgacgagcacccaggccgcaagtccctgtttgaactcgcgtttgaaccgtttgagatactcgcgtaccagattgacgtcgtcatgctcgtcataggcgaacatcgtgctgtacagggcggcgcgggccgggccgatggtgatgctcggaatcagggtgaccaggtagacgagattcagcgcggtgaagcgcgccaacgtgttcatgaactgccagaacggggcgttggtgttgaatttcatgatcctccttgaacagctatttataagtatataaatagagatgatatttgtccagtgctccgtgttgcgccaatttctggagccacaccatctacgattggggcgacgtggtgccgcccgtcagctacggcgacggcatcagcgacgccaaatgcgtggtctccggcctgcagatggactaccgtcgtttccaaaaccaggcgcagctggcctgctatacgaacgagcgcgacgcgatccgtgcttacgacgcggccacgccgatcaccaccaacctcatgggcacgttcaaagacctcgactatttcgaatgggccaaggaaatggacgtggtcagctgggacaactatccggacatggacactccgccgagcttcaccgccatgtgccacgacctgatgcgcggcatcggcggcaacaagccgttcatgctgatggaacagaccccgaaccagcagaactggttcccgttctgcaaagtcaagcgtcccggcgaagtgcgcaagctgagctggcaggccgtggcgcatggcgcggacaccgtgcagttcttctagatgaagcagtcgatcggcggctgcgaacgattccatggcgcggtcatcgcgcacgatggcaccgaacagtcacgtgtcttcaaggagaccgcggcgctcggcggggaactggaccgcatcggcaagcggatcatgggatcggaaatccgtgcgaaagtcgccatcatgttcgactggcaaagctactggtctctcgaaggctgcgtcggaccaaccgccggattctcctatccgaacgaagtgcaccgcttctatcgcgcgttctggcgacgcaacgtgcctgtcgacatcatcgaaagcaccacgcctctcgacaagctcaaacaatacgatctggtggtcgcgcccgccctcatcaccgtgctgccgggcgtcgccgaaacgctggaatcctacgtatccgaaggcggcagcttcataaccggctacatggccggcatccacgacgaacacgacctcgtggtgccgggcggctatcccggcaaattgcgcgacctgatgggcgtatgggtggaggaaatcgacgcgctcgcgccggacgagaccatcgaagtgcatggcgacgcggttgatgccaagggcgagatcgtggccagcatcatccaccgcgaaggcgccagacggctcgccgcctatggtggcggcgaattctacgcgggccattccgcgctcaccgtcaacacgtacggcaaaggcaaggcgtacttcgtgggcacgctgttggacgagaccggtatgagcgccttcatggccccgatcatcaaggagctggggctgaaaccgctcgacaccccggaggatgtgagtctgtccgtacgctatggcgatgacggcgtccgctacgcattcctcatcaacaacagcgaatccgacaagaggctgtgcctggacgagctcgacggcggtgtggaactgctcaccggccatgtggtcgacgggccggtcgggctcaaaccgtacggcgtgaacgtgatcgaactcggataatcggcatcggcgtcgtcacgtggcaggatgcgtcagacgcgaccgaatacgcccgcgcaagtcgccggacgctatactggtcacaggttttgaactctattgaagacaggttagatagcgatatgactgcgaagaggcgcattcttgcgttcgagatcggcacattcttcacgcgttacgtggtgttcgaggatggccggatgggcatccccggcaccgtcgccacgccggtcgacagcgtggaatctttctaccaggcgctcgcgcacatcgtcaacggccaacgcgcgccgcttgacggcatcgccatgagcgtgccgggattcatcgacgtcagcaaacaggttgccgtcaccgccggcgcgttgggcatgctgtacaagcatgagatcggcaaggaactgcaggaatatcttgacaagccggtgccgacctggatggagaacgacgcgaactgcgcggccatggcggaaaaactctccggcaacgccgtcaaactcgacgatttcgcgctgatcaccatcgacaccggcatcggcggcgcgctgtttttgggtggcgggattcgccgtggcaaggattggcgtgcgggcgagctcggcatgatgattccgaactatgaaaccggcgggttcaacaccatgcagaactatttgtccaccatcgtgctggccgaggactacgccaaggaattcgacgtgccgaccggttccatcgtgcccgccaccctgttccgcaggcttgacgagccgcgcgtgcgcaagatcgttgacaaatggattgattacctggcgatcgccattttcaacaccgccgcagccaccgatccggaatgcatactgctcggcggcggtatctgccgtgaacagcagctcttgccgatggtgaacgcggcgctcgacaggattccgcagtggggcgatttccgcacatccgtcaaacgttgccgccacacgaacaacgcgggccttatcggcgcatactacgccttcgaaacggaagtcggcggccttactgacgtgccgataaggtgaacggcagcaggcagcggtctggggcggggtcgtattcgcttggatcggtgaagccggcccattcgcttggcgggaagatgatgtcggaaatcgacatccattcctcaagcagattcatcgaatcgtcgcccagccaacggtattgcagaccgtccatcgcgctcatcgccagcgtatacaggtcgtagaaacgttcctcgtccacgccggtcggcaggatccagttcatcgaacagatcatctcccaattgcgcatatggcggccgatgaagaaattatgcgccggatgcgtcggactgagcgcttcgccgttgagcaccgaatacaactgcaccaattccggacgctgcagattgtacagtgcgatgttcagacagtaacgggggtagaaatacacgcgatgaccgtcgttgtcggtcacggcggcggtcaccgcattgtactcgtcggcgtcgggggtgtcgtagcattccgacagcaccatgttgagcaggtcatccttcgacgaaatgtaatggtagagcgccgcctcggtgatgccgatctcgtcggctatgtcctgcaggctcatgccccagaatcctttggtggcgatgattttgacggccgcctggaggatctgcaggtgcctctcctcctgactcatgcgctttttcttctcgaaggtcttgcccgccaatgcgttgcgcgcctgagtgccatagggggttgaagtgttggcgcgtgacgcggcgggccagctgtcctgttcctgcagaaaacggtcccatgccgcaacgctcatgtcaatctcctatggtcttggttaatggtggttgttgcaccgttgtgcaactgtacttgatggtggccacttgatggtggccgccacgtgatggattcactgagcaagcgtgcggcgcatccatgcgacggccagcttcggccaagcttgcacgcattcctcgatgccgttgacgccttgccacgccgtctccgcggtgcccagcgccagaccgtgcccgccgctggggaacaggtgcgcctcgatgctcacgccggctttcttgcaggcatcgatgagcataagtgtgttctcgtagggcacgcagtcgtccggaacggtgtgccatacgaacaccggtggggtcttggcgtcgatatgcttctcgatggatacgggttcgagcgcttcggcatcagccttgcggtcgccgagcagcgcgtcgaagctgccgcggtgcgcaagcggtccggatgtgattaccgggtaggcgagcatcagtgcgttcggacgtaccgcgtccggatcatagccgtgtgccgcgagcacgtcgtcactggcggaagtcgcaagattggcggcgaggtggccaccggcggaaaagccgatgacggcgattcgatcgccgtcgacatgccattcggcggcgtgcgcacgcatgcgtcgcaccgcttctgcggcttccagcaacgcgacggggaatacggacggtttgacggaataccgtagcacgaaggcgttgaaaccggctgcaaggaactgcatggcgattggctcggcctcacgatcagacgtcatttcatagccgccgccgggtatcaccagcacggatggacgtctgcggtccgggtcgatctccttgctgttgtcaaggcaatagccgacgaatgtggccgtgctgtcatcgatgccgggaatcttgtgttcgaaatatgaaatattgcatggcatccatcctattcgtatgaagttcgtgtggttatgccgtgttaccgtacacggtttgcgtgtttccccgctcttggggggtattggaaacgggcggccgcgaaaatgcttccacggccgcccgtttccaatactcggatagtcaatccgtcagaaggtgacggtgacttcgactggtttggtggtatcggtcgggatcgggacggtgtcgccgtcgagggtggggcgcacgccgagcaggtattgggacgcgtccacgaaggtccacgcggcggtgccggtgagccaggagttcttgccctcgcccggggttggggactcgtcctctaagaaaccgtccaacacaccgtcgccaatccaatctccacctcgccggtggacaggttgcgctggaagttggacgagtcgtccacggcattccacaggcaccattccacggagccggtcacgtcgatgacggccggctcgtcggtggtgttcgtcacgtcgagccgattgatttccgcattggtgtgcagcggcacgaaggcggtgagcttggattcgatgcctcgcttggaagcttcgaacacggtgtagccgatgccttgacggcacttgcaggaatcaagcggggtcttgcacggaaggaaggtcggcgaccaggtttcgaccggcttggcatcggcggaatcggagtccatcaggctcaggtaatagcagcgggagccgttgtctgccggcacgttgttataccggtagcgggtgatgcggcgtagtttggcgtccttgtagaagctgtagccgccgccggtgttggaaatcagcgagaagaagtcctcgttgccaaggtagttgatccacggcaggggagtcgccggggtttcaatcacgtattcctttgcggcatcatcgaaatgaccgtagcgcatgggtgccctttcgtcggtgaaatggctgtgacgaggtgtactgtatgggtatatcgtccattgatttaattaataggttagcacgttgtttataaacttataaataacgatttgctggcgtgttgccgtcggtcttccaatggtcatctgtcgacgctgccgcaatcgggcagaggttggggtatacttcctcccgttgccctcgtagctcagttggttagagcagcacccttataaggtgtttgtcctgggttcaagtcccagcgagggcacatgcggacctgccggaagcggcgggtcctttgcatatccgcggattgcagtccgtacgccctgcgtgtgacggcgcataccgtgtcccggccatcgcctacactccataaggttatccggttcacgccttgccatcggggcaatgcgacccgggtcccccgaatctctaggagacaaactatgaagcagggtatccatcctgattaccacgcagtgcaggtcacctgctcttgcggcaacaccttcgtcacccgttccacctacaacggcgatcacatgaccgtcgacgtgtgctccaactgccacccgttctacaccggcaagcagaagatcctcgacaccggtggccgcgtggctcgcttcgagaagcgttacggcaagaaggccaagtgagtcttattgcttaggcaatgaaaacgccagtccattcgtgggctggcgtttttcgttaccgacgtgccgtcgctcacctccgacgaccgcacttccgcgccaccttatatgatggacaggttgagtaaggttcagcgacgagtgattccgctgaagcgcagatacgaagaaaaggcgtacattggcagacgaacaattccccgcggccgtcaccgcgcttgaggaataccacaatatcgaacagcagatggccgagccggaggtcgcatccaatcccgacaagatgcgcaagctgggtcggcgccacgccgaactgggtgccatcgtctccgcctacaccgcatacaagcaggtgaaggacgatctggaggcggcccgcgagatggcgtccgaagatcccgatttcgccgaagaggccaagcggttggaaggcgagctgcccgcagccgaagagaagctgcgcaccgcgctgattccgcgtgaccccgatgacgcgcgtgacacgatcatggagatcaaggccggcaccggtggtgaggaagcggcgctgttcgccggcgacctgctgcgtatgtacatgcgatacgcggaaaagcgcggctggtcggtcaccgtgcaaagcgagaacaccaccgagctgggtggcgtcaaggacgtgcagctggccatccgcgccaaaggcactccggcgccggaggacggcgtgtgggcttccctcaagtacgaaggcggcgtgcaccgcgtgcagcgcatccccgtcaccgaatcgcagggacgtatccagacttccgccgccggcgtgatcgtcttcccggaagccgacgaggacgacgatgaaatcgaaatcgatccgaaagacctcaaaatcgacatcttcatgagctccggccccggcggacagtccgtgaacaccacgtattccgcggtccgcatgacgcacatccccaccggcatcaccgtgaacatgcaggacgagaagagccagatccagaaccgcgcggcggcactgcgcgttctgaagagccgcctgctggccatgaaacacgagcaggaggccgccgaggccgccgatatgcgccattcccaggtgcgctcgctggaccgttcggaacgtatccgcacgtacaacttcccggaaaaccgcatcgtcgaccatcgcacgaactacaaggcgtacaacctcgacgccgtgcttgacggcgatctgcaggccgtgatcgacagcgacatccaggcggacgaagccgatcgtctcgccaaccagaagtaaggcgattgggtggcgacggtattcgaaacggtgcgttccgccgcggacgaactacgtgcggcgggagtcgacactccgcagcacgacgccaaactgctgctcgccgaagcgttccatacggacctgcagcacgtggacaaagccatgctcatgggcgatggcgtcgaacgtctggccgaaaaagaagacgcggaaccggcgatggaacgtttccagaccatgctggcccgtcgtgtcaaacgcgagccgttgcagcacatcaccggccatgcgccgtttcgctaccttgatttgaaagtcggtccaggcgtgttcattccacgtccggaaaccgaactggtcgtgcaggaaggcgtcgactgggccaccagaaacggcatgtaccgcgccaaagtggtcgatctgtgcgccggcagcggtgcgatcggcctcgccttcgcttcggaagtgccgggcagcgaggtgtgggccgtcgagaaaagcgctacgaccgccgagtggacgtggcgcaacctcgacgagaccgcgaaacggtatcccgcaatcgccggcaattatcatctggacatcgccgacgccacgcaaatgccgacgctaagccaacttgacggcaccatcgacatcgtgctcaccaatccgccgtacgtgccgcttgccgacattcccgaacagtcggaagtgcgcgattatgatcccgatctggcgctatacggcggttcggcggatggcacgctcattccggaacgcatcatcgcacgcgcggcgaaactgcttcgtgcgggtggacttatggtgatggagcacgacatcacgcagggggagcggcttgccgccttcgcacgaacctgcggcttcgtcgacgttaccgtgcataacgactacaccggacggccacgttatctgacggcggaaaaacagccggcacagtaacttatattcttttgcgccatgctgacggggatataaccagaagttgagtctcactataagaacattttatgcaggccgccgtccgtcaggctataaagaacaatcggaatgcacagagagagaacgggcgtccgtcatgagtggtcgccgtggttccgcgcacgggggttgagatgaacatgattttttccaaggtgcgcgttgaaaggaatgtgcagcgttttcaagaaaagaggaagaacggaatgaacgcgaagttctccgccaagtgcgtcgccctgatcgcggcaggcgcaatgtcgatgtccctcgctgcctgctccggcggcagcatggacgattccagcagctccaacggtagcgcggccaacagcgataccatcacgctgggctccgtcaccaccaactccggcaccgccgccgcatatggcgaggccgaggtcgccggcttcaagctggctgtggatgagatcaacgccaagggcggcatcaacggcaagaaggtcaagctcgagtccatggacgacaagggcgacgccaccgaagcctccaacgccttcaacaagctcgccggcgacaacagcgtgctcggcgtggtcggcccgaccatctcctccaccaccgcggcagtggctccgctggccgaccagtccaagctgccggccatcgcaccggccgccacctccgactccatcgagaccggtggctacatgttccgcacctgcttcaaggactcctaccagggtgagatcgctgccaagttcgcagccgagaccctgaaggtcaagaaggtcgccgtgctgtacggcaccggcgatccgtactcctccggcgtgggcaaggccttcgccgctgccgccaagaaggccggccttgacgtcgtggccgaagagaactcctccagcgccgacgacaccgagtactcctcccagctgcagaagatccaggccgctggcgccgagttcctgtacgctccgtactactactccgtcgctggcccgtacatcatcccgcaggcccgctccgtcggctacaagggctatgtgatgggtcctgacggctacgacggcctgaagatgaccgacgacaagtcgctgtacaacaaggtgctctacaccacccactactctccggacgacacctccaacgccaaggtgcaggacttcatcaagtcctacaagaaggccaacaagaacgccgatccgaacaccttcaccgcactgggctacgactccgtgtacatgatgaagcaggccatcgagaaagccggcaagaacgccacccgcgaaggcgtgcgcaacgccatcgccggcatgagcttcgaaggcgtgaccggcaacttcacgctcgacaagaagggctccccgaagaagtccgtcgtcgtgcttgagctcaaggacggcaagccgcagtacaagaccaccattcagcctgccaagtgagcgtcgcttgcctgaaggcctgaatctgtgaagaggagggggccgggaaaccggttctctccctttcgcgtatcaagacgaaaataaccatattcagccgctgggcttcttcagcggccaagccggacggttatgtcaaaagtccggcatcatcaacttttgaaaggaggaatgatgggcgatcagatcatcatgttcatcagtcagatcttcaacggtctgaagatcggcagcgtgtactcgctcgtggcactcggctacaccatggtgtacggcatcattcgtttgatcaacttcgcacacggcgatttcatcatggtcggctcctacgtgctgatgcttaccattccggcgatcgtcgcattcggcctgcccgcatgggtggccgtcatccccgcgatcctcatgtgcgtggcggtgggcgtcatcgtggagagggccgcatacaagccggttcgtgaaaagggcaacagcatgacggccctcatcaccgcaatcgcaatgagccttctgctggagaacggctcccaggccatcttcggcgccgactaccagaccgtgcccaccatcatccagattccgacgctggcgatcggcaaactgaagatcgacggcgcgaccatcatcaccatcgtgctcggcgtgatcatcatggtcgcgctgcagctgttcgtcacctacaccaagcagggcaaggccatgcgcgcggtctccgaagacaaggaggcctcgatcctgatgggcatcaacgtgaactccaccatcacgctcacgttcgccatcggttcgggcctcgccgccgtcgcatcgctgatgtactgcgtttcctatccgcaggtgtccccgatgatgggtgcgatgctgggcctgaaggccttcgtcgcggccgtgctcggcggcatcggctccatcccgggtgccatggtcggcggtctggtgatcggcgtggtcgaaagcctgaccaaggcgtacatcggcaccatcaccagcggcgtgatcacgtccgcgttctccgacgccattgtgttcggcatcctcatcatcgtgctcctggtcaagccgtccggcctgatgggcgaaccggaaaccgagaaggtgtgacctcatgaagaaatcaatgctttccaccaaacagtcctatctgatgtgcgcggtcggcatcgtcgtgctgttcggcattctgatgggtgtatgcgaatccggcatggccagcacctacatcaagggcatcatgatgacaagctgcatcgccatcatcatgaccacgtcgctgaacctcaccatcggcgtgctcggccagctgacgctgggctgctgcggcttcgaagcgatcggcgcgtacagcgcggccctgctgagcaagctgctcgtcgccaacggcgttgcgatggatccgacgctgcgattcctgctgacgacgctcgccggcggcgtggtcgcctgcatcttcggcatcctggtcggcattccggcactgcgtctgcatggcgattacctcgccatcatcacgctgggcttcggcgaaatcatccgcgtgatcatccagaacctgaaggtcgccggcggcatgggccttgacaagggcgcggccggccaggcgctgatcggcatcgaccgactcgccaacctgtacgtcgtgttctggatcaccgtcgtcaccgtcgtgctgctgttcatgttcgcccgctcccgttacggccgtgccgtcaaggccatccgcgacgacgagatcgcggcaagcgcgtccggcatcaacatcacctacatgaaggtgctcgtgttcgctatctccgcgttcttcgcgggcatcgccggcggcatcttcgcccagtacatcggctcgctgaaccccgcgatggccggatggctgcaatcgatcaactacgtgatcatggtcgtgttcggcggcatgggctcgctgacaggttccatcgtctccgccatcgcgctgacgatcctgccggagctgttgcgcgccttctccacctaccgcatgctcgtgtactcggtggcgctggtgctcatcatgatcttccgcccgcagggcatcttcggcaactgggaattctccctgaccaagaccatcaacaagctgttctacccgatgaaggtcaaggcgcacggcaagtcgaagcaggctgaatccaccgccaaggcagccaaggacaccgccaagacggacgaaaccgtcgagacggccgccgacaccaaggaggcgcaggcatgagcgagcccatcctgaaagccgaacatctcggcatcaccttcggaggcctcaaagccgtatccgacttcaacatgaccatcaactccggcgagctcgtcggtctgatcggcccgaacggcgccggcaaaaccaccgtgttcaacctgctgaccggcgtgtaccagcccacggaaggcgagttcttcctggacggcgaacgcatgaacggcaagaagacgtaccaggtggtgcgcgccggcatcgccagaaccttccagaacatccgcctgttcggccagatgaccgtggaggagaacgtgctggtcgcattcaacgaatcgttcagctaccacatgggcggcgcgattttccgcacgccgaaattctggaagcaggaacgcgagatgcacgccaaagccatcgacctgctcaagatcttcggactagagggcctggccgaaaccgaagcggcgaacctgccgtacggcgcccagcgcaagctggaaatcgcccgcgccctcgccaccggcatgaaactgctgttgctcgacgagccggcggcaggcatgaacccgacggagaccgaggacctgctcaactgcatcaacaccatccgcgaccgcttcggcatcgccatcctgctgatcgagcatgacatgagcctggtgatgaacgtctgccagcgcatccaggtgctcgactacggacgcaccatcgccgccggcacgccggacgagatcgccaacaacccgcaggtcatctccgcatacctgggttccgacgacgataccgacagcgacgatgccaagcacgaaagcgaggaagcctgatgctggaagtcaagaacctttccgtttcgtacggtgccatcgaagccgtcaaggacatcagcttcactgtcaacgacggcgagatcgtgtctctgatcggcgcgaacggcgcaggcaagaccaccacgctgcacaccatcaccggtctggtaccggcgaaatccggttccgtgatgtacaacggagtggatctgctgaaaacccacaacaacaagatcgtgaccctcggtatggcgcacattccggaagggcgccacgtcttcacacgcatgagcgtcgaagagaacctggagatgggcgcgttcagcctgaaggaccagtcggacctcaagaaggacctcgacatggtctacggcctgttcccccgtctgaaggaacgccgtaaccagaaggccggcacgttgtccggcggcgagcagcagatgctggcgatgggccgcgcgctgatgagccatccgaagacgatcctcatggacgagccgtccatgggcctgtccccgaagctcgtcaaggagatcttctccatcatccgcaagctgcacgagcagggcatcacgattctgctggtcgagcagaacgccaagatggcgctgtcgatcgccgaccgcgcatacgtgctggaaaccggccgtatcacgatggaaggcgacgccaaggaactgctcaacaacgagcaggtgcgcaaggcgtatctgggcgcctgattcatgccgtatccgccttgtcggcttggacgcatccaaaccgacagggctttttctatatccgatggaatattcgccggtcgtgttccctccattcgggcgcgccatcgagccatgccttacaataggtaagttgactggctgaaagggaggtgtcatgagcgaaatttgcacagtaaacgacgaatcccttgcccgggccgttgaaatcatccatgatggcggattggtggtcatccccactgacacggtgtacggcgtcgcctgcgatccgcgtaacatcgaggcgatccgcaaggtgttcgcagccaaacaacgaccgaaatacaagtcgttgcaggtgttgctgccgtcaatcgaaagcatggagaagctgcatctgaccttgccggtgccgctcaaccgtctggccgccatgttcatgccgggcgctttttcgccgatagcggaagcggaagacgactgttcgcttgccacgttgcgtcatgatccgacaaccggcaaagccacacagggcgtgcgcatccccaattccgcggtcgcgctgcgtattctgcgagccaccgggccgttggccgccaccagcgccaaccgttccggcgaggaaagcgcacaaacggtgcaggaagccgcggacgcgctgggagatgcggtggatctgtatttggacggggggcgactccgggacatgtgtcgtccacggtggttgcagccgacccgcacgagcgcgacggcatcgcgattcttcgggagggagtgattcgcgagctggtcatccgtaaggctttaacactgaatggcggtgctttgggcgcatgagaatctacctgttcattgccgcggtcgcaggtggcgtcacctatctgctcacgccgctgatccggcacatcgccatcgaaatcggcgcagtcggcgaagtgcgtgcacgcgacgtgcataccgtgccgacgccacgcatgggtggactgggcatgcttatcggcttcaccgtggccatgctgttcgcctcgcgcatccctttcatcgaaggcctgttcgcccaatcgcatcaggcatgggtgattctagccggcgccattatgatcagcctgctgggcatggccgacgatttgtgggaccttgactggatgctcaaactcgccggtcagctgctcatctctgtgtttgtggcctggggcggcctgcagatcatctcgttgcctctcggctcgctcgtcaccgcgtcgccgagcctgtcgatggccatcaccgcgttccttatcgtcgcgtccatcaacgcggtcaacttcgtggacggtcttgacggcctcgcttcgggcatcgtcgcgatcggcggcatcgccttcgccatctattcgtacatcatcgcaagaagctcgccgtcgtacgcatccatggcgacgctgatcgacatcgccatggtcggcatgtgcgtcggcttcatcctgcataactggcatcctgcgaaactgttcatgggagattccggctccatgctgctcggctatctgatcacctgcgcgtcgatcgtcatgacgggccgtctcgatccggcgtccatccataccagcatctatctgccggtgttcatgccgattctgctgccgatgctggtgctgttcctgccgatcctcgacatgtgtcttgcgattgtgcggcggttgagcaaaggccagtcgccgatgcatcccgatcgcatgcacctgcaccaccgcatgctgcgcatcggacacaccgtgcagggcgcggtgctgattctctgggggtgggcgtcgctgatcgcattcggctcgatcatgattctgttcttcaaagcgcagtatgtgctgattggcttcctcattgcgtcggcgctgctgacggtcgccacgatgtacccgtatctgaaacaccgcattcccgaaatccgtgaggaaaacgcaatctccggaaccgatgcgcaacacgcgtcggtcggacgcgcgcgcggcgacaaaacgcgcggtggacgctgatcgtccgtccggcgcaatcgcaagaaaaactgatgaaacgctttgccaaacgatataagcagcttttattacgattgataatttcggcttttcgcgccgtgtcgcagtaagtcagcccacgttcatatagtgggtctatggctacaattcctgatatgaatgcagattccacgttcgccccacttcctccgattttcgcccagcttggcctcgcctatgacgatgtgctgctgctgccgaacgagacggacgtcattccgtccgaagtggacaccaccacccatctcacacgcaacatcacgatgaaggtcccggcgatctccgccgcgatggacaccgtcaccgaatccgacatggccatcgccatggctcgcaacggcggcatcggcgtgctgcaccgcaacctttccatcgacgaccaggccgcccaggtcgacatcgtcaagcgttccgaatccggcatgatcaacgatccgctcaccgtgagcccggacgtgaccctcgccgacctcgacaagctgtgcggccgtttccacatctccggcctgccggtcgtggacaaggacagcaagctcgtcggtatcatcaccaaccgtgacatgcgtttcatcgcttccgaggattacgaccgtttgaaggtctccgaggtcatgacccgcgagaacctcatcaccggtccgtccgacatctccaaggaagacgcgcacgacctgctggccaagcacaaggtcgagaagctgcctctggtcgattccgaaggtcacctgaccggtctgatcaccgtcaaggacttcgtcaagaccgaacagtatccggacgccaccaaggatgagcagggccgtctgcgcgtcgccgccggcatcggcttcctgggcgacgcctacaaccgtgcttccgctctgatggaagccggcgtggacgtgctcgtggtcgacaccgccaacggtgaggccaagctggctctcgacatgattcgccgcctgaagtccgattccgcgttcaatggcgtggacatcatcggcggcaacgtcgccacccgccagggtgcgcaggccatgatcgacgccggcgtcgacgccgtcaaggtcggcgtcggcccgggctccatctgcaccacccgcgtggtcgccggtgtcggcgtcccgcagctcaccgccgtgtacgaggccgcccaggcctgccgcgccgctggcgtgccgtgcatcgccgacggtggcatccactactccggcgacatcgccaaggccctcgtggccggcgcatcctccgtgatgctcggcggcaccctcgcgggctgcgaggaagctccgggcgagaaggtgctcctgcacggcaagcagtacaaactgtaccgtggcatgggctccctgggcgccatggctccgcgtggcaagaagtcctactccaaggaccgttacttccaggccgacgtcacctccaacgacaaggtcgttccggaaggtgtcgaaggcgaagtgccgtaccgcggaccgctcaacgccgtgctgtaccagatgatcggcggcctgcaccagtccatgttctacattggcgcgcacaacatctccgaaatgccggaacgtggccgcttcatccgcatcaccgacgctggcctgcgcgaatcccatccgcacgacatcgtcatgaccgccgaggcgccgaactactccggccgtcagtgattggcgaataccgcgcgaaacgcatacgacgcgactaaacgctagataatacgaaacccgtccggtggcaggaatgccgctggacgggtttcgtgcgttttcggcagctattggtctagtgacgtttagttaattgagccatgtcgatggcaccgtatgaacgtcaacttacgcgttccgtggtgccacgcagcaccagcgacgtcggcatgacggtgaacggctcgtcaagcgtctcgccattgagcagcgcaagcgtcttacgtgcagcgatacggccgatttccgccggatcctgatgcatggtggtcagatccaatgcggtggcggtgtcgtcatcatcgaatccgaccagcgacacgtcctgtggcacgcgccatcccatgcgccgcagctccttcagcaggggagcggccacggcgtcgacggagacgcagatggcggtcggctgctttggagcgctgagcagctgcgcgacgatgccggaatagatgtcctgctcgctgcgagcatcgatatgggatagtgacggcatgacgatgatgtcttcatccgcgtaaccgcaagcttgtgaggcttcgctgaatcccttcttgcgcagcctgtcggagcagacgaacggcgtggtgttgatgggctgttcgatgtaggcgagcgtcttatgccctaacgatttgaggaaccgtacaatcgtcgccatggaagcctcgtcgtcgatggcgacgccggcgtcgagaccgtgcgtgctcggcgcgttcatgccgaccaccggaatggtcagattgccaagcacctgcttcttcgcctcgtcgaagtcaaatgacgcctcgatgaccgcgtcgacgttgcggttgcccggaagattttggaaaaacgcatccaaatcgtcctgcgtccacacgatgtaaggaacgatgtcgtatccggccttcgacatcacctcgtaaatgccttcgaaggcgtgggcgttgaaccagctgctgatttcgttcggcagcagcacggcgactcgcatggttttgccggacgccagggacgacgcgcttttcgaaaaggagaaatgcaggcgcttcgcctcctgctcgatgcgttccctggtttcgggactgaccctgtcgagcccgcgaagcgcgcgggacacggtggagacggacactccggctgcctgggctacgtctgcgatggtggttcgtggcatggtcggatggctccttagggtggactatgcgggcggtcggttgcccgcgactgcttcactctatcacgacacgctgcttttgtaaaaacgcttgcatggcttcaggtgttgttattgcttgctttttgaagtgctgccaccttgttctgcctcctgtggtttgcgcttttttgcacaagcgttattattgattatgtcaagcaatgcgataacagcaacgaagctacacaacacaacataaccatcgtaggaaaatcaacgaaaatcgttctacgtacggagttgtgatacgtgcgcacggtgcacaagcgtttgtatgaaaggggacaacatgaccgaagtcaacgatccgtcgctgtggtggaagcaggccgtggtctaccaggtgtatccacgttccttcaaggattcccgcggcgagggcctcggccagattgccggcgtcaccgagaaaatcggatatctgaaggaactgggcgtcgacgccatctggctgagcccgttctacccgtcccagctggccgacggcggctatgacgtggacgactaccgcaacgtcgatccgaaactcggcaccatggacgatttcgacgcgctcgccaaagccgcgcatgccgacggcatcaaaatcgtcgtggacatcgtgccgaaccacagctccaacctgcacgaatggttcaaggccgcgttggccgcgaaacccggctcgccggaacgcgaccgctacatcttccgcgatggcaagggaccgaacggcgacgagccgccgaccaactggcagaaccacttcggcggccctgcatggacgcgcgtgcccgacggccaatggtatctgcacatgttcaccaaggaacagccggactggaactggaaaaacgaggacgtgcgcgccgatttcatcaaaaccctgcgtttctggcttgaccacggtgccgacggcttccgcgtggacgtggcgcacggcctggccaaggatctcgaccgcgatgatctggacgattatgtggtctggtgcaccaacgatcagcccgaagacggctcccatccggtgatcgaccgcgacgaagtgcacgacatctaccacgagtggcgcaaggtgttcaacgagtacgatccgccggcgttcgccgtggctgaggcgtgggtccgaccaagccgccagcatctgtacgcctccccggacgatctcggccagatcttcaacttcgagttcgccaagaaggattggatccgcgacgacatgcacctcgccatcgaggaaggtctggaaagcgccgaacggtccggttccaccgccacttgggtgatgagcaaccatgacgtggtccgccatgccacccgctacgcgctgccccaggtgccgaccggcgaataccatcgactgccgctcgactggctgctgcgcgacggcaccacataccgggaggaccgcgcgctcggcaccaagcgcgcccgcgccgcgatcatgatggagatggcgctgcccggctccgcctacgtgtatcaaggcgaggaactcggcctgttcgaagtggccgacattccgtgggatgagctggaggatccgtccgcatggcgcacctcccgttccgccagcaccaaaggccgtgacggctgccgtgtgccgctgccgtgggttgcggccgacgctccgcagctggacgatccgaacgatgagttcggccatggcggctccttcggattctcgccggcagacgcgaaggccgagccgcatctgccgcaacccaagtggtacaaggatttcgcggtcgatgtcgaatcggccgacccggattccatgctgaacctgtaccgccgcgtgctggcattgcgacatgagttgcagaccaccgacctgagtctcgaatggcttccggaagaccagcccggcaaggcgcatgacggcgccaacggtttcccgggtggcaccatcgcgtaccgccgtgccaacggctgggcctcgatcaccaacttcggcgaagaaccgatcacgttgccgcaaggcgaagtgctgctgacatcaggaccgcttaccgacgacggcaagctgccgcaagataccagcgcttggctcaaactggccgattgaccgcacgcaggatgccccgatctgagggtgtccgtgccggataccgcactcgtgcgctgaaccatcgaaccggcagcgcgctccagccgtccgcgtccctccatttgggcgcggacggctttcctgtttccaacgaccgttttccaacgatgacggtccgacgtacctaccctgcggtatcttcatatgttcggcctgcgcagagggcgcgaccgcggaccaatcgaaagaggcaacgatggtagatgcacacgatggcgaaacatacacgtccgaaggctcacgtctgatctggatcgactgcgagatgaccggcctagatatcttcggcggcgacgagctcgtcgaggtttccgtggtgccgaccgacttcgacctgaacgtgctcgacgaaggtgtcgactatgtgatcaagcccagtcagaaggctgtcgaccacatgaatgacttcgtgcgcgccatgcacacccgttccggcctgatcaacgaatgggaacacggtctgagcctcgacgaagcgcaagccaaggtcatcgaatacgtcaggaaattcactccggccggcgtcaagccgctgctcgccggcaacaccatcggctccgacaagaagttccttgaccactacatgccggaactcatggagaacctgcactaccgcaccatcgacgtgagcaccttcaaggaactcgcccgccgctggtatccggccgtctacctcaaccgtccgccgaagaacggcggccaccgcgcgctcgccgacatcatcgaatcgctcgacgaactgcgttactaccgcaaggcgttcatggccccggtgcccggtccgagcgaagcggaggcgaaggccatcgcctctgaaatccaggaaaccagcctgctcaacaaggactgacagcacgactccagcgagaggaaccgcatgaccgcagctgattggaccaccatcggccaaccgcaggatatccgccttgtggtcgccgacatggacggcacgttacttgacgaacgaagccgaatccccgacggattctggcccatgctcgcccggctcaaacgccgtggcgtcgaattcgtgcccgcgtccggacgccaatacgccacgctgcgcaacatgttcgccgacaaagccgcggagattctcgacgggggagaactgtcctatatcgcggaaaacggcaatgtggtggcgctcgacggcaaagtcgtggaagtgcatggcgtcgatttggacgtcacgagtcacgtcatcgacctggtcgacgacgccgctgcctccggcgagcataacgtgggactggtggtgtgtggccttaaatcggcatacgtgcagcgttccgacaagccgttcctcgatgaagtcggcaaatactacgcggcgctgagcatcgtggacgatctgcacgaagtgctcgacttcgcgcaggaaccgtccgcctacacccctgacggcgacgccgaaatcgttctgaaactcgcgatcctcgaccttgacggctccgaacgattcaccaacgaaaagctcacacatctgcgcgcggactaccaggtggtcgtctccggcaaactgtgggtggacatcatgaacatcgaaaccgacaaaaagcagggcgtcgaggcgttgcagcgcgtgctcggcgtcacacccgcgcagacggcggtgttcggcgactacctcaacgatctgctcatgcttgaggcgggcgactggtcgttcgccatgggcaacgcacaccccgatttgaaggccgccgcgcgctacatcgcaccgtcgaacgtcgagcacggtgtgctcaaggttgtggacaggctggttgcctgacgatttcgttgcatggggcgcggtgacgtaaagaaggtggcgtaatgaggcaatccgaggcgcttgcgattctgggttccggcgcaagcgtgttcctgacgggcgcgcccggtgccggcaaaacctacgtgctcaacgaattcatacggcaggcgcgtgccgacggcgcatccgtggccgtcaccgcatccacgggcatcgctgccacgcatatcaacggcaccaccatccattcctggagcggcatcggcttggccacggcattgaccgacaatctggtcaaaaccgttcgcacacgccgcaaacgcaagctgcaggaagccgacatcctcatcatcgacgaggtctccatgctgcacgcgtggctgttcgacatggttgaccggatctgccgcatcatccgccgcgacgaacgtccgttcggcgggctgcaggtggtgttgtccggcgattttttccagctgccgccggtttcggtatcgggacgcaacaacgacctgatcgcgccgtccgccgaatatctggccagtcgcgaacggtacatgcgcgccggactcaatcccgaaggtttcgtcaccgaatcgttggtatggcgcgaattgaaccccgttgtctgctatctgaccgaacagcatcgtcaggatgacggccagctgttgaacgtgctgaccgacattcgcgaaggcgcggtggacgatggcgaccgcaatgtgctgctgacccggttgggggccattccggaacccgggcagcaggcggtgaacctgttccccgtcaacaggcaggccgacgcgcttaatgacctgcgcctgttcgaaatcaaggaggagccgcacgaatacctcgccgaatccgagggcgcggcgaatctggtggaacggctcaaaaagaacatgctcgctcccgaacgcttgtacctcaaaacgggcgcggccgtgatggcggtgcgcaacgacaccgaccaccagtacgtcaacgggtcgctcggcaccgtgcgtggattcaccacgcaatcgcagggcggctggccgatcgtcgaattcgaaaacggcaacatcgtcaccatgaagccgaattcctggcagatgcaggacggcgataccgtgctcgccacggtcaaacaggtgccgttgcgctgcgcgtgggcgatcaccatccacaaatcgcaaggcatgacgctcgatcgtgccgtcatggatttgcggcgcacattcgcgccgggcatgggatacgtggcgctgtcgcgagtggaagggctcgacggcctgtatctgcaaggcgtcaacgagcgcatgttcctggtctcaccggacgcggtccgtcttgatggacaattgcgattggagtcggcgcaggccgtcgatacgcttgcctccgacggtgtcggagcattccgcgcccgcatgccgcaaccggccggtgaggatgacgaattcgcgcaggacgtgctgttctgacccgctgctaaatatcagcccatcgcctgcagggaacgcgcaagatccgggtcgagctcaacttcgtcctcgacgctttccgaatcggggtcccaacagctggcgatcacgcaggccagtccgacgagcaaccaaagcgggttgcgctgcaggaactcaagacctggaatcgcccgcgtgacgatgatccatatcaccatgccggccagcgcaatcgcattgaacggcttcttccatggcagggaaatcaacgtgacgcacaatacggccaggcacaggccgatccattggttgccttcggtcagcacttccggcgctgccgccgcgaagacgaaatagcagatgatgccgatccggccgagtttgttccaaatcgaaatgtgcgcggtgacgtgacgcatgctgcgtcctttccttatgaagcgatatggtgctgattccagtatcatagaaacggctttagacttatttataactctataaataacgtttttcgcgtattggtgtgcgattcgaggacgtgtggcgcatccaagtcggcttacctgagtaatttggaacgtatgaccaaagcacttcgtatgtctaccatgttcctgcgcaccctgcgcgaggaccccgccgatgccgacgtcgtgtcggacaagctgctgcagcgcgcctgctacctgcgcaaggccgctccgggcatctggacctggctgccgctgggcctcaatgtcctgaacaagatcgagaacatcatccgcgaggagatggcgtccatcgacgcccaggaagtccacttctccggactgctgccgcgcgagccgtatgaggccacccaccgctgggaggaatacggcgacaacatcttccgtctgaaggaccgccacgaggccgactacctgctggccccgacccatgaggaaatgttcaccctgctggtcaaggacctgtactcctcctacaaggacctgccggtgaccctctaccagatccagaccaagtaccgcgacgagttccgtccgcgcgccggcctgatccgcggccgcgagttcatcatgaaggacgcctactccttcaccctcgacaaggaaggcctcgtcaaggcatacatggacgagcgcggcgcatacgagcgcatcttcaaccgtctcgacctgaagtacgtgccggtgcacgccatggccggcccgatgggcggcttcgaatccgaggagttcctggctccgatggagatcggcgaggacaccttcgcccagtcgccgtccggcaaggcctggaacgtcgaggcgctgaccactccggaaccggaagccatcgactttaccgcaacgccggcagccgaaaagcgcccgaccccggacgcggccaccatcgacaagatggtcgaattcgccaacgccaaccatcctcgttccgacggccgcgattggcaggcctccgacattctgaagaacgtcgtcatcgccgtcatgcatccgcaggacgaagaccacgacgagccgtggcgcgagctcgtggtcgtaggcgttccgggcgaccgtaccgtcgacatgaagcgtcttgaggcgcagttcaccccggccgagatcgaggaagccaccgacgaggatctgaagaagcatccggaactcgtcaagggctacatcggaccgatggcgcttggcccgcaggcgcgcgacggaaagaaggccgagaacgcgtccgagaccggtgacgcgctgcgctacctgatcgacgcgcacgtggcacgcggttccgcatggttcaccggcgccgacgagcaggacgtggattactacgatttggtgtacggccgcgatttcgaggctgacggcaccgtcgaagccgtgcaggtacgtcatggcgacatgagcccggacggttccggcccgctgagcttcgagcgcggcgtggaaatcggccaggtgttccagctgggcctcaagtattccaacgcgctcggcctgaaggtgctcgaccagaacggcaagaccgttccggtgtggatgggctcctacggcatcggcgtctcccgtgtgatggcctgcatcgccgaaacccatcacgacgagaagggtctggcgtggccggcagtcatcgcgccggcacaggtgcacgtcgtggccaccggcaaggatgcggccgcgttcgaagccgcagaacagctgatcggtgagcttgaggccaagggcatcgaagtcatcttcgacgaccgcaagaaggtgtctccgggcgtcaagttcaaggacgccgaactcatcggcgtgccgatcatcgccgtcgccggccgcgacaccgtcaacaacggcaccatcgaagtgcgcgaccgcaacggtgagaacgccgaagcggtgccggtcgcggacgccgcgcaggcgatcgcggaccgcgtcgctgcactgctcaagtgacatacggcaatccgtagcgcgtcggtttgatccgacgaacgacatacggcaacggaagaccatcaagcaggtggtcttccgttttttgtttttcatggggaataccgtgcgcatctcacgcacatgaggattgtggatgtcggtggataagtcgaaattatccaccgacaatccacgactcgcccgacgatctcaagttatccacattctccggttgggcttgcagacggatggaacgttcggcgatagtggtcttaccgcggaaacgtgaagatgcgggaagggcatgcagtttaccctctctcaccataaatccacctcactgcctgtcgcttccgtgccgtcaacggcgctttccgcggtccatcattcgtcaaacagaaagggccgaacatggcgcagcagcagggtctcctcaccatcacgggatatgtgggcggccagcccacgcaattcaatcgggaaggcatgccgcatgccagctcattccggctggccagcaccagacattatttcgatggccgaacgcaacagtggaaggacctgcccaccacatggatcacggtgaaggcatatcgaggcctttccgaaagcatctgccaatcgttcaaaaaaggcgaaccggtcatcatgaccggcgtgctggcggcggaaagctgggtggaccagaacggcaagcaacagtcgaaactcgtcatggaagcgaatgcggcggggcatgatttgagctacggtgtctccaccttccgcaaactcgccaagaaaaacgattccggccagcaagacgcgcagcctggacaggctttaggacgtgatccatatgtgcaagccgcccaacagcggggcgaaacttcagtcaatgcgatggacgggcagagttccggcgttgacgagcaaggcggctcgcaggccggtacggatagcaacgccgccgaacccctacgtgaggaattcggcggcgatggcttctgacgattgcctgacgcttatgcgatcgctggcatggcctgttaccagatgcgcacgcgttgctccggtgcgagccacatgccgtcgccgggctgcacgccaaacgccttgtggaacaggtccacattacgggcgatgccgttcgtacggcattcggcgggggagtgcgggtcgatctgcagatactgctccgccaactcgtcgcgattcttagtgcgccaaatcgaagcgtagctcaggaagaaacgctgcaggccggtgaagccgtcgatttcaggagcatcggcaagcgcggcttcgatggcttccgtggaaccatccttgccgcggccggccgcttcatcgagagcgaacgcataggccttgagagcgatgttcacaccgctcaaatcgccgatgttctcgccgatggtcaacgcgccgttcacatgaggggccttcgacgggtcatccgaatacttttcggcgagctgcgtcggcacgaactcgttgtactggtcgatgagcttctgggtgagcgccttgaaattggccttgtcctcttcggtccaccagtcgttgagtttgccgtcgccgtcgtattgcgagccctggtcgtcgaaaccgtggccgatctcatggccgatcaccgcgccgatgccgccgtagttcgcggcatcctcggcatccgggttgaagaacggcggctgcaaaatggcggccgggaacacgatcacgttcatggacggctcatagtaggcgttcaccgtctgcggattcatcagccattcgtccttgtcgacggccttgcccaccttggccagctggtagccggtctcatacaggttcgcggcacgcatgttctgggcgaagccggcgtcctcgcgcacatccagcgcggaatagtcacgccaatggttcgtgtagccgatcttcggcacgaacttggacagcttctccaatgccttggccttggtctcgtcgccaagccaagtggaattggagatggacacacggtaggcgtcgatgagattgccgaccagctgctccatacgctgcttggaggtttcggggaagtgacgcttcacgtattcgcggccgacatcctcgccgcagatgccgttgaccagcgagacgccacgcttccaacgcacacgctgctccttctgcccggacagcgtcttgccgtagaagtcgaaattcgtttcgtcgaattcgtggggaagctccaatgtggagccgatcaccacatgcacgcgggcccacagcttgagatcatccagcgacgcttccttccagaacgcgttgagtccggtgaggaagcttggctcatgcacgatcgtgtggctgaaacagccgcggaaatccaacggctgcacggcagccgcggtggtcgcgtcgtaagcgttctgccaggcgtcgatccaagcgtccaggtcaacatcggcgagcatggcgcacaggtcggcgtaatccgtcgggttataggtcttcaccgaatcgcgcgtggacacgttgtcccaatggttcgccgcgatgcgcgtctccacgtcaaggaaacgcttggcctgcgcatgggcatcctcgtcatcggccgcaagatgcgcgttcttcagctgcttggcgaccatctcgacatacgcctcacggattggcgcgtaatggtcttccctgtagtaggcctcgtccggcagatccaaaccgtcctgttcgatgtgcacgacattggtctccggcgctcccggatctccgtaaacggcgatgccgatcaggtctggaccgccggtcgggttcatggcgccaagcgcgcgggtgagcgcggccttgtcttcggcctcgtcgatggaagccaactggtcttcgatggcggcgagtccggccgcgtcgatggcatcgacgtcaaggaaactatggtacaaagcgcgcgacttgacggctgggcaatcatcctcttcaaggatgtcgcggatctggttttccgcatcctcggcgagcttgtcgaaggaaccataccgggaacggtcgtcgggaagacggtacatgtcgacccacgggccgttgacgaagcggaacaagtcctgagacgggccggtcacggcggagaacgatgccggatcgatacccgaaaccaaagaattcgaagtgttgttcatggcttcacactatccatctttggtgacaacatcgtgtattcgaatcgaatattcgggtggaacgcaaggtggaatacagaaaggagaacatcgttcgccggtgtatggcccgcgaagtagggttgaaggcatgatcgaactgaaaacccctaaagagattgaagcgatgaagcccgcaggccgcttcgtcggcggcatcctgcgcgacctgaaggaattcaccaaggtcggcaccaatctgttggaaatcgacgaattcgtccacaagcgcatcgtggaccgcaagggcgcctcgtcctgctacgtcgactatgcgcctgatttcggcaccggtccgttcgcgcactacatctgcacgtccgtgaacgacgccgtgctgcacggcgttccgtacgactacaacctgaaggacggcgatctggtcagcctcgatctggcgatcaacgtcgacggatgggtcgcggattccgccatcagcttctgcgtcggcacgcagcatcccgacgacctgtgcctgatcaagtgcaccgaagaggctttggcggccggcatcgaagccgctcagccgggcaatcgtctgggcgacgtctcctgcgccgtcggcgacgtggcacgcgaatacggctacccgatcaacctggagttcggcggacacggcgtcggccatatcatgcacggcgatccgcacgtgccgaacgacggcaaggcgcatcacggctacaagctgcgtccgggcctggtcatcgccatcgaaccgtggttcctcaagaccaccgacgagatctaccaggatccgaaggacggctggacgctgaagagcgaggacggctcccgtggcgcacacagcgagcacaccatcgccatcaccgaaaacggtccggtgatcctcaccgtccgcgactagtccaaaaccttatgaaaacgggcttgtgcgattacgcacagcccgttttttcatgcccgttttgagacggaacccacatatcgaaacgcgcatgccatatagtgggcggtactttttgaactggtaaggagcgaacgagtatggccacagccaatctgagtgtggaatccaaggacttcaccctgccggtggtcgaagccacggcgggcgcggacggcatcgtggtgtccacgctgcgcaatgatggctgggtcacactcgaccccggtttcctcaccaccgcgcaatgcgaatcgaaaatcacgtacatcgacggcaagaactcgattctgcgctatcgcggctatccgatcgagcagctgtgcgagcagtccgacttccttgaagtcgcttggctgctgcgtcacggcgaactgccgaacaaggaccagtacgaccgtttcatctccgacatcaaccaccgcacgatggtgggggaggacttccgtacgttcatgggctccttcccgcgcaccgcgcatccgatgagtgtgatggcgtccgcggtcaacgcgctcgccacgttctacccggacaccacggacatcaacgattccgaccagctggacgaagcggcgaccatcatcatggccaaggcgcgcaccatcgtcagctacatcttccgccgccgtcgcgatgagccgatgctgtacccggactactcgcgtggctatgtcgacgatttcctgcgcatgtgcttcgccgtgccgtatgagccgttcgaatccgatcctctgtatgtgcacgcgcttggccgtctgctcatcatccatgccgaccacgagcagaactgctccacgtccgtggtgcgcatcgccggttcggcgcacgccaacctgtattccgcggtcgcggccggcatcaacgcgctgtccggcccgctgcacggcggcgccaacgaggcggtgctccgccagctcaaggccatccgcgactccggcaaaaccgtcaaggaattcgtggaggacgcgaaggccaacgggcgtcgcatctccggcctcggccaccgcgtgtacaagtcgtacgatccgcgcgcggcgatcgccaagacctatctgcagaagatcatggaacgcaccgacacgctgaagctgccggcggacgagcgcgcgctgttcgacgtggccaccgaactggagcagatcgcattgagcgacgattacttcgtgtctcgtcatctgtatccgaacgtcgacttctacacgggactgatctaccgtgcgatcggcttcgatccgtccatgttcaccacgctgttcgcgttgggccgcatccccggctggatcgcgcagtaccgtgagatgctcgccgacccgaacacgaagatcggccgtccgcgccaggtgtacaccggctacacggaacgcgattacgtgccgatggaccagcgccactgaacgatattgacacgcggctccggtttcggacgtgcgcatgcgcctgccatggcttgccgctacagtgtttcaaggaacgaaagaacctaacgaatcgctggaaccggtctacggctccggcatggtcaaaggagcgtacacatgactgaacagcgcaccgcatggggttggggtctggcaagcatcgatgcggccggcaacacccttgacgtgtggtatccggaactcacgttgggcgaggctccggctgaaacctcgcgtccgaatcacaacttcggcgccatcgcgcatgacgaggccgacgcgcgtggcgtgcgccgcatgcccgtgttcaccgtgtccaagctggacgagccgatcgaggacgccgccgacgcctatctgcgtctgcacctgctgagcatgcgtctggccaagccgaacacgttgaatctcgacggcattttcgccaagctcaacaacgtggtgtggaccaactacggtccgttcgccgtcgatgatttcgctttgcgcaagcttgacgtgatggccgccacccgacagtccggagccgtgttggcgccgcacgtcgatgtgaacgtgctgtcgattgacaagttcccccgcatggtcgactacgtcgtgccgaccggcgtgcgcatcggcgacgccgaccgcgtgcgactgggcgcgcacctgtccgaaggcaccaccgtcatgcacgccggcttcgtgaacttcaatgcgggcaccctcggcgtctccatggtcgaaggccgcgtctcgcaaggcgtcgtggtcggcaacggctccgacatcggcggcggcgcgtccatcatgggcaccctgtccggcggcggcaagctcaagaactccatcggcgagcactccctgctcggcgcgaacgccggcatcggcatctccctgggagacaactgcgtggtcgaagcgggcctgtacgtcaccgccggcaccaaggtcaccatctacgacaaggccaaggtcgccgccggcgaaccgctcgaaaccgtcaagggcgccgaactgtccggcaaggacaacatcctgttcatccgcaactccgtgtccggccgcatcgaggcgcgctaccgcaagaccggcatcgagctcaacgagaaactccacaagaactgaaaacggaatggcggagagcgtcatccgcgctctccgcaagaggaaactcgtgaaaatcacactgatcaccgtcggcaaggtcaaagagaagtatctgcgcgacgccatcgcggaatattcgaaacgactgggccggtattgcaagctcggcatcgtcgaagtggccgacgagaagacaccggagcatgccagcgacggactcgaacggcagatcaaggccaaagagggcgaacgcatcgccaaacatattcgtgacgatgcgttcgtcatcgccctcgccatcgaaggcaagcagctcaccagcgaacagctcgccgcgaaaatcaacgacctcggactccacggcaccagccatatccagctcatcatcggcggctcattgggactcgaccccgcgatcctcaaacgagccgactacctgctgagcttttccaaaatgacgttcccgcaccagctgatgcgggtgattctgctggagcagatctatcgcgcatacaaaatcaacgccggagaaccttaccacaagtgattttcgaggcgtttcgcaagaaacgctaagtaggggcgagccggtatagtggcgcgtatgagtgactacagggacgaacgcgagcagcgagaacgccgtcgccgcaccatggtgcgcacggtgtgcatcgtcatcgccgcggcgatgctgctgagtctggtcattcctgcgatctacgcggggctttgacgccttcgggcccgtatgatccgaaacgggccccggtttcccgtatgcgtgcggacaggttcgcggtccgtccatgtgggaaatggatgtgggcacgtggaaaaaccttatggattgtgcgggagccgtggacggctccatgtcagaatagtcaggaacgtaatagaaatgtatggtgtaaacgatggcagaatttgattactccgaggcgatcagcgaagcgcgcgccaaatacgagtccatttccaaggccctcgacgtcgatcgactgaccgccgaggccaaggaccttgaagtgaaagcggccgaacccggattgtgggacgatccggaaaacgcacagaaagtgaccagcaagctgtccgcggtgcagtcgcagctcaagcgtctggcatccgccgaccagcgcatcgaggacgtggagaccctggtcgagcttggccaggaggaagaggacgccgacacgttggccgaggcgaaggccgaagtcgaaagcatccaaaaggatctcgacgatatggagatccagacgctgcttgacggcgaatacgacgaacgttccgccgtggtgacgatccgttccggcgccggcggcgtggatgcggccgatttcgcgcagatgctgctgcgcatgtacctgcgttgggcggaacgcaacggatacaaggccaaggtcatggacacctcctacgcggaagaagccggcatcaagtcggccacgttccaggtggacgccccgtatgcatacgggcgactgagcgtggagggtggcacccaccgtctggtgcgtatctccccgttcgacaaccagggccgccgtcagaccagcttcgccgccgtggaagtggttccgctggtcgaagcgaccgatcacatcgacgtgccggattccgaaatccgcgtcgacacctactgctcgtccggtcctggcggacagggcgtgaacaccacgtattccgcggtgcgcatcacccacatcccgaccggcatcgtggtgaccatgcaggacgaacgctctcagattcagaaccgcgccgccgccatggccgtgctgcagtcccgactgctggtgctgcgccacgaggaggaagccaagaagaagaaggagctcgccggagacatcaaggccagctggggcgaccagatgcgctcgtatgtgctgcatccgtaccagatggtcaaggacctgcgcacggggtatgagacctcgcagacccaggctgtcttcgacggcgacatcgacgagttcatcgaagccggcatccgctggcgtcacgaacagcgtcgcgcggcagccgaggaacaagaagcctaagcgataggcggagggaaaacacgatggcgctgatctcgcttgaacatgtgagcaaagtctatccaaagggcacgcgtcccgcattggatgacatcagtcttgacatcgatcgaggtgatttcgtctttcttgtgggcgcgtccggttccggcaagaccaccttgctgagcctgctgcttcgcgaggaggaagccacggatggcgagatccgcgtcgccggcaacgatctgcgacgcctgtccgcacggcaggtgccgcattatcgccggcagatcggctttatcttccaggattacaagctgctcaacaacaagacggtatgggagaacgtcgccttcgcacttgaagtgatcggcacaagccgttccaccatcaaatcgctggtgcccaaagtactgcagacggtggggctcacgggcaaggaaaacaactacccccatgagctgtccggcggcgaagcgcaacgcgtcgccatcgcaagggcgtatgtgaaccatcctcagatcctgctcgccgacgagcctacgggcaacctcgacccgaccacatcgctgggcatcatggaagtgttggacgccatcaaccgtaccggcaccaccatcgtcatggccacacacaacgaagagatcgtcaactccatgcgcaaacgcgtggtcgaattgcacaccggcaagattgtgcgcgacgagcagcagggatcctacgattccgcgctgtatttcccggatgccgaagtcgagtcgaaatcgcaccaggcattgggcacttccgacccgaacgcgaaataccgtcgacagaacgccatcgattcaacgaacgctcctgacgacaccgtcgacgtggaaggcgcgacgcgcgccgaaaccgtggtgaacgccgtggatgtggtcgccgctgccgtccatgacggacaggggaacgacggcatcgcccgtcttgccaaatccgtgcattccggacgcaccggccgttacggcgaggccttcgcgtcagtggagaccaccttgacctggggcaagggactgagcctcgaacagatggccgaccaggaacaggccgagcaaaccgaacggaacgaacaggccaagacctccgctgaaaatgatgcctccgagactggtgccgacgaagcatcggcgctgtccgctccgcctgcaccgcccgttccaccgacccaaaccgagcctccgacaccgcccgaaccgcccgtcccgccggcaccgtccgatgaaaaccctgaggacaccaaggagcacgactgatgcgttttcgtttcatcctttccgaaacatggaacagcctcaagcgcaatgtttcaatgatcatctccgtcatgctggtcacattcatctccttcctgttcatcggcgtatccggcctgatgcaggcacagatcaccgccgcgaagggcgaatggtacgacaaggtcgaagtggtcgtatggctgtgcccggacggtgccagccaggcggcgtcctgctcgtcgggcaaggcgccttccaaccaggagatcgtcgatctggagaacgtgatcaacgaggaagccggcaacatcgtctccaaaatcacatatgtgagccgtgaggacttctacaagaacaccttcctcaagcagtatccgaacggcgaataccaaggacgcgtgctcaccgccgccgacatgcaggggtcgctgcgtctgaaactgaaggacccgaccaaataccaagtggtatccgaagtgttgagcggccgcaccggtgtcgaggaagtgcaggatcaacgcaagatcttcgacccggtcttctcggtgctgaaccgtgcgacggcggtcaccgtggcgctcgccggcgtgatgatcctggtggccatcatgctgaccggcacgacgattcgcatgagtgccgcctcgcgtaagaacgagaccgagatcatgcgactggtgggagcctcgaactggaccatccgcctgccgttcgtgttggaaggcgtgtttgcgtcgctgattggttcgctgctcgcctgcggaacgttgagcgccatggtgaagctgttcatcacggattggctgtcgaagagcgtgcagtggatgcctctgatcaaccagaagacggtatggctgcttgcaccggcccttgtggtgggagccgtcgtgctgtcgatcgtcgcgtccagcatctcgctgaggaagtacctgaaggcataaaccggcggagtgctgaacgagatgttcagcatatttgaagtttgctggatacaatgtcgaaataggtggatttcgggaagggaatacatgtctaggaaaatgacgagacaggtgcggcccatcgttggactgatgcttgcttcggctatgttctgcgccggcggcgtcgcggtcgtcgtcgcgccggctccgcaggcgcatgccgtgagcatgtcggaataccaggcgaaggtgtcgaaccacgccaagctgaagtcgcagcttgtcggcgtgagcagcgatctcgccgacacgattctgcagttggccgatttgaacgacaaccagattcctgcggcggtcgaggccgcggaatctgcccagcaggcggcagaacaggcgcagagcctggcggaagcgaccacgcagcggttgcaagcggcccagcaggacaaggcgaaccttgaggagcagatcaaacagaccggctccgactatgatgacgccaaggccgccgtcgcgcagctcgcccgcgaaagcttccacggctccagtacgtcggatgtgctggattttgtcaccgattcgacgaccgccgacgatttcgtcaacaagatgcagtcgcaggccgcggtcacgcgaagcgaatccaacgcggcaaccgacgcggcgaacgagctgaacacgtcgatgaaccgtaaggaccgtctgggcgccatcgaacagaagatcactcagctcaaggagcaggccgaccagcaggcggcaagcgcccagcaggcggcaagcgaggccagcgccaagcagaccgccctgcagaagctgcgtgacgagggcacggtgaaacgtgagaagctcgaatcgcagaagagccagctgacaacgcagagcgccaaggaagcggcggacatcgtcgccatgaaatcgcagatcgattcatggaacaaccagtacaacaattccaacaacgccgctgtcaaccccaataacaaccagcagcagtcgcgtccgaacaacaacacgaactacaatcccgctcccgcgcctgcacctgcgccggctccgacgcccaataacaacaattccggcggcgccggcggcatgaactatgcggtgcccggcaattgcccggccggttccggatactgctacggacacaacaccggcaacacggtcggcggtgccgcgtatccgtcccgccagtgcacgctgtgggcatacctgaggcgttcccagctgagccttccggtcggctcctacatgggcaacggcgccgattgggccaataccgctcgtggactcggatacctggtgaacaacaccccgcatgtcggcgcggcgatggtgttcgcgcgcggccaaagcgtaggcggacattggaccgccgactggcagtacggccacgtggccgtcgtggaacgcgtgaacgccgacggttcggttctgatctccgaaggcggcactggcttcgcgacgttcccggcttgggaaacgatctccaacgccggagcctaccagtacgtccactactgacggttccgttccagacatgaaaccacggcaagcgcgccgtccgcatcgtcgggcgacgcgctttcgtgatatggtcgacggagtcgcgttgcatacactgatcgaaagaaccgggaaggaggtccgacatggccaaggaacagggaaccaaaccgatcgcgcagaacaagaaggcgcgtcacgactacgccatcgaagacaagtatgaggccggtctcgtgttgaccggcaccgaagtgaagtcgcttcgtgaaggacgggcgtcgctggccgaatcgttcatcaccatcgaccgtcgtggggagatgtggcttgagggagccaacattcccgaatatctcaacggcacgtggaacaaccacgcacccaagcgcaagcgcaagctgctgctgcatgcggcgcagatcgacaagctggcccgccaaacccaggccaagggattcaccatcattccgctgagcctgtatttcaaagacggccgcgtcaaggtcgagatcgcgctcgcccgaggcaagaaggaattcgacaagcgccagtcgcttcgcgaggagcaggacaagcgtgaggcgctgcgagccatgcgatacgccaacaagcaggtgcgataaatcggaaaaattccggtttcacatagtgaaagaacgccgattcaggaaaatttttgtaacacaccctctttacgctaggatacggttcggctgaacaggccgatatgaatccataggagagggaacatgcaagcaggaaaagccctgaaaaccgccgccgcgttcatgttgagcgtggccatgctcgccaccggcgcggcatgcggcaccagcgacgacagcgacgcctcggcgtcgaaatccagttcgaagtccagcgaactgaccggttacgatgtttccggcgtgaagaaggacgacgcgatcgccaaaatgctgccggattatgtgaacaaggacggcaagctcaccatcggcatggatacgtcgtacgcgccggccgaattcctggccgcggacggcaagacgccggtcggcttcgacgtggacatcgccaaggcgctggccggagtgttcggtcttgaggccgatccggaaaccgcgaacttcgattcgattattccggccgtcggcgccaagtacgacatcggcatctcgtcgttcaccgtcaccaaggaacgcctcgaggcggtcgacttcgtcagccacttcaacgccggctccgcatgggccgtgaagaagggcaacccgaacaaggtcgacacgtccgatctgtgcggcaagaaggtggccgtgcagaccgccaccatgcaggagaccgccgccaacaagatggccaagcaatgcaaggccgatggcaaggcggagatggacgttatctccagcaagttgcagaccgatgtgaccaccaacgtcgtcaccggcaaggccgacgtgttctacgccgattcgccggtcgccggctacgcgatcgcgcagaccgacggcgaactcgaaacgcttggcaagaccgaaggcatcgccccggaaggcatcgtcgtcaagaagggcgaccagcagatggacgaggccctgcagaaggccctgcagaagctcatcgacgacggcacctacatgaagatcctcaagtactggggtgttcaggacggtgccatcagcaagccggagatcaacacccccggcaccaacgagtgactgtttcggaacttttgcgtccgttaatacgctcgtagcaatccgctcttaggttatgccatagccacgtttggctggttgatttggctgggttgaagagaggacttgccatgatgaggaacctgaaaggttgggcggcgctcgcgttgagcgcggcgatggtcgtctcgatgggagcctgcggaacctccgacaaaacggattcccaagcttccgtcgattcgaattcgtcgtcgaccaccggttacgacgtgtccggcgtgaagaaggacgagaagatcgccaagatgctgccgtcctccgtcaccaaggacggcaagctgaccgtcggcatggatacgtcgtacgcgccggccgagttcctggccgcggacggcaagacgccggtcggcttcgacgtggacatcgtcaaggcgttagcgaaaacgttcggcctcgaggcggatccgcagacgtcgaatttcgattcgatcattccatcaatcggttcgaagtacgatatcggcgtctcgtcgttcaccattaccccggaacgcatgaaggccgtcgacttcgtcagcatgttcaaggccggttccacgtgggtggtcaagaagggcaacccaggcaagatcgacacgtccgacctgtgcggattgaagatcgcggtgcagaccggcaccacacaggaggaggaagtcaacaagggcgccgaacagtgcaaggcggacaacaagcttgacatccagatcctgtccaacaagctgcagaccgatgtgaccaccaacgtcgtcaccggcaaggccgacgtgttctacgccgattcgccggtcgcgggttatgcgatctcccagaccgacgaccagcttgaggccctcggtgaggacgtcggcgtgaccaaggaggccgtggccatcaagaagggtgattccgacacggccaaggcggtgcaggcggccatgcagaagctgatggatgacggcacgtacatgaagatcctcaagcattggggcgtcgaatccggcgccgtcgacaaggccgagatcaacccgaccgatttgggctgatcggcgcactgacgctgcgggcgtaggggcatcggacgtatatagatcgatgcccctacgctttttgccgattaacgtcggcgtagcattgcggttttatcgtgtgcctttggaatactggacgtctgattggcaaatggacgattaccgttcagtggatgggaagagaatagaaggagaacccactatgtcgttgaaattcaaatcgtttgccgctctcgcgctgagcgcggccatgatgttctccgtcgccgcatgcggcaccacggattccggtgacgccaaaagcgactcgaaggcgaagaacaccaccgttggttacgatgtgagcaccatcaagaaggatgacgagctggccaagctggccgcctccgcgaagaccgtcaaggacggcgagctgtccgtcggcatggaactgtcctatgctccggccgaattctacgccgaagacggcaagacgccggtcggctacgatgtggacatgtccaaggccatcgcccagacgctgggcctgaagccgaagatcgtctcctccatgttcgacaccatcgtcccgtccatcggctccaagtacgatctgggcatcaccgccatgaccatcaccgaagagcgtctgcagtccgtcgacttcgtgagctactaccgcgccggctccacgtgggccgtgcagaagggcaacccgaagaagctcgacacctccgacatgtgcggcgcgaagatcgcagtgcagaccggcaccgtccaggaggacgaggccaacaagatcgccaagggctgcaaggccgacaagaaggccgaagtgatgtcctacaagcgtcaggccgaagccgccaccgcagtggccaccggtaaggccgacgtgttctacgccgattcgccggtcgccggctacgcgatctcccagaccgacggccagcttgaggccctcggcgacgttgaaggcgtggccaagcagggcatcgccatcaagaagggcgaccagcagctcgacgaggccgtgcagaaggccgtgcagaagctgatggatgacggcacgtacatgaagatcctcaagcattggggcgtcgagtccggcgctctcgacaaggctgagatcaatccgaccgacctcaactgatctcatcagatagatagaaaaaggaaacagcatcatggcgaagaaacaagtcgacggcgacggcctcgatattcccaatcgcattaaagccttgcccgtcaagcgtacgggtccgatcgtggcggccatcatcgtcgcgctcttcgccgcgatgctggtgcaggctttggtcaccaatccgcgtttcgaatggaatgtggtctggaaatacctgttcaacgagaacgtactggaaggcatcaagtacacgctgctgctgaccgtcatctcgatggtcatcgccatcattctggcggtcattctggcggtcatgcgcaaatccatcaacccggtgctgcgcggcgtgagctggttctacatctggttcttccgtggaacccctgtgtacacgcagctggtcttctggggtctgttcgcggtgctggtgccacgtatcggcgtgggcatcccgttcacctcaatcgaattctggagcattgactcccagtctgtcatcaccgcgttcaacgccgcatggctgggcttggccctgaacgaagccgcctacctggccgaaatcgtgcgcgccggcctcgaggccgtcgatccggggcagacggaagccgcaaaggccctcggcatgaagcgcacgctcatcatgcgtcgcatcgtgctgccgcaggccatgcgcatcatcatcccgccgaccggcaacgagttcatcggcatgctgaagaccacgtcgcttgtcaacgccgtgccgttcacgctggaactgcagttcgccaccacggcgatcgcgacccgtctgtacaagccgattccgctgctgatcgtggcgtgcatctggtatctggtcatcacctccatcctgatggtcatccagtcgcgactcgaaaagcacttcggcaagggcttcgacgcccgtcccgccggagcccgcggcaagcgcacgccgctaccgggcaagaccttcggcgaacccaaggatgacgtcgacaagcagaacgaagccacgttcgcgggaatgaccgcgtgaggggaatgaccatgagcgaaatcacaaccaacgaaatcgttcccgccgtcaaggcgacccaggtgcacaaggccttcggcaacctgcacgtgctcaaaggcatcgacatgaccgtcatgcccggcaccgtcaccgtgattctcggaccgtccggttccggcaaatccacgttcctgcgtctgatcaaccagctggaaaccctgaccggcggcgaaatcgacgtcgacggcgaaatgatcggctacaagtacgtcgacaaaggcggcgaacgtgtgctgcagaccctgaacgacaaggaagtggccgaacagcgttccaaactcggcatggtgttccagcgcttcaacctgttcccgcacatgacggctcttgaaaacgtcatggaggctccggtccacgtcaagcacatggacaagaaggaagcccgcgaactcgccattcaggagctgaaccgcgtcggcatgggggagcgtctcgactactatccggcacagctgtccggcggccagcagcagcgcgtggccatcgcccgcgcgcttgccatgaagccggagatcatgctgttcgacgaaccgacatccgcgctcgatccggaactcgtcggcgaagtgctcaacgtcatgctcgacctcgccaaggaaggcatgaccatggtggtcgtcacccatgagatcggcttcgcgcgcgaggtcgccgaccagatcgtcttcatggacggtggcgtggtcgtcgaacagggcggaccggagatcatcgaccatccgaaggagtcgaggtttaaggacttcttgcagcacgtcctgtagcaagtaaggctgtcgtactgccgtaaattcccaatccactgacgtcaagcgtccgcagacgtccggtgggttgggttttctttttgccgccgacgatgggcgcgttgcgtgcgtcactggttcgcacgatttccctgggggagtgggatttcgcatatatggcaaagatttgtaaggacgcgcggcttggtttcatgattgacatccttacccgataggctaaggagctatgtgtggaatcgtaggatatgcaggaaatgttcggaccgcgtgcggcaaacccttggaggtctgcctccagggtcttcagcgattggaataccgtggatatgattcggccggcgtggcgttgaccgcgcccggcatggaccatgtggcggtgcgtaagaaggccggccgtctcgccaacctggtgcaggacatcgaacgcgatccgatgccggaagccaccgtgggcatcggccacacccgttgggccaccaacggcgtgccgaacgacaccaacgcgcatccgcacacctcgcgtgacggcaaagtggccatcatccacaacggcatcatcgaaaacgcgtcccagctgcgtcttgacctgcagacggaaggctaccatttcgtttccgaaaccgatacggaggtcgcggcgaagctgctgggtaagatcagcgacaagatcatcgaagagaccggcaagcctgacctgttcaaggccgtccgccgtctcgcacgcatgctggaaggcgcgttcaccatcctcgccaccgatgtgcgccagccggacatcgtggtcggcgcccgtcacgattcgccgctggtggtcggtcttggcgaaggcgagaacttcctcggctccgacgtggccgcgttcgtggcctacaccaagcgcgccatggaaatcgaccaggaccaggccgtgatggtgtccgcagacaaggtcgtcgtctccgacttcatgggcaacatcgtgcccgatccgaagacctacaccgtggactgggatgcgtccgccgccgaaaagggcggttgggactccttcatggacaaggagatccatgaggatccggccgccgtgcagcgcactctgctggggcgtctcgacgagaacggcaacatcaacctcgatgaggtgcgcatcgacgagcatgatttcaaagccatcgacaagatcatcgtcatcgcctgcggcacggccgcgtatgcgggcatggtggccaaatacgccatcgagcattgggtgcgcattccggtagaagtggaactcgcccacgaattccgctaccgtgacccgatcctcacccccgaacgttggtggtggccatttcgcagtccggcgagaccatggacacgctgatggcgttgcgccacgcgcgtgaacagggctccaaggtattggccatctgcaacacgcagggcgcgtccatcccacgcgaatccgacgcggtgctctacacccacgccggtccggaagtggcggtcgcctccaccaaggcgttcgtggcgcagatcaccgccgcatacgtgctcggcctgtatctggcccaagtcaagggtgccatgtatcgagacgaaatcgcccagactttggaatctctgaaggacatgccccgcaagatccagtggattctcgacacccagaccaagaccgtgcaggaagccgccgaacagatggtggatgcgaaatcgttcctgttcctcggccgccatgtgggctatccggtggccatggaaggcgcgttgaagctcaaggaaatcgcctacacgttcaccgaaggcttcgccgcgggcgaactgaaacatggtccgatcgctttggtggacgaaggcgaaccggtcgtattcatcgtgccgccggcgcgcggccgcaacgtgctgcactccaaagtcatctccggcatcgaagaggtcaaggcccgtggcgcctacatcatcgccgtggccgaggaacacgatccggacgtggaacgttacgccgacgtggtcttctggcgtcccgcatgcccgacgctgatgagcccgctggtggacgtggtgccgctgcagctgttcgccatggacatggccaagctcaagaactacgacgtcgacaagccgcgcaatctcgccaagtccgtcaccgttgagtaacgaacgcaggcaccggtacgtgctcgaggaacctcatattcccttcgaatatgaggttctgtacgaggacgagaacatcatcgtcatcgacaagccgcatttcctcgccaccacgccacgcggcatgtggtatcgcgaaaccgcgctggtccggttgtgcgagcggtacgacgagccgaacatcacgccggcgcaccgtttggaccgactgaccgcaggcgtcgtcgtgttcgtacgtaatccgtctgcgcgaggcgcgtaccagatgctgttccaaaatcgcaaaaccgtcaaaacctacgaatgcctggcaccgctcgccccgacgcagcggccgcgatatggaacggcggtgcgcatcgaccggcacctgccgtttccgctggtacgcaggtcgcatatcaacaaggatcgcggacgattgcaggcgtacgaaagcgccgacgtgcccaacgcggaaacgctgatcgaacggggaagcggcatccgcttcgttgccggcagaccgtacgtgaattacacgctgcatccgaaaaccggcaagacgcaccagttgcgcgtgcatatgaattcgctcggactggcgatattgggcgacgatttctacccggacatcgtgcagcgcgcgtacgacgacttctcgcaacccttggaattggtggcgcgcgaactgcgattcgatgacccgctcaacggcgagccacgtcgattcgtatcgcacgtgccgttgggcgcgggcttatagaaacccacgattttggacattcccctatctcgcccgacacgcccgattatcatggcgttctgttgacttgccggagcgtttccggcatcacgagagtaagagagaaccatgggtaaaatctcgaaagccgtccgcggcgtcgccgacatctacaacggcgcatcgctgatcgtccgtatcatcgtcggcctgatcatcggcaccgtgctggcattgaccatgccccacgtgacctggatcggcgaattcggcaccctgttcgtggccgcgttgaaggccgcggcaccgattctggtgttcgtactggtggccagcgcccttgcgcagggcacgtcgaaactcgaccgccgtttcggcaccgtgctgttcctgtacctgttcaccacgttcctggcagcggtcgtggccgtgctgacctcccgtctattcccgcagaccctgtccttgggcaaggccgccaaagccgacgtggtgccgcaaggcctttccgaagtcatccagacgctgctgaccaacatcgtggccaatccgatccaggccatcatcgatggcaactacatctgcatcctgatgtgggcctgcctgttcggactcgccatgaagtccatcgccaacgaaagctccaaagcgttcatggccaacgtggccgacgccgtgtcccaggtgatccgctgggtcatcaacctcgccccgttcggcatcatgggcctcgtgttcaccaacgtggccgacaacggcctgtccgcattcaccaagtacggcagcctgctgctcctgctcgtcggcaccatgctgctcatggtgctcgtgttcggcccgctcgtcatcttcatcttcctgcgccgcaacccgtacccgctggtctaccgctgcttcaaggaatccggcctgaccgcgttcttcacccgctcctccgctgcgaacatccccgtcaacatgcagctgtgcgagaagctcgggcttgacaaggacatgtactccgtgtccattccgctgggcgccaccatcaacatgaacggcgcggccatcaccatcaccatcatggccatggctgccgccaacacgctcggcatccagatctccctgccggcggccatcctgctgtccgtggtctcagcgctcggcgcatgcggcgcgtccggcgtggcaggcggctcgctgctgctcatcccgatggcctgctcgctgttcggcatcagcaacgacatcgccatgcaggtggtgggcgtcggcttcatcatcggcgtcatccaggattccgtggaaacctgcctgaactccgcgtccgatgtggagttcgcggccaccgccgaataccatgcctggctcaagcagggccgtcagctgccggccttcatgtattccaagaaggaacgcgccaagctcggcatcgaagcttgattgcgtaccggcttagccgccgatgcgatatcgcagggaaccgctttggaagttcgcttccggagcggttcttccgcattcggcgtatttgggtggatatggggagcctttccaggcttgtgcgtggcttccgcatgacccgtataatcttatggtggtaatcgcaggcgaaatacaaaacggaggtccgtgggcgtggtgctgaaatcggcgaaactggtgaagcagctcatcgccatctgctgcgcgggcgtcatggcgtccagcgccgccgcatgcggggccaatacggacacacgcacacagatcaccgtatggtcgtgggagccgagcatgaaacaggtcatcgccggcttcgaaaaagacaatcccgacatccgcgtggtttggaagaacaccagcggttacgacaaactcaacaacgccatccaagacggttacggcattcccgacgtggtgcagctggaatattacgcattgcgccagtacgcggtcagcagccagctcgtgcccatcaccggcagaaccgaaggctatgccgatttctacacgcccggcacctgggcgtcggtgcagctcaacggacgggtgtacgggcttcccatggactccggcccgatggccttcttctataacaacagcgtgttcgaacaggttggcgtggacgcgtccaagatccgcacatgggacgactactacgaggccgccaaaaaactcaagaaaatcggcgtgtacatcaccgccgattccggcgacgccagcttctacgacacgatgatctggctcgccggcggacgcccgttctccacgtccaacgatggcaagaacgtgaccatcagactcaccgaagataaaggcacccgcgaattcaccgaattctggcagaagatgatcgatgagggtttggtggcaacaaacctcacgtcatggtcggatcgatggaaatcggccgtgggacaaggcaaagtcgcctcgctgttctccggcgcatggctgccttcgctgctcatgtccgacattcccggcgcggccggcctgtggcgcgtggcccagatgccgacgcccgacggcaaggccaccacatcggaaaacggcggttcggcccttgccgtgctgcaacgttcccgcaaacccgaagcctcataccgtttcatcgaatacgcctgccacaatgccaaaggcatcacaacccgcgtggatggcggcgcgttcccagccgacaaaaacaccctatccgactcgaaattcctcagcaagaccacggtgaccgacgaccgtggcatcgaagtgccctatttcggcgggcaggaatacaaccgcgtgctgtcccaggccgcggagaacgtgtcgaccggataccagtatctgccgttcgaagtgtatgcgcgcagcgacttccggtccacggtgggcaaggcctacaaatggtcgagcctgctgcgcaaagagcagaacaggctcaacatcatcgccgcaggcggtcaggtctccgacacctccaacatcggcgatgcgttgaagaacaccgaatcgtccgaccgcatcaaacttaagggcggcatagccctatggcagaaggacctgaaagaatacggagccaaccagggcttcaccatccaatagcgtctgtgtaattggtttaatcgattgcggcctgcggatagcgcattatccgcaggccgtcggttttcagattgccgggctatgatcgccggttcccgtcgctggctcttgaatcagcggacgttgcggtcgtagatgtgccacatgcccttgaaaatcaggtccggatcgtaaatgtcgatcatgttcgtgccgtcggcgaacacgcggctcaatcctcccgtcgccaccacacggaaatcctcgtcgatctccttatggaactgcgcgatcgtgcgttcgatgccgccgaggaagttgtagtacaggcccgcctgcatggccggtttcgtggacttcgccagaatcgacttcggacgggtgatctccacttccggcagctgcgccgtcccttcccacagtgcggccgcggcggtgcggataccggtggtgatcagtccggaaatcaccgacgcgtccgcggtgacgtagttgaacgtggtggccgtgccgaaatcagccaccagaatcggcccgccatactcgtaatacgcgcccgcgcagtcggcgatgcagtccgcgcccatgttctgcggattgtccatgcggatgttgagtcccgttttgatgcccggtcccacgatcatcggatcgatgtcgaggaacttcacgatgctcgcacggaacgaatgcatgaccttcggcaccacggacgaaatgatcacatcatcgacatccgccggcttgtagccgctcaaagccaggaactgcgtgatcatcagcccgtattcgtcggacgtgtggttcgccttcgtggtgatgcggtacgtgcccgcgatgcgcccatcgtcgatgaaaccgatcacgacgttcgtgttgccgatatccacagccatcagaagcatgttgcgttctccttcgcgttttgcggaagttccgttgaaatattgcgattattgcgattgatacggttattgcgattcgaaaatgctgcggttagcgccgttcgccgtccgcacgcatggctgcgagcttgacaagaatacgtttcgcaagtgcgtccttgcccatcttgctccatcgttcgatgcttggcctgtctgcggtttcgcccggcgtcagcaccgtcaccacgttcgtgtccgctgcgaaaccggcgccgggggtgcgcagattgttggccaccagcatgtcgcaatgcttgccgttaagcttcttcgccgcgttggcctcaaggtcgcgcgtctccatggcgaatccgcacaatgtctggtccggccgcttatgctcgccggcccaagccagaatatccggattcgacgtgagctcgagctcgatgccgctgcgcccgttcttcttgatcttgtcccgggcctgctcgaccggacggaaatcgccgacggccgcggccatgacggtgatgtccgtgtccgagaaacggctcgtcaccacatcgaacatatcccgtgcggtcgtgacatcgaccacatccacgccatacggggcgtccaacgccaccggaccggacacaagcgtcacctgcgcgcccagattgcgtgcctgttcggccaaggcataccccatcttgccggtggaatggttggtgaggaaccgcaccggatcaagcggctcctgcgtcgggccggcggtgacgagcacggcaagtcccttaagcggcagctcgccgtccggacgattcgcaagcagcagcgctttcaccgccgtttcgatgcgtgccggctcctccatacgtcccttgccggcgtcgccgcaggccagcatgccgctttccggctccacaatcgtccaaccgagctcacggcaggtattgagattgcgttgcgtcacggcgttttcatacatatgcacgttcatggcggggcacaggatcttcggtcccttgtcgtacgcgagtatggtgctggtcagctggtcatcggcgatgccgcaggcgattttcgcgatgatatcggcgctcgccggagcgactgccagcagatccgcccacttcgcgtcggccacgtggctgatctgcagcggaccgtccggtccgggtgccacgtcggccgtagcgccgggacgatgtccggcggcgaacatggacatgcgtgtcggcgtgtgggtgagggaactgaacgtcaggggagtgacgaactcctgtgcggcggcggtcatcaccacacgcacctcatgcccctgcttgctccaatcggaggcgagatggcaggccttgaacgcggcgatgctgccggtgacccccaaaagaatatgcgccatggatcaaccgtccttctcgttgtgacctgccgcgactgcgtcaagtatataaccgggccgaagcctccgcgcgctttgcgggcgaatccgaacgggccgcgggtatggcggacggtagaatcaggccgtggtgatcgacctcacgcaggcggtcaaccgcaatcacaacacataatcgaaaatacgaagaggagaaatcccatgtcgtcacctaccggtgcgcacggcgaagccgacgcaaccaaacaggagaacgaacagcagccgcagtccacggcaagcaccgacgccacgctgaacgcgcgtgcgaaatcgtcgaacggcgcgaaatcgcaaggcccgaagaagtggcttatcgcgttgatcgccgtcatcgccgccgtcgcggtgatcgtcgccattgcagtgacgcgcggcaaaaacgatgacgcgaacacttccggcgtaactaaagccgacaccgtcaccatcgggctcaaactcgccccggtcagcctcgacatccgccaccagtccggatcggccatcgaacaggtgctgatcggcaacgtctacgaagcgctgctgtcgcgcgactccgacaacaaagtgcagccgggcctcgcgaaatcctgggacatttccaaggacggcaagacctacaccttccatctcaaccagaacatgaccttctccaacggcgacaagctcgacgctgacgacgtggcctggtccatcaaccagctcaaggagaagcagtactacaacgccaaccaggtggccagcctcgacaaggccgaagcggtggacgccaacacggtcaagctcaccctttccacccccgactccaacctgctgtggtatctgaccggacgtcctggcctcgtgttcgacaaaaacgccaaatacaacgcgaaaaccgaagcggtcggctccggcccgtataccgtcgaatctttcgactcggccagcaaaatggtgctcaaagccaatgcgaaatattggggaaccgcgcacaagcccgccacccagaacgtggtgatccgcttcctcaccgacgacaacgcagcggtcaacgcgctgaaaagcggtgacgtcgacgtgctttccccggtgaacgccacgctcgccaaatcattggatgccagcacatacacggtgtccgcggccgacggcagcgacaagttcgtcctcgccttcaactgcacgaacgccaaactcaaggacaagcgcgtccgccaggccatccgctacgccatcaaccacaaggagatcatcgcctcccgaggcaacgtcgactacgcgctcggcggtccgatcccgtccgtcgaccccggttacgaggacctgaccggcctgtacccgtacaacgtggacaaggccaaggaacttatgaaggaagccggttataccaccgacaagccgttgcggctcaccctcacctacgccaacacgtacggcaccgaactgggcgaccagctcaagagccagctcgccaaaatcggcatcgatttgaagatcgactatgtggaattctccacatggctgcagaacgtgcacgccaacggcgactacgagctgtcattggtggaccacgccgaaagccacgacttctacaagtggaccacgccggactactactaccattacgacggcaagcaggcgcagaaactgtacgccaaggctttggaagccaccgacgaggccgacagcgcgaaatacctgaagcaggcggcgaaggccgtaagcgaggacgcgccggcggactggctgttcggctaccgcgtgacggtggccgtcaacaagcacgtgcagggcttccccagcaagctcagtcagacggtgctgccattgtggcggatctccaggaataagtaagggaacggtatttccatgcgattcgtgggaaagcggctggcgctgttcgtagcggctttggtgggcctgtccgcgctggtgttcgtgatgctgcgcgtattgccgggagacgtcgccgcggtcatcgccggcacgaacgccacccccgaacgcattgcgtcgctgcgcgccgaattcggcttggacaagccgctcgtcgcacaatatggcgattggatggcgggcatgctgcatggcgacctcggcgtgtccgcagtcggcggacggccggtcgcgcggcaggtcgccatgcgcgccgccgtaacgttccctctgattgtgctgagcctgctgatcgcgctggcgatcggcctgccgcttggctgcgaggccgtcctgacacgcaatccgcggctgcgcggcctgttccacggcattgcgatcgtgggcggcgcggtgcccgcattgtggggcggcctactgctgatcctgctgttctcccgtggcaggggactgttgggattgctgcccgcgcaaggcttccccgacaccggctgggccacgccgggaaaggccctgtcctgtctgctgctgccggcgctcaccaccggcatcacagccggcgcgtccatcatgcgctacacgcgtgccgcagtgggggatatggcctcatcgcaggcggtggacatggccatggcctgcggcatgacccgcaaacaggcggtattgcgcgtggcgttgcgtctggccactgcgcaactggtgtcggtggtcggcctgaccttcgcgcaaatgatcaccggcgtgatggtggtggaaaacctgttcgccctgccgggtcttggcgccatgctggtcaccgacgtcggcaaccgcgacttggtcgcggtgcaaagcgaactgtttctattggccgcattcttcctgctgttgggactcgtggtcgatatgacgcatcgcgcgctggatccacggctgaaggcctccggcgtcgtttcggggaaggtgaacgcatgagcagatcgaatcctacgcaaactccgaacgctacggatggtgaagaatcagcgtccacaacgccagcggaagctactatgagcacgacgggtgcggtcgtctcgtccatctgggccaaggcgagcggcagatacgcgacgatcgtcatcggactatggctgctgaccgctgcggtgtccttggtctggacgccgtattcgctgctcgacaccgacggtttcaacgcgtgggcctcgccatccgccgcgcatccgttgggcaccgatggtaccggagcggatgtgctgagctggctgatggccggctcccgcacgaatctcatgatcgccgtgctcaccgtcgtcgtcgcggccgcgatcggactgctgttggtggcagccatggtatcgcgttccggtgcgctcgcgtccacatcggtggtggtggccgacgcgctgatctccattccgacggtgcttatcgcattgattctttccgtgccgttcggcgcgtccgccgcggtggtcatcgccgcctgcggttgcgcgtacgggctgaacctggcacgcatcctacggccctccgcactgctcgccgcacgttcggcatacgtcgaatcggcattatggtcgggggcaagctccgtccgcgtgttcttcacgcatatcgtgccgaacacgctgccggtattgtgcgtgcagttgtccatgagcgccggcacctcgctgctggcggaggcgggactcacgtatctgggcgtcggcgtcggagccggcgtgcccagttgggggcattcgctgtccacgtccgtgaaattcatcagcatctatcccatggccgtcctatggcccggcttggtcgtcacgatggtggtggtcgcgttgaacctgttcggcgacgcgttgcgcgacgcgctcgatccgctaaccaatcccgcgttgagggaggccgcatgagcgccgtcatacgtcatctgaacatcgccatcaacggcaagccgatcgtcgatgatgtcgatttggacatcgccgacggcgaacgtgtcggcttggtcggctcgtccggttccggcaaatcgatgatcgcccgcgccatgatgggcctgctgccggctaccgcacaggtgacgggcagcgtcgaattgggtggtacgcagattgtcggcgcgtcggacgcagcggtcgccgacctgcgcggacggtacgtgggcatggtgttccagaatccgtccgccgcgttgaatccggtgatgaccgtggcgcagcaggtcggtcttccgctgtacctgcattacgatctgtcgctcgccgaacggtcggaacgcgtcacagcggtgcttgccaaggtcggcctcggcgaggacgtgctggtgaaatacccgcatgaactgtcgggcggccaacggcagcgtgtcggcatcgccacggcgcttgtcacttcgccgcggctgatcatcgccgacgagccgaccaccgcgttggattcgatcacgcaacggcagatcgtggacctgctcacgtcgctggtggacgagtcgggcgcgtcgatgctgttcatcacgcacgatttcgcggtgctgaacagggccaccacacgctgttatgtgcttgaatgcgggcggatcgcggaatccggcgatacggacgcgcttctggaccaaccgcgcaccgacgcgggacacaggctggtccggtcggcccgcgcgttgtcgttgcacgcagggcaggatgccgggcgggaatccgtgcggaatcccgcgcaaaaggaggtggaccatgactgacgtgaacgaaggaatggtgctgcgcggccgcggcctcgacaaatggtatggcgcgaaacatgaccgccgtcaggtgctgttcggtgtggatgcggatgtacgggcgggggagtgcctcgccgtgatcggcggctccgggtcgggcaagaccacgctgacccgcgtgctgctggggctcgaatccgcggacggcggcagcgtcgaatactgcggcgagccggtccgtggcgacgtggcgcacagtctgcgcctgcagtccggattggtgttccaaagcccgttcgattcgttggatccgcgatggcgcatcggccgatccataggcgagccattgcgaatgcatcatccggattggccacgggaacgcgtcgcggaacgtgtgaccgaagtgctggaaatggtgagcctcgatccgggaacgttcgtcaaccgtttccctgtcgacctgtccggagggcaggcgcagcgcgccgcgatcgcccgcgccatcgtggacaagccgaagatgttgctcgccgacgagccgatgagcgccatcgacgtggctgcaagggtccggatcctcgacgcgttcgtcgcgattcgcgaatcgcagcccgatatggcgatcatcatggtgtcccacgatctgggcgtggtgcagcacatcgcggaccgcattctggtcctgcacgacgggcgcgcggtcgaagtcggcccgacggaccaggtgctgggccatccgcaggacgagtacaccaagcgattggtgcaggccgcctcgctgtaggtgtcgctccgcatgcctcattcgtgcgcgccataccgtctcgcatattcgtggtgcgtctcttttctataacgatttgaccgattgcgtgtcggtcgatattgttggttacatggttagttagttatgtaactaaccatgtaaccaacaggatggatggtccggcatgaccggatgttcatgatcgggggactgcgatgacgcatggaacatatcaaagccacgggatgcaacggccacggcgaatcgtgacaatactgacggttcttgctttgagcatatcgttgggcgcgtgcggcacggcaggagatcggaagcaagagcagtcgtcacggggccaggcgtccgccatcagcggcgatgcggacgccaacgccgcggacgcgtcgtatcgggacgaaatcgcaaaaatcaagaactccggtagcactgaagccgcccagattctcgaggacggcaaaatcacggaagaggagttggtccagctcggttccagctacgcgcaatgcctgacctcgaaaggcatcacagtggacgccggcgaggcgcgataccccggtgggtcgatcggcccgtcctacggagacgacgcgcttgacaagcgcaacttgagcgaagatgagattgccgccaccaatgccgctgacgaagcctgccagaatgagacccaatacaagaacatcgtcgacctgtatctgagcctcaaggagaatcccgagaacgtcgataacgaccaactcgcgcgccagcagaacgacaagacactggcctgcctgaaaaaacacggcatcgtggacgactccgtgaccgccgacgcctacgacgagctggcgacgatgggcgaatccggcggaacgagcttcgatgacctgatcggcaaatacgccctcaaggacaatcccgcctacgacaaacgcaaagcggccatcatcgaacaatgtggggcattgtgatggcgggcggcaaaacacccgtcagagcatggtcgcatgttcggaaccgacggacggatgcggatggaaagcggtggccggcgacgcgacgacgtcagccattggccatgtcggtcgtcgcgctgttggtggtcatcgcattggcggcaggcgtcggatgcggattcctgctggtccgaccggccataccccaatcgttgcgatcctcaacggcctccggctcgatcactgcggcgaaaagccggttcgatgatgcccgagacgtcaccgtcacggtccataccggaacggggcgcaccgtggcctcgcccaaatcgggcaccatcaccgcctatggttgcgcgcccggacaaaccatcgattccggaacaagcttcatcgcagtggatgaagtgccgctgctgtcgttgcataccgccgttccgccgttccgcgacctgcagtccggtatgcgaggccgcgacgtggcggcgctgaacgccgagctgcgacggcttggatatgcggcccccgacggcgatgcgatgacctgggacacgattctcgcatacaatgcgctcgccgataccgtcggcgcggcacggctggtcaaggacaacgggtggacgctagccaaagacgcttacgtgtggttggatgggcaatccgtgacgatccgttcctgcgttgccggcatcggcgcatcaatcgacgtgaaatccgaactgttgaccaccgattcgcaatcgcaatcggtatccgtgaccatgccgcaggacgaggtggtcgcaggagatcgggtgcttgacgtggacggtcgaatggtcgacatgccgcaacaaacgacggcaatcaccgactcgtcgacgctggctgcattgctgggcagcgacgcctatcggcaggcgtccggcacagctgagtcctccgagagcgcgtcggatggcgcgtcggatgtgaccttcaccctgcaatggcgtctaaaaactccaatcgatgtatggtcgctgccacccaccgctttctacgcgcaacatgatgaacaggcctgcgtggtgtccgatggcaagcccgtcgcggtcaccgtgatcggctcccgtttggggcgctcaatggccacggtcgattccggcgcggcattgggcaaagtgcgcacgaatccgcaaggaggcaaaccatgccgatgagtgatcccgttgattccacgggtcctctgatgaagggggatgatgagcggacgccgggaaaactggtgacgttgcgcgatgtcggtcacacattcactggagacacttggctgttccgttcgttaaatgctgacctgcggcccgatcgcgtgtacgcgctggtggggccttccggttcgggcaaaagcacattgttgtccatattggcgggatgggtgaagccgtcggaaggatccattcagcggctgaacatcgggaaaaccagctgggtgttccaaaatcccatcggagtggcgcgccgaaacgtgatcgaccatgtgactctgccttatcttgcgcgggggttggatgtgccgcaggcggaggcatgcgcgcgcgagctgcttgcccagttcggtctggcggagcgcgcgtccagcgaataccgggagctgtccggaggagaggctcaacggctcatgctggcgcgtggcgtggcgtcgggcgccgatctgctgctggtcgatgagccgaccgcgcaactcgatgtacatacggcggatacggtgaatgcgcgactgggcgcgttgtcaagacagggcatgatcgtggtggtcgccacgcatgatcatcgcacgcgcgacgccgccaccgatgtcatcgatttggaggattaccaatgaaatcgatgcggttgaaagcggtgctgcgtgagacttggcgcaacgtcgccactggtacgagccgatgcgcgcttatctcgctgctgctgtcgatatgcgcggtcgcatgcatgtgcgcagacctgacgcagatgacggggttgatcggcgacgcctggaaatggaaggaatcaggtgcctccacctatgcgatcactttgcagggaggaatcgacggcgcggcctgcgaagggctgcgttccgcgaacggagtgttgggcgccgccgccctccggcagtcgtccgaccgcgtgcgcatcgcgtcattgcccgcgaccgagattccgacatacgaggcaagcgcacatgtcgcgcaggtattcgcggcgacagggatacggaaggacaattccggtgtgatcatgtcgacggctgtggcgcgcacgtatggcgcgcatgccggcacggtgctgccgctcgtcggtggcgcacgcatgcgtgtttccgcgacgttcgattggccaagcgacggaaggcaaccaacatacggctatgcgattatctcgcccggcaacgataccaaggcctatgacacctgtctggtccgtgcgtggccggttcccgacggtatcgaaagcctgctgcgtgtctccattcgcgccgatgccgaatccggtgtcggcgccgctgcgagctccacctctgccgggacgagtggaagcaacgaaacgccgcatgcgaaaatcagccggatcaataccatgctggggtcgcatatgcctggcccggcggatttcgatgcccgcatcacccggtatgcgccactgttgatgttcgtcatcgcaatggcgttggggttcgcatcggtttgcatgcgcagaatcgagatagcgagcgcgttgcatgcggggtatccgaaaaccgcgatgctgctgcagctgtctttggagacgctggccacggtggcggcgtcttgcgtggcatgtctgccggttgtcgcgattgtgccgctcatattgaccggatccggtgacgcgatgccggttgtcgcgatgctatgccgtgttccgggcgccatgtcggtcgggatgcttgccgggactgcggttgggggtatgacgatccgtgaacggcagttgttcgcctatttcaaggcacgcgcatgacgtgtgccgtgtccttgagagatgcttcgccggctgttcgttgccgcatcgcggcagaccaacggttagagtggatgacgttgatattgaaccgactaggcggctggaggcgtcggatgcgattcgatttttcgggaacgacgccattgttccggcaggtggccgaacaaatcagcgaagctatcgtctccggtgccttcgcggaaggcgaacaggtgcccagcaccaccgagatctcgtccacgtatgcgattaatcccgccacggtgctcaaaggcatgaatctcctggtcgatcagggtctgctggagaaaagacgcggccttggcatgttcgtcaccacgggagcacgggagaaggctcgtgacgccaaacgcgaggaactgctcaccacgcgggtcgtcgaactcgtcgcgcaggcaaaggcgcttggcatcagctgcgaacaactacagcgcatcatcggaaggacctatcgatgagtctggtcatcagcgatctgagcaagagccgtcatggaacgtccctgctcaacggagtgaatctggaattacggagcggtgcgatacatggtctgttcgggcgcaatggtgccggcaaaagcacattgctgaacatcatcgcgaaccgactcgtggccgatgccggcagtgtgtcgttcgacggcaaccgtatgacggatggcggcggcatgtgggaacgtctcatgctgatggacgagacttggccatatcctgtcgaatggcgtctgcgatcggtgttccgtctgatctcgcggcgatacggcggattcgatgatgtgttggcggggcgtatgatgcaggctttcgggctgcggcctgatgctcgtttcatgagactgtccaccggtcagcgtggcgcggcgaagctggttgccgcgctttgcgcgccgaccgatatcgtgttgcttgatgaagcgactgatggtcttgacgctgcggcccgtgacctgtgttaccgcttcgtgattgagtcgtatggcgacagacctcgcaccatgatcatatccacccatctcataacggaggtggagggactggtcgaacatgccgtggtcctcgaccatgggcgggtgctggaatccttcgacatgaacgagttggcacaacgtgggcggatgctgtcggggccggtcggatcggtgcggcggtacttggccgacaatggtttgcgtacgctgtcggaaaccgttctcggtggtctgctgactgtcggcgtgcgtggcgtgccatctgcaccgatgccggaggacgttgtcatgaggtctttcgatctcaatgagtatgtcatccagattaccggcatggacaaggggtatgcgtcatgatggatgaagtgaaaggcttgtcggccgggatgcggttcgcgctgacaaggcagcttgccgcgcgttgcgtcgtgttgatggcgtacgtgttggccggttattgcgtgccgtggctgtggggtctgattttggccttggtatccggaggtcattatgtggtggaataccatgtgcttggcccgacgttggtgatgtgcgcggttctgacggcggttccggctgtcagtggctttcgttccctgatatccatgggcgtgggccgggccgtgtatttctggaccgagatgttcgccaatctttgcttctcccttgcctgctcggtggtcatgacgttggggttcgtgctgacgccgaaccatgatgccgatatcctcatcacgttccgtgtcggcagtgacctgcagtggctggcttgtgtgccaccatccgattcattcggacgattgcgattcctgaaccgtgatctgggcggttcatacgcggccatgagaacaggcgtgcgaggcgatacggccaatccgatgctgctgttcctggcgctgttcctgttgaccgcctcggtggcgattctgggtcaatgcgtcggggaactgctggcgcaggtcaatcggtacggggcaatcgccctggcggtgtcggcatgcatagcatgggtcgcgcgtccatggctgttgaacagaaccgccaccgatgtcaatccgatgatatggaaactgctcgaggcactgcggggacgctggtgtctgatgtggcgtgaggggcaagcggcgtccgcggcgatgtacggaacgtccaacgagcgtctcgtatacgatcaggcctacacgttctggccgatgatggtgcttttcgtaggtgtgatgatcttcggcaacttgttgtgctggctgttgatccggcgtcgtgaggtgcgtgttccgcagttgctgccggtatggtggtgacgatgctcggcatgggcaacacgccgatgtccacgtccgtgctatcgtatgagccatgttcaatttctcatgttgttgctgtcgctgaccaaccgcccgaggggcgcgtggttcatcgacgcataacttgagataggacattccaacaagcggtcgcgcatatcgcaggccgtatgcgaatcgccaaacgatcattcgaaatagcgcatcagccgaggttggcgcacgcgacgcacgcgaatgagcaaggcagcatcgcaacaggtcccgtttcaacaactgcacgcgacggacgcgagcttctcgaacatacgaaaccaaaaccattcgaaaagcccacgaaccgcaccgtgcaaaggaaacgtcatgaccatccacaattccctgtccgaactcatcggcaacaccccgctcgtcaaactcaaccacgtgactgacggcatcaaagccaccatcgcggtgaaggtcgaatacctgaacccgggtggctcgtccaaggaccgcatcgccgaacgcatcatcgacgcggccgaacgcagcggcgaactgaagcccggcggcgtgatcgtggaaccgacctccggcaacaccggtgtcggactcgcgctcgtggctttgcagcgcggataccgtgcgatcttcaccctgccggacaaggtttccgaagccaagcgtgcggtgctgcgcgcatacggcgccgaagtggtcgtaacccccaccgacgccggtccggacgatccgcgctcctactaccaggtggcagaccgcctcgccaaggcgattcccggcggctaccgtcccaaccagtacgacaatccgaacggtcccgaaagccactatcacaccactggtccggaaatctgggaggccaccgaccacaaggtcacgcatttcgtggcgggcatcggcaccggcggcaccatctccggcaccggacactatctgaaggacgtgtccaacggcgcggtgcaggtcatcggcgccgatccggaaggctccatctactccgacccgaacgacgtgcaccaataccagatcgaaggcgtcggcgaggacttctacccgaaggccttcgaccggagccttcccgacgagatagtgcaggtcaccgacgcggaagccttcgaaatgacccgacgcctcgccaacgaggaaggactgctcgtcggcggctcatccggcatggccgtgttctccgcgctgaaatacgcccgcgagcacgacctcgacgaaaaccagctcgtcgtggtgctgatgcccgattccggccgcagctatatggagaagatcttcaacgacgactggatgcgagccaacggattcgccgacgtcgtggaacgcaccaccaagcccagcctcgccgaacagtacctgtaaaagaccgtcaaacgactgtccggcagcccgatcgcacctttgaaaccaatgcccatcatccgaacgacccaaaccatccgctacttccaaggagttcccatcatgaccatctcgaccaacaccgaagccctcaacgccaccgctctcgccacccgcgccatccacgcaggccaggaacccgacccgaccaccggagccgtggtcacccccatctacatgacctccaccttcaagcaggacggcgtcggcggcctgcgcaacggctacgactacagccgttccatcaacccgacccgcaacagcttcgacgagcagctcgccgccgtggaaggcgcgaaatacgcgttaagcttctcctccggacttgccgccatcgacgtgctgctgcgctccaccctgaagcccggcgacaacatcctgctcggcaacgacgtgtacggcggcacctaccgtctgctgtccaaggtgttcgtgccgtggggcatcggcctcgacgtggtggacatcaccgacacggccgccgtctcagccgcgctcgccaagaagcagtacgcgtacatctgggtggaaaccccgtccaacccgctgctcaacatcaccgacatcgccgccaccgcggccgtggcgcacgcgcacggcaccaaagtggtcgtggacaacaccttcgcatccccggtattgcagcatccgctcgcagacggcgccgacgtggtcgtctactccaccaccaagtacatcggcggccactctgacgtggtcggcggcgcggtggtcctgaacgacaaggaaacacgcgacgcggtggccttcctgcagaacgcggccggcgcggtgccctccccgttcgactcctggcttgacatccgaggcctcaaaaccctcgacctgcgcgtcaagcagcacagccgcaacgccatgaaagtggcccagtggctcgaaacccgccccgaagtggaacgcgtatggtatccggggctcgaatcccacccgggccacgacatcgcggcacgccagatgcacggcggtttcggcggcatgatctccatccagatcgccgccggtttcgaagcggccaagaagttcgccggagccaccgaagtgttcaccctggccgaatccctgggcggcgtggaatccctgatcgagcatccgggcgccatgacccacgcctccgtggccggcaccacgctcgaagtgcccgccaacctgatccgcctgtccgtcggccttgaggacgcggacgatctgatcgctgacctggagcaggcgttccgccagatctgaattccctatttccgatagaagcatgaaacggccggcatgggcaagacccgcgccggccgtttcgctctccgcggtcaacgcacggcattgctacacttggaaaccatgacgcaagctgttgattccgccgattccgtagacccccgcgcattggaggcgctgaaccgctatttcggctacgattcgttccgtcctggacaatccggcatcgtctcggccatcctcaccggacacgacgtgcttggcgtcatgcccaccggcgccggcaaatccatctgctatcagattcccgcagcgatcctgccgggcgtcgccatcgtcatctcgccgctgatctcactcatgcgcgaccaggtcgacgccctgaacgacgtgggccttccggccgcgttcatcaacaccactcagacgccggacgaacaggatctcgtcttcgcgcaggcgctctccggccagatcaaactgctgtacgtggcgccggaacgtttggaaaccgaacgattccgcaacttcgccgtccgtgtgccgatctcgctcgtcgccgtcgacgaagcgcactgcgtctcccaatgggggcaggacttccgttcctcatatcttggcatcggcgaattcatcgccggactgcccacacgtccaacggtcgccgcgttcaccgccaccgccaccgaacgcgtgcgccgcgacatcgtttcgattctgggcctgcacacaccgtccatcaccgtcaccggtttcgaccggccgaacctgtatttcgacgtcatcagcatgccacgcaaagacaaagcatcctgggtggcgtcctacatcgccagccatccggacgaatccggcatcgtctactgcgccacgcgcaaggaaacggaagcgctcgccgaatcgcttaacagcgccgtcgccgaattgcgtgccgcagggggtgcggatgtgtcggatatcggcaccatcgccgtcgcctaccatggcggtatgagcgccgacgcacgagagaaggcgcaacgcgatttcgtcaccgaccgtgtgcccgtggtcgtggccaccaacgcgttcggcatgggcatcgacaaatccaacgtgcggttcgtcatccaccacaacatgcccgaatccatcgaagcgtactaccaggaggcgggtcgcgccggacgagacggcgaaccaagccgctgcacgctgttgtggaacgaatcggacatcgtcacccgccgccggctgctcgattcggattacgaaaacgaacgattgactcccgaagagcaggaggccgtacgcgcgtcgaaacgccggctgctcgacgcgatggtcggctactgccgtaccacggactgcctgcacgcgtacatgacccggtatttcggcgaaaccgcgggcgcggcggcgaaaacggacggcaaatgcgtgggcggttgcgccaactgcgagcacacattcgaaaccatcgacgtcaccgacatcgcccgagccatcagccgttgcgtgcacgatgtgaaccagcatgtcggcagcggcaaaatcgtcaaggtgctgcgcggctcgaaggcacaggatctaagctatctcaaccccgaaagcctgccgtcgttcggcatgctcgacgaagtgccggaagcgcgcatccgcgacgtgctgagccagatggccaccgacggcttcctgacgatcgcggaaggacgcctgccgatcgtcggcttcggaccccgtgcggcggaaacggtcgcacccgaattccattacgacatcaagaagatcaaacgtgctgacgcccgtgcgcgtcgaacgcccgacgtgtccactcccgctgtcggatcgtacgtgccggatgacggcgacgaggcgctattccagaagctgcgtgcgctgcgactggacatcgcgcgcgaacttggcaaaccgccgtacatcgtgttctccgacaagacgttgcgtgacatggtacgggtcaagccgattactgacgaccagttccttgccgtcaacggtgtgggggaaagcaagctcaaacagtacggcgaacggttcctggccgcgattcgggaggattccggcgacgaggcttgaaccggccataaccgacacgcatggcacgacggttgacgttgagcccgcgaaccgtgaatagtggaatgtgaacacaacaacgaaaggacagaacatggcggaagacaagccggtggtggaaagcttccaattggaccacaccaaagtaaaggcgccgtatgtgcgctacatcgatacggaaaccggcctccacggcgacgtgatctcgaactacgacctgcgattggtgcagccgaacgagaacgccattccgaccggcgggctgcacaccatcgaacacaccatcgcggtgctgctgcgcgaacgcatccccggttacatcgactgctcgccgttcgggtgccgcacaggcttccacctgctgacgtggggcgagcattccaccgaggatgtggctcgcgcattgaaggaatcgttggaattcatcgcctacgaggccacatgggacgacgtgccggcaaccaccatcgaaagttgcggcaactaccgcgaccacagcctgttcaccgccaaggaatggtgcaaggacatcctcgccaagggcatcagctccgacccgttcgaacgccgccttgtgtgagcgttaccatgcctgtgcggtgggcgtggtagtttggacggctggaatgcttgagagaggtacacagtcgaattgaggtgaaagggttgagcgaaaccacttccgaacgtcggttccgtcgtgccaccatggatgatctgcctgtcatgctgaaaatctaccagcatgcgcgtgagcttatggcggccaacgggaatcccacgcaatggggaaacacgttcccacgtgaggaagtgatccttgacgacattcgccagcagcgcaccatgctgctggtggacgaggctgacggcaaggagcgtgtgctcgcccagttcgccctgtgcacgggcgaggatcccacctacgcgcatatcgacggcgcctggctggacgacgactcgtatgtgaccatccaccgcatcgcctcgtcgggaatcgtcaaaggcgcggccaaggactgcatcaactggtgcatcgaacattacggcaacgtgcgcgccgacacgcatccgaacaacaaggccatgcagcacgtgctcgaatcgaacggattcgcccgctgcggcctgatccaactgcttgaccgccccaccgataccacgcgtatcgcctaccagcgtcacgaatggtgattgcgcatacatagaaacgtagaaaaaaggacgtctcccgtaaaactgcgggagacgtccttttccatatgaagggatgattagaacagtcccggctcgttaagctgagaatgcttgcggctgtacgtgaaatacacgaccagtccaagcgcgaaccacacggcgaaacgcacccacgtctcccaattcaaaccgaagatcagaatcaggcagaagatgatggcgcagattggcgtgaacggcacgcccggcgcacggaagccacgatgcgcgtccggctgggtcttgcgcatccacaggatgccggccgacacgatgatgaacgcggacagcgtaccgatgttcaccagctcgaacagcacgttgatgttgatgaaaccgccggcgatggccgtcagaatgccgaagaaccacgtgcccttgaacggtgtgcggtacttcggatgcacttcgccgaagaacttcgggaacagtccgtcgcggctcatcgcatagcagatgcgggactggccgtacagctgcaccagcatgacggtggtcatgccgatcaacgcgccgaggttcacgatgaacgccagccagttgaggccggtctcgagaatcacgcccgccaccggagcgtcgatgaacttcgcgaactccttgtacggcaccacgccggtcatgatgagcgtcatgatgatgtacagcacggtggacacggccagcgagatcaggatgccgcgcggcagcgtcttgttcggattgatggtctcctcggcggaggaggagacggcgtcgaagccgatgaagctgaagaacacaatcgacgcggccggcacgatgccgtacggctgcgtcgaacccggctggaacgtgtagatgccatacggggagaacggtttccagttggcgggattgatgtaccagacggtgcacacgatgaacagcacgatgatggccagcttgatcatcaccatgatgtcgttggtcttcttcgtctggttgatgccgatggacagcacccacgtgatgataagcacgatcacgaagcccggcagattgaaatacgtggtgactcccggcgtggtgccgtacgcggcggtcagttcgaccggcagatgcaggccgaagccttccaacagcttgttgaaatagcccgaccagccggcggacacggtcgccgcctgcaacgcgtattccaaaatcaaatcccaaccgatcacgaaggcgatcaactcgccgaacgccagatacgcgtacgaataggcggagccggaaaccggtgccatcgcggcgaactccgcatagcacaggcccgcaaaaccgcagcagacggcggcgagcaggaaggacacgcacaatgccggtcccgcggtgagcgcgcccttgccggtgagcacgaagatgccggtgccgatgatggcgccgatgcccagcatggtcaggtcgaaggttttcagtgttcgcttcagcggagtcgattcggagacaagttggtccaccgacttcttgcgaaatagatccatggtcgtcagattccctgtgattgtttcaaaaatgggctggaccggacggatttccgggactctggcacgccttaacgccagaaatcagaaaggccgcggcgatatgcgcaacagccttgtgtatggaaagtgtaaaaaacactgccggacaaaatcgtgaaaacatcgtgaatcgtctcaccatatgtccctgatgttccatacctgtcacatagcggcgcgacaatgggagccatgactttgagcgcaacacgtgaatgggatttctcctccgaacaaggcaaagcgaactacaaggccgcccagcggcggtatccggcgcaggccatcgtcgacctcgccgcactgcgcgacaacatgcgccatctggtgagtgtcgtcggcggtccgcattccggcaccgccgtcatgggcatcgtcaaagccgacgcgtacggccacggtctggttccggccgcgctcgccgcgctcgcgggaggcgccacatggctcggcaccgcgcaatcgcatgaggcgctgctgctgcgcaaagccggcatcggccccgatcgctgccatattctgacgtgggtctacagcggcgccgaagtgccgttcgacgagctggtcgacaacgacatcgacatttccgtcggctcgctcgccggcatcgacggcgtcgccgcggccgcacgcaggctcggcaagacggcgcgcgtgcatgtgaaggtcgattccggcttcggccgtaacggcttcacgcccgccggtttcgacgcggcgctcgccaaactggtgccgctcgccaaggaaggcgtgctgcacatcgtcggccagtggagccatctggcggtcgccgacgcgccggacgtcccggaattcgtggcatccaccgacatgcaggtcgaaacgttcaaggacttcacccgtcgtatggaggcggccggcattccgccggaaatccgccacctcgccaacaccgcggcgacgctgtcccgtccggaaatccacttcgaactgacccgtccgggcatcggcctgtacggttacgaagccgatccggccatgggcacgccgtccacgtatagcctgaagcccgccatgaccctgcaggcgcagctcggcaccgtcaaggatgtggaggccggacatggcatttcctacggccgcacgtatctgaccccgtccgacacctccaccgcgatcgtgccgctcggctatgcggacggcatccaccgctccgcctccggattcgacatggaaggcgccaagcatgtgaccaagcccggcggcccggtgcgcgtgatgacctcggaaggcccgcgcctgtaccgtgtgtccggccgcgtgtgcatggaccagttcatcctcgacctgcacggttccgccgccgaactcggcatccacgaaggcgacaatgtggaactgttcggtccaggccgcggcgaggattacgccgaaccgaccgcggacgattggggtcatgccgccgacaccatcagctacgagatcttcacctgcctgcgcaaccgcattccgcgcctgtacgagcatgccacggacgtattgtccgccgaggacctcgccaagctcgacccggcaagcatcctgtaatcccgtaaaaagcggcggcagccgccgcacccataggaaggcggtgcatcatgacgagcgaaggatacagcgcgttcgacgaggagcgttgggctccggaaccacccaaatccagctcccgcaccgccttccaacgcgaccgcgcccgactcatccactcgtccgcattgcgcaggctcggcgcgaaaacgcagattctggtagccggcacggacgatttcgcacgtacacggcttacacacacgttggaggtcgcgcaaatcggtcgacagatcggcacttcgctcggttgcgatcccgacgtggtcgactgcgcctgccttgcgcacgacctcggccacccgccgttcggccataatggggaacgtgcgcttgccgaaatcgccggcaatatcggtggtttcgaaggcaatgcgcaaaccttgcgattattgacgcgcctcgaaccgaaaatactgtttcccgacggacgttccgcaggcgtgaatctgacgcgtgccgcgctcgatgcggccgtcaaatacccgtggacgcttgccgaagccgccgcgcatccgaaaggggagcgcagcgcgaaattctgcgtctatccggatgatacggacgtgttcgcctggctcaaacaacacgcgcccgacaccacccgccgtcccgtcgaatgccaggtgatggacctgtccgatgacatcgcctacagcgtgcatgatgtggaggacgccatcgccaccggcgcgttcaatccgggcgtgctgcatgaaagcggcgtgatcgacgcggtcgtcgaggacgcgcgcgcctggtacggaccgcaatgggacacagacaagctggtggccgcgttcgcacgcatgcaccggcgcgacacgttcccccggctatttcgacggttcgcgacgcgcgctcgccgcattgaagaacatgaccagcaatctgatcggccgattcgccggttccgtggaacaagccacgcgggacacgtacggcaacgagccgctgacccgatacaacggcgatctggtgattcccgaggaaaccagttacgaaatcgtggtgctgaaaggcatcgccgtgcatttcgtcatggcgcccggcgaacgcgagccgatgcacggcgaggaacagcggatcgtcggcgatctggtggacgtgttcatggcggacaatcccaaaccgtccagcgcgttggagaacgtgttcctcgacgattggcgcgaggccggcagcgacggcgaacgcctgcgcgtggccatagaccaggtggcgagcctgaccgacacgtccgccctgaccctccactcccttctctgctgaacggggctggtaggctggaccgtatgccgggaatgatcaagaaggaagacatagaaaaggtccgcgccaccgccgacctgtatgacatcgtatccgcgaccgtcacgctcaaaccctcgggaaccggcacatacgtaggcctgtgccccttccatgacgagaaaacgccaagtttttccgtacgtcccgcgcttggcgtgtggcattgcttcggctgcggtctcggcggtgacgtgttcggctacgtcgaacatcaggagaacatcgatttccgcgacgcggtggagctgctcgccgacaaataccatatcgaactgcattacgacaaggccgacaacgtgcccgcgcacaccggttcgaaacgcgcacgcctactcgaagccaacgaggcggcgcaggaatacttcgtctcccagctgatgaccaaggaggcgctcgccgcgcgcaagctgttggacggtcgcaacttcagccaggccgactgccagcggttcggctgcggatatgccccccaaggatgggataacctggtgcggcaccttgccggcaaaggcttcacccagcaggagatgctcgacgcgggactcgcccgtcagggccagcgtggcgtatacgactatttccgtggccgcgtgacatggccgattcgtgattcgaccggtcgtacgcttggcttcggcgcgcgcaagctgtacgaggatgacacgatcaatgcgaaatacatcaacacgcccgacacgcagctgtaccgcaaaacacaggtgctgtacggcatcgaccttgccaaatcggcgattgtgaagaaacgccaggcggtgatcgtcgaaggctataccgatgtgatggccatgcatctggccggcatcgacacggcggtcgccacgtgcggcaccgcattcggcgccgagcatgcgaagatcatccgccgattgatcgcggacgattcgttgggcgccgtgcagctggttggccccctgaaggtggaggggcaggcgttgagctcgcgtgtcgtgttcacattcgacggcgatgcggctgggcagaaggccgcgatccacgcgttcggtttggacgccgcgttctcgacgcaggcgttcgtcgcggtcgccgaagacaacctcgacccgtgcgatctgcgcatcaaacgcggcaacgaggcggtgcgcgcgctgatcgccaatgcgcggccgctgtacgatttcgtgatcgattcggcaatcgaccgtttcgacaccacgtacgcgacaggtcagatgggcgcggtcaaggcggtcgccccgctgatcgcgcaaatccgagaccgttcgctgctcgacctgtactcacgcaaggcggtacgtcgcatcggcgtcgatctggacatcatgcaacgcgaagtggcgtaccagcgtcgcaaactgaacatgcgtgacgaggacgcgtacgcgccgaaacgtcgattccaaaacaatgcggggccgtcggctgaaccagcatatgcggaacgtggcgcgaatccgtatgcgaatcccgccgcacgcaaggcgttggagcatcgcgacgcggccgagcaaagctactatcgcatcgacgacgccgtgttcatctgcgaacagcagttcatggccacgctgatccaggtgccgttggccgtcgatccgacgatgttcgccagcctgaccttgtcgagtttcatgacgccggtgttccgcacgctgttccaagcggtcgccgcggcgggcgggcttccaggggaagacgtgccgcagggactgtggatgcacaatctgacgaaggcgggcggtccgatgcttgaatcggtcatcaacgagctggccgtcatgccgctgccattgccgccgagcgaagcggacgcgaaccgcaatacaggcgagtcgcaggaacaatcggcgcaattgcgcaagccgacgcaggaggagcggcggtacgcgtccgaactgattgtcagactgcttgataccggcatcatgcgcaaaatcggcgcggcccagcgccgcatggcgcaactgccggacggtgcagagaaaatcgaactgctcggacagatcaccaaactggaaacgctgcgcaaggacctgcagtcgcgtgttttcggcaacaacgttgcgtgacacgcccatatggtgaatcgaaggcgaacggaagatgatttttagacaaaatcttggcgcacgcggggttaatttgtgaagatttgcgggccttgttttcggtttcgccggtttgcaaaagcatgcggcagtaagcaatagtggatgaaaatcgttggaatggtcggaaaagcagcacgccgagggttcgtgctagtcgcatttttgggtaaagtggtctaggcgtttgcatgaaaatcgcttgggttttgcaaggtgtgcaaggcggttgcaaacgggattgacggaggaatgcatgcggcgattggtcgtcaaggtcctgaagaacgagaccattctcgtagtcgcttccatactcgcactcatatcgtgcttcatcgtgccgccagacaaggaatacgccggctacatccacgccagcaccatctcgcagctgatctgtctgatgcttgtggtgtgcggcttccagcgcatcggcgtgttccgcatcatcggctcgcgcctgctgcatcacgtcaaaaccgcgcgtggcctggtgctcacgttgatcgcattgccgtttttctccggcatgctcatcaccaatgatgtggcgttggtcaccttcgtgccgttcgcaatcgcggtgttgacgatggcgcacatggaagagcatgcggtgcttgtcggcacgctgatgaccatcggcgcgaacgtgggcagcatgctcaccccgatcggcaacgcgcacaacctgtatctgaaagcgttgacgggcatgccgacgtccgagatgatcggcatcatggccccgtattccgctaccgcagccgttctgctgataatcatcacctgcgtgattttcggcagcaaaccggtttccgaattttccgcgatcgatagttccggcatcgaacagaacgtactcgccccgcattccgaccggccgcagcctgacgagattcgcgtgaccggctacggtgccggttatggcggctggcgtacgattgtgtattcggtgctgttcgtggtctgcttgctggcggtgagcgatttcattccgctgtggttgatgtgcgtcatcgtgttcgtggcgttcctgctatgcgaccgccgcgtgttccgcaacgtcgattggggactgccgctcacgttctgcatgttcttcatcttcatcggcaacatgaaacgcgtgccggaattctacgagctggccgcctcgctggtgggcgcgcatccgctggaagtggccgtggtgtccagccagttcatctccaacgtgccgaccacgctgctgctgtccggcttctgcgaccagtggcgtgaactgatcatcggcaccaacctgggcggcttgggcacgctgatcgcgtccatggcgtcgctgatcggctacaagaacgtgacgcgcgcctacccggacaagaaaggccgttatctggccgtctacaccgcggtgaacgtgctgttcgtcatcgtgctcgtcggcctgagctggattatcgagtagcgtttggccgtcgaccggtttccctgaccgctaatctcaaggtcgccggttcgcaccttttgctgggattgcatgaaaacccttggaatcattggatttcaagggtttattgttacgtcggctgatggtctggtgctgtgataatctgtgccgggaagcgtgtgccgagaaacgtaggaaggctgaacatgctgcaaggattgctgggaattttctccggactgatcacgccggtgcagaccgcggtgaacacgcggctcggccgttccatcggctcgccgttgcgcgcctcgctggtgtcgttcagcatcggcctcattgcgatgctgactttgacgctgctgcttggcccgtatccgctgattcccgccaccgcggcgaacggcccatggtggatgtggttcgcgggcgtgttcggtgtcactttcctgaccggcaatgtgctgctgctgccgaaactgggcagtctcaaaaccgtgatcatgccagtcaccgggcagatcgtcatgggcctgctgatcgacactttcggctggttcggcaccaccgcgcagccgatttccccgctgcgcatcgcaggcgcggcgatcacgctggtcggcttcctgcttgccgtcgccggaccgaatctgcgattgaggcctgccatcgatcgtccggctggcggttcggaaaattccggcgattccgaaaaatccgaaactgacggaaaagccgtacatgtgccaggttccgcgaccgtgctgtggagttgcgcaggcatcgcgttcggcatgtgttcggccgtgcagacggcgttgttgggcaagctgggcgtcgcgttgggatcgccggtgaaggcatcactcgcctcgttcgtggtcggtctgatctcgcttgcgatcgtcgtcgcattcgtcgaccgcacctacagcctcggcgacgcgctgaagaaaggcaatccgtggtggatgtgggtaggcggattgctgggtgcgacgctggtgatgtgcaacgcgtacctgtccgcgcatatcggcaccggcatgacggtgatgctggtattgctcggtcaggtcggcggaggattgctggtcgaccgtttcggcctgcttggcgtgccacgcaagcccgtggccggcatccaatacgtcggcgtgctcgtagccattgtcggcattgtgctcaaggcgatgtgattgccgtgtcgagttggcaaccgtgtgcgaactgactatactgtgtttagtttggccctgtagctcagctggatagagcatgtgacttctaatctcaaggtcgccggttcgagcccggccggggtcaccatcaagccctcgcgtcgtttcatgcggtgcgggggctttcctgtccattgaacggcaagccattggcttgcgaagataggggagaccatgaagcgaatcgtcgcgggcattctggcgcatgtggacgcgggcaagaccacgttgtcggaggcgctgctgtacgctaccggccaagtacgcaaactcggccgcgtcgaccacggcgacgccttcctcgacacggacgccatggaacggcagcgcggcatcaccatcttcaccgagccggccgtcatcgccacgcccgacctcaccatcaccctgctcgatactcctggccacgtcgacttctccgccgaaacggaacgtacgctcgccgtgctcgactacgccatcctcgtcatctccggcgcggacggcatccaaggccataccgaaacgttgtggcgactgctcaatcgctatcaggtgcccacattcgtcttcgtcaacaaaatggacgcgcctggcgccgacaaaacgcaactgctcgcccaactcaagaaacgcttctcggacggctgcgtcgacttcaccgagccgattgacggcgaacgcatggaggagatcgccatgcaaaacgaaacggccatggacgcgtatctcgacaccgaaaccgtgccggacgaaaccattcgcgccatgatcgcccgccgtgagctgttcccctgctatttcggatcagcgctgaaaatggacggtatagaacagttcgtcgcaggtttcgaacggttcgcgcaagagccgcaatacaatggcgaattcggcgcacgcatatataaggtgtctcatgacgcgcaaggcaaccgtctgacctggctcaaggtgaccggcggcgaactgaaggccaagatgatgctaagcggcaccgcgcacgccggcgacgcggatgcggttgccgaagacggccaatggcatgagaaagccgaccaggtgcgcgtctattccggcgcgaaatccaccaccgtcgacacggtccccgcaggcaccatctgcgccgtcacgggtctgacgcagacattccccggcgaaggcctcggcatggagcgggacgccggcagtccggtcctccagccggtgctcacgtacacgctggaaccgggggagtgcgacattcacaaatgtctcgtcgccctacgcgaactggaggacgaggatccgctgctgcacgtcgtctggcagtctcgcctagaggaagtgcacctgcagttgatgggcgcggtgcagctggagatcatccagcagatcatgcacgaccgtttcggcctggacgtcacgttcggaccgggcagcatcctgtacaaggagacgatcgccgctccgatcgaaggcatcggccatttcgagccgttgcgacactacgccgaaacgcatgtgctgctcgaaccgctgccgcagggctcgggcatggcatacgccaccgtgtgcagcgaggacgtgctcgaccgcaactggcagcgcctcatcatgcagcatttccaggaacgcgagcatctgggcgtgctcaccggctcgccgatcaccgatatgagaatcacgctgctgacgggccgtgcgcatctgaagcacacggaaggcggcgatttccgccaagccacctaccgtgcgatacgccagggcctgatggaagcgaagaagaagggcgattgccgtctgcttgaaccttggtacggcttccgtctggaagtgccgcaggacatggtcggacatgcgatggccgacatccagcgcatgtcgggcacgttcgacacgcctaccggcgacggcgaatatatggtgttgaacggcacggcgccggtatccgaaatgcgtgactatgcgatggacgtgaacgcgtacacgcacggccgtggccatttaagctgcgtgttcgccggctaccagccgtgccacaatgccgacgaggtgatcgagaacatggcttacgatccggaatccgacctggagaacacgccggattcggtgttctgcgcgcatggcgccggctatccggtcaaatggtacaaggtgcccgaattcatgcatctcgactacgcgtgggatggcatgcgcgaatagaaccgaaagacagacgggtgggaagcgccgattgcttcccacccgaggcctcttgtcggataccgacaaacggataaacgaaaagccccaccgaatcggtgaggcttcatgctggagcggacaacgggactcggacccgcggtctcaaccttggcaaggttgcgctttaccaactaagctatgtccgcaaaggattcctgccgtgagaagcaggcatccagtgggtgatataggaatcgaacctatgaccccttccgtgtgaaggaagtgcgctagccgctgcgccaatcacccgtgggatgtctccaccggtttcccggcttcgtcatccgcttcgcgtgggcgatacaagattcgaacttgtgaccccttccgtgtcagggaagtgcgctacctctgcgccaaccgcccgaagcgagtgctaacttacgtggattctcggcggaatgcaaatcgtcggcgtgtcgcgatgttcacgtgaagttcgccggccgttcttcacgcggtgggttcaacctgcggaaactccaaggtttccgtgtcgtggtccacgccgctcatggcggtcgtatccgcatcattggttcgctccgcggtcttggcggagccgttcgcagtagggtttcccgtgccgacggcgtgcgtcagcgcgagcctcatctgatgccagaccacgttgccatgcgtcgactcggacagtccttcgtccacgaatcccagccgtgcgtaaaaatcgaccagccgttccttgcaggtgagcacgaggcccttgcgtccggcctgtgccgtgtcgagaatcacctggcgcagcagatagctggcgcagccgcgatgctggtagacgggtgccacatccacgccgaaaatcatctgccaatcgccatgctcgtcatgcatatcggcgtcgtcatacatggcatcggcaagattcggctcgtttgtggccatgccatcgacgaaaccaaccaacgtgccgtcctctacacgcgaggggaacggggtatcgtcgtcatcggtgttgaccaacagccagaaatggtccggataagcggccacgcgtgcggtaaggctttcgttgcttgcggcctccgcaggtgggaagcaggcggcctccacagcctcgatcgcgtccagatcctccatcgttgcatgtcgaatgagcatgtgcatactctctcgcaaggcatacccaatcttcacatttcgatatgcgccgacggcgcaatccgccaacatgccatactgtagaagaaccttggagggatcgcaggacgactgtttcgcgatacctgataagtccttatacgaaaaaccgataacgaaactggctcgtagtggcgaataaagcgatagtatgagccgcgttcgccggaacaaatacgaaaaatccgttgagaagagaaggaggcgcgcgtgttcgactggacgttcatctcgcactacgcgccgttcttcgtcagcggtgccgaaatgacgctgttcatttccgtcttcggcatcatcctggcgatcgtggtcggcttggtctgcgccggcatcgagatcgcgcgcatccccgtcctgcggcaggtcgtgcgcgtctacatcgagctgagccgtaacacgccgttgctggtgcagctatacttcctgtattttggcctgccgaaactcggactcgtctggtccgcggaactgtgcgccatcgtcggactcggcttcctcggcggctcctatatggccgaagcgatgcgcggcggcctggagaccattccggaagtgcagcgcgaatccgcatacgtgctgggcttgagcaaatggcagacattaagccgcgtggtcattccacaggccatcagcacctccattccaggcgtcgtggccaatgtgatcttcctcatcaaggaatcgtccgtggtgtccgccatcgcgctcgccgacgtgatgtacatggccaaggacctgatcggcatgtactacgacacctatgagtcgctgttcctgctgattgtggcgtatctggtgattctgctgccgatctcgctgttcggcacttggctggaacggaggttcgactatgagcggcgctgagattctgctcgagccgggcgtgattccgcgcctgctacagggcctgtgggtcacggtgtggatcgccggtgtgtccgtggcgttgtccgtgcccgtcggcctgattgtcggctggctgatgacgatgaaaaatcccgttgtgcgagtgctgaccaggatttatctggatttcatccgcatcatgccacagctggcgctgctgttcatcgccttctacggtttcgcgcaggcatggaattggaatttggatgcgaccggcgcatgcgtgttcgtcttcgttttgtggggcggcgctgaactgggcgatctggtgcgtggtgcgctcgaatcgattccgaaggcgcagtacgagtcgtcgtacgttttgggattgagcggctggcagacgttcacgaaagtgattctgccgcaggcgttgcgccggctgctgccggcttccgtgaaccttgccacgcgcatcgtgaagaccacgtcattggccgtgctgctcggcgtggtggaagtcatcaaggtgggccagcagatcatcgacgcgaaccgtttccagtatccgacgggcactttgtggatttacggaacgattttcttcatgtacttcatcgtgtgctggccgctgtccatcgtggcccgcaggttggaaaagaggtggaagcatgactgagcaggctgaacaggttacgcagaccgcgcaaaacagcgggaaatcgcagacaagccttgaaatcaggcatctggtcaagcggtacgccaatgccgacaagccagtgctggacgacatctccttcgacgtgccccatggcaaggtgttcgtcatcgtcggcccgtccggatcgggcaagtcgacgttgctgcgcaccatcgcaggtcttgagccgattcagggcggcaccatcgcgctgaacggcgagattatcgaaaccggcaagccgggcaccgaatcggccggccgcagcaagcgcggcagcgagctgcgcacgcgtgtcggcatggtgttccaaagctacgacctgttccccaacaaaactgtgctcggcaacatcacgctcgctccgacgctcgtgcagaagcgcgacaaggcggaggtcgagaaggaagccatcgctctgctggaacgcgtcggactcgccgaccgcaaggatgcctggccgcatgagctgtccggaggccaacgccagcgcgtggccatctgccgtgcgctgatcctgcatccggaagtgctgctgttcgacgaggtcaccgccgcgcttgatccggaaatggtgcgcgaggtgcttgacgtgatgctggaactcgccgattccggccagaccatgctcatcgtgacgcacgagatgcaattcgcacgagccatcgccgaccaggtgatcatgctggaggacggcggcatcgttgaacaatccgacgacgccgaagcgttcttcaccaatccgaaaaccgagcgtgccaagcgtttcttgcacacgttcgaattcgacaggcatcgcaggccggcggaaacgccgacggaaccgacgggaacttccgccgagtaatcgcaagttttgatagcagtcatccgtacaagagaggagtaaccatgaccgcatcaatcatcaacaagacaatcaagagcatcgtggccgcatcggccgcgttgatcatggccgcctccgtggctgcctgcggtcccaacgccgccaccccgagcgaggagaacaacgcctccaacggcggcgtcaccacgtccaaggtgaccgcccgctccctggacgagatcaagaagtccggcgtgctcaaagtggccgtcttctccgacaaggccccgttcggctacatcgacaaggacggcaagaacgccggctacgacatcgtcttcgccgagcgtctcgccaaagatctgggcgtgaaggtcaagtacacgtccgtcgatccggccgcccgtgtggatgtgctcacgtccaacaaggtggacatcacgctggccaacttcaccgtcaccgacgagcgcaaggagaaggtcgacttcgccaagccgtacatgaaggtcgcgctcggcgtggtctccccggagaacgccgaaatcaccgacgtgagccagctcaagggcaagacgctgatcatcgccaagggcaccaccgccgaaagctatttcgagaagaacgaacccgacgtcaagctgcagaagtacgaccagtacgccgacgcctacaacgcgctgctcgacggccgtggcgacgccttctccaccgacaacaccgaggtgctggcctgggccaagaccaacaagggcttcaaggtgggcatcaccaagctcggtgacgaagacaccatcgcgccggccgtgcagaagggcaacaaggagctgctcaactggatcaacgacgagatcgtgaagctcggcaaggagaacttcttccacaaggattacgaggagactttgaagccggtgtacggctccgacgtcaacccggatgacattgtggtcgaaggcggccagctttgattcttacctgacctgacggcggcctgccgtccgtcaatcctgtttccaagccttccgtggcacacgccgcggaaggttttttcatgccgattccgggccggttatgtcacatccttcgaaaccgtttacagtccacgcgggtgtatgtttccggaggtttcgtaccatccgataacccctcataaataaacgctatggcgattcgcacgttgtataagcaacgtcgataatctccggcgcgtggcgctttccaagacacggttaagtaggaaccagcgatcgcgtgaacggcacgcggcagggaaaccacaccgagggggtgcgcaccatgaccagattcaacactcagctcgtccacggactgccggtcaacgacaacaacaccggagccgtgaacccgccgatctacaactcgtccacctatgctttcgaatcggtcgggaccatgccccgctgggattatgcccgcagtggcaatccgacgcgcgagttcctggagaagcagatcgcgcagctggagcatggcacgcgcggtttcgcgttcggttccggcctggccgccatccacgcggtgctgtcgatcttccaacccggcgaccgtatcatcgtcggcaagaacatctacggcggcacctactcgctgttccacgagtatttcgaacgctggggcgtcatcgtagaggaagtgggcaccaccgattacaaggcgctcgatgcggcggtgtccggcgaatccgccaagggcaatgcgcatggatgtccggccaaggccgtgtacttcgaagtgctcaccaacccgcttctgcaagtcaacaacgtgacggccattgccggaatcgcccaccgtcatggcgcgatcgccatcgtcgacaacacattcgtcaccccgtatctgcagcagccgctcgaccaaggcgccgacatcgtcatccattccgccaccaagtatctggccggccattccgaagtcaacgccggcctcgtggtggtcaaggacgatgagctgggcaagcgcgtctacttcgcgcagaaccgtttgggtggcgtgctcgcgccgaacgaatgcgattcggtgcgtcgcggcatccagacgcttgccttgcgcatggaccgtcagcaggagaacgcgcgtgcgatttccagctatctgctgctgcacccgttggtcaagtccgtgcattatccgggactgcccggtcacgaatacgagctggcctccaacggtctcaagggcggtggtgccgtactgagcttcgaagtggtgccgggcgtcgaccctgcggacgtgctcgacaacctgcatatcttccgtctggcggtttcgctcggcgcggtggaatcgcttgccgaactgccgtgccgcatgacgcatttcgaactgccgcgcgaggagcgtctgaaggtcggcatcaccgacgaactggtgcgtctcgcagtcggcatcgaagacaagcaggacctcattgaggatctcggccaagccttcgacatcgcgtacgagaactatctcaagcgtcacgccggcgagagtctgttcaccttcgcgcaacacgtatatgcctgaaagttttgctatcggtagggatttgaatattaactggcacgctatctcacgaaccggacaggggaaagcgcccctctgtccggctcgtgggcgtatgtgggtcagctcctggacaggcgatggttggttcgtggacggcccttgcccagctcgcggacattgtctgcatacgattgcattctttggtaaatttttactcgggttcggcaatggttgcagaacctacgaaaggtcatgcgacaagacctttaaagagaaaccaaagaagggagtaatgccatgccgttccttgtagcgctccttgtcattgcgctgatcatcgcgttcctgttcctgtccacgttgttcatcgtgccgcagcagcaggcatacatcatcgaacgtttcggcaagttcaacaaggtccagttcgcgggcatccacatccgtatcccgttcgtggaccgtatcgccatgaaaaccaacatgcgcgtcaaccagctcaacgtgcagctggaaaccaaaaccctcgacaacgtgttcgtcacggtcgtcgcctccacccagttccgtgtgaacccggaaaacgtggccaccgcctactacgagctgcgcgacccggccgggcagctgcgctcctacatggaggatgccctgcgttccgccattccggcgttgagcctcgatgacgccttcgcccgcaaggacgacgtggccttcgacgtgcagaagaccgtcggcaacgaaatgtcccgtttcggtttcaccgttgtcaaaacgctgatcaccgccatcgacccgagcccgcaggtcaagaacgccatggactccatcaacgccgcccagcgtgagaaggaagccacccgcaaccgcgccgaagcccagcgcatccagatcgagacccaggccgctgccgaggcggagaagacccgtcttcaaggcgagggccaggccaactaccgtcgcgagatcgccaacggtatcgtcgaccagatcaagagcttgcaggctgtcggcatgaacatcggcgatgtgaacaatgtggtgctgtttaaccagtacctcgacgtgctgcgctccttgagcgaatccaacaacgccaagaccgtcgtgctgcccgcatccacccctggcggctaccaggacatgtacagccagatcacgcaggccatggtgacagccaacgaaaccgtcggccagcactcgactgtgccgacaccgccgcacgtcgctccgacgacgccgcgtatctgacacatgtttggtgatgcctgcagtcgtcgggcatacgttgattggccgcaggcatgtgaatcgcaggaaagcgaaaacgaaaaaaagaatcccttctttcgtcggggagccacgtagatgtgacggagagtgcggaaacgatgaaagaagggattcgtgttgcaagtgcgccgtcgtaccacgacacacgtctgttatacggaaggcttcgctcggacgtcaggccagagtgacaagcttcccgggagaaggtgcgttgagacattcagcagcatgcgcttccatggaacggagctggtcttgcagatccatgactttcttttccaaccatgcgatggtcatggattgggagatgacgagcaggtcgcgctggtcagctgcggcttcgttggcaaacgattgtgcttcggtcatgatttgcggatctgctttccaccgtgcgatggcgcgttcgatacgtttactgccaacgattttcgggttaagacctgcgctggcgaagatgctggtcggcccgttgccccgtaagtattgcgccatgcaacgcacttggaattcccttgaataggtgatacggtccattgatgccctttctaccgcgggcaaggtgttgagatagtagacttccgcctgggtgaaatgacgtttcatattgttcccctttggtgtgaaaccgtttgacattccacaatctgaagattattgctgatggtttcattttatttttgacattttggtcgaaaaggtcatttggcacgaaacaagggtttctggcacgaaacaacatgttccatatcgttcaggcggggtttcttgaacggttttcgagtttcaggcacgcgcggaccgtggcttcagggtgttcccttaagggtggcgaagcgcggtgaaacactttagacttaggagcaattatcaacatattcccagaaaacgaggaggtgaatgtgccggtaggtatcacatccaacgttgggaaaaccggtcgcggtcccattatcgaggttaaaaacctacgcaaggaatatccagtgctcgatgagaccgtcgtagcgctggaacgtgtcaatctcgccattccgcaagggcagatttgctgtatctatggtgagtccggatccggtaaatccaccctgctcaatcagcttgccggcatggaaaaaccaactaaaggtggtgtacgtattgcaggtgtgcccatcagcaggcttgacgaacggcagctggccgaattcaggcagaagcaccttggcttcgtgttccagtcgtacaatctgctgcccaatctcaatgccatcgagaatgtggccatgccactgatgttccgaggcgtgccgaagcgtaaacgcgagatgatcgcgcgtgccatgctcaagcgggtcggccttggcaaacgcatgaaccattatccggcccagatgtctggcggtcagcagcagcgcgtcggcatcgcccgcgctttcgcggcacgtccgcaagtggtattcgccgacgagccgaccggcaatctcgattccaaaaccaaaaccgaagtgatggatatgatttgctcgttcgcacgcgatttcaaccagaccatcgtgctcgtcacacatgacgacaatatggcgcaatacgccgatcgcatcgtcacacttcttgacggccgcatcatcggcgaccggcttacgtaacattcacgacaacgcatatcgacaactatgacgacaacagaagggccttccatgggcaacaacacaagaatcgcaacactgctcaacggggcaatctcactattggcggtggtcgccatcacgttggtatgcatcgtgccgacggcgttcgccgaagatggcgccaatacttccgatgctccgggtgcgggagcggacaacagtgttgagcagattgctgggccggtgccgaacatcattatcaccaatttcacctatggcgacgggtcggtggcggtcggcagcaccttcaacctcggtttcaccttccaaaacatgggcaaagtggcggtgagcaacatggtggtcaccgtggacggcggtgagaattttgccatctccggcggtacgaacacgttctactacgatgcgctgaatgcgggagctgcgttgacgcagaccgtgccgatgcagacactggccagtgcgaaaaacggcgcgcagggcatcgacatcagcttcaaatacgagtacgtggacggtgccgcacgcagctccaacacttccgacatcaaaatttccgtacccgtttcgcagcctgatcgttttgaattgaacgatccagtggtgcccaatatcgtcaacgcaggtgaggaaactactatcaccatggattacgtgaacaagggcaagggcgacgtttccaatgtcgaggcgagcgttgaaggcgacggtatcaccgccacgcaggccaagcagtacgtcggcaatgtggcgtccggcgcgtccggctccattggattcgcattcactgcggacaagcccggcgaaaccgaggcgaaactgacggtgacgtatgagaattccgatggacagccgcagaccaaggaatttccggtgaaaatcaatgccgttgaagctcctgttccggatgattccgatacggatgttgacgtccaggatcagagcatgccggtctgggtgtggatagtggcggcggccgttgcactcgtcgtgattgtattgacggtcgtattggtggtccgtcgccgccgtaagaaggcaaagcaggtggccgatgatgacgattgggattgggagactgccgatcttggagccgataagcagggtaaatctactgccatggctgccgatgcgccgacgcaggtaatcgccacggcaggtggcacatcggccgcctccgtatccgcaacgtcatcttccactccatccgtcaaggagtaggcatgcgattttcggatatcgcacatacttgcgcgcagaatttgctgcggcgcaaatcgcgtacgattttgacggtgctcggcgtgatcgtcggctgctgctccatcgtcctgatgatttcgattggacaaggcatcagcgagcagaatgagcagatgctcaagagcatgggcaatctcaacgacattaccgtcacagctgccggcggctcgggcgcgtacgacagctctggcgtcggtatgtcgagtttgtcttcgtcggacatgacatcatcggatcagcaggccaagcttgacgatgctgcggtacagacgttccgtggcatttcaggcgtcgcagccgtgatgccacagcggtcggcgcagagcaccgtggatctcactgcgggagccggatcccgatacgtggctcaatatgcttctgtgatgggtacggatatgacccagcttgaagcatcgggatacaagctcgttcaagggcgtatgccgaggcgtgccggagaagtattgctcggcaaatacgcggcataccagtttatggataagtatcgttccgatgatgactccaggcgtatcgctcccggtgattatgagtgcgatgagaacggttgcaaggagagcgagggggagaagccgttcttcgacgtactgaccacgaaactcaatttgattaccggagccgattatcaaagccctgacgattaccgcaaaataggcagcacttcgatgagttccaccgattcaggcgacggcgatggtattgccagttcgcagaatcctgtggtttccatgcctctcaccgtggtcggtgtgttggacgctgcaaccaataattacgatgcattcagctccggtgtagtcatgtcgctggaggatatggacacattgcaggccaaaatcgacggcaaaaccaataccaccagccggaccaaaacaaactacgaccaagtggtggtgcacgctcaaaatatcaaggatgtgccgggtatcgaagcgcagatcaaaatgtctggctaccaaaccacgtccttcgaacagacccgcaaggagattgaaaagcagagtcgtggcatccagctcgcattgggaggcattggcgcggtgtcattcctggtggcggccatcggcatcgccaacaccatgattatgtccgtgtcggaacgcactcgggaaatcggcattatgaaggcgctcggctgctatgtgaatgatattcgcacgatgttcctatgtgaagcaggtgccatcggtctggtcggtggacttatcgcctgtctgatttccgccttggggtcgctgagcatcaatctgctgtcgtttggtggattcagtatggaaaacgtaggcaaagcgattatgggcggtgacgacgtgaaccgaatctccgtgattccatggtggctgtttgtcgtggccgtgttgttttcgattctggtgggcatactcgccggttttgggccagctaataaggctgtgaagattcctgcgttggacgccatcaagaacgagcaatagcgattgcgattgacaataatgcttatggtcggccatgtgctgttcagcgtgggccggcatttcgcgattgttcaacgttccctgtcgatttttgacggtgccggctagttgcgtgattaacgggccaagacgcggcgaatgcgatcagccaccgcttccacagtcagcccgtaacgttcgtcaagctcggcaaggggcacacgatcggtgaattctttcgatgcgccgaaattgagcgcatgcacagtggctgctttcggattagtggaattcgcgtagaacgcggtcactttctcaccccagccgccttccagctggccatcctccaaggtgacgaccacacgatggccgtcggcaagcacgtccagcagctcgccatccatcgcggaatactgctgcgcgtcgataagcgtcgcattgatatcgtcgtcgttttcgagcgttgccgccacctcggccgccaacggcagtgtattgcccaagccgagaatcgccacttcacgtcccggacgcacaatctggtaccgcgtgaaagggcaatcgccggtaatatcgatcgtcgtctcgtgcgtgtcggcacgttcggccgggtcgaacgccatatcggcggaacgctccatggcaagaatctgctcgccgggcatgcggatagccgtcacaccatgatcagacggccccgtggcccatgcaagcatgtccagcatctgctctccgctggtcggtgccagacaggtcacatcaggcgtgttggcgaacatcgtcatatcgaacgtgccggaatgtgtattgtccgcgccggaaatgcccgctccgaaaatcagcagcgtcgccggaacatgattcaacgccagctcctgctgcaactggtcgtaaatacgctggaagaacgtggcggaagtcgccagaaccggccggcctccagccttcgcgatgcctgcggcgaacgcggccgcatgctcctcggtaatgccggtgtccacataatgcgatccggcacgttcacggaaatcacgggtgatgccattcgaaccaggggtggcgggggagatgaccaccagtcccggctcgttttcgaaacgggactccaacgaagccatggccatctgaccgtagtatttgcgcgcgtcaagcggcttgccgagcgcgctgtccggatcctgccaatgattcgcctcgcattggccggcatgcggctgcggattggtctggttgcatccgtcggaaccatcctgcgcctcggtctcatcgctgaaacccaagcccttggtggtgtggatatgcagcacgacgggatggtcgatatccttcaagtcttcaagcgccgcgaccagcgtgtccacatcgttgccctgctccacataacggtagtcaagtccgaacgccttgaacagattcagctccgcggttccgttcgacgcgcgcagacgggcaagattgccgtacatgccaccgaaatcctcggcgatcgacatctcattgtcgttgacgacgatgatgagattaccgccctgttcggcagcgttgttcagtccttcgaaagcgatcgccgagctcaacgaaccgtcgccgatgatggcgatgacgttgccgatttcgcttgctcccgcagcggtatgttgcatatcacgtgttttggcaagaccgcaggcaagggagatggacgtgccggtatggcccagcacgaaggaatcatgctcgctttccaacggattggtgaaacccgtcacctcgccgaaccgcgactcgtccagatacgcctcggcgcgcccggtaagcatcttgtgcacgtagctctggtgggagacatcgaaaacgaaacggtcacgtggagaaccgaacacgcggtgcaacgccacggtaagctccaccacgccaagattcgaaccgatgtggccaccatgcttccggccgtaatccaacagcgtggaacgaatctccagacacagatcacgcaactgttgcgaagaaagggcatgcacatccgccggagaatgaatcgaacccagtatgccagcggtcattatgcgcaactgtccttccctgaacctgtcttctttaccgcggaaaatcctatcccactgtatgcctctgccggggtgtcggttgtgaaatacctgcaaagtcttctcaactgcggcacaatggaaacgatgaaatgaatcgaaccaccgaaaaaccgcgaaggagcgctgaccatgaaagccgtatacgtagcaggaaccgattatgacaatccgctgtcgcaactcaaggtgggggagctggacacgcccgaaaccaagccgttctggagtaccatccacgtggccgcagccagcgtgaaccaccacgacatctggagcctgcagggcgtgggactctccgccgaacagacgccgatgattctcggcaccgacgcgtcaggcgtgctcgacgaggacattcctgttcgcaaagggctgaaagccggagccgaagtggtgctctacaccttcgtcggcaccgacggcgccggcgtcatgccgggggagcggcgcaccatcctatccgaaaaatacgcgggcaccatggccgaaaccacccaagtgcccagcgccaacgtgttcgccaaacccgccaacctgaccctcgatgaggctgctgcgctcggcaccagctggctgaccgcctactcactgctgttcacatcggccaacgtgaaaccgggagacaccgtgctcgtccaaggcgcgggcggcggcgtgtccacagcggccatccaactcgcccatgcggcaggactggaagtgttcgtcacgtcacgcagcgaagagaaacgagaccgcgcgatcgccatcggagccgacgccgccttcgaaaccggcgcgcgactgccgcataaggtcgacgccgtcatcgaatcggtcggcgcggccacctggagccattccgtcaaatccgtacgccccggcggcaccatcgccatctgcggagccaccacaggagaccagcctggagccgaactgacccgcatcttcttccaggacattcgcgtgcaaggcaacaccatgggttcgcgtgacgacttcgcacgactgctcaaattcgtggaacacgccgacctgcaccccgtcatcgactccacctacgcgcttgccgacgcgcccgcggcgttccgcaaagtggtcgacggcgacgttttcggaaaggtcgtgctgcacatcgagccgagtaagtaaagtaggcggtgttctggaacacataagtctacgtaaatccttcggaggttttgatggcagacaacaagcctgaagtcgcggtgatcatgggatcggcaagcgattgggagaccatgaagcacgcatgcgagatgctcgaccagttcgaggtgccgtacatgaagcaggtgatttccgcgcaccgcaccccggaactgatgggtgagttcgcgcacaacgcccgtgccaacgggctgaaggtcatcatcgccggcgcgggcggcgcggcccacctgccgggcatggtcgcggcgcagaccacactgccggtcatcggcgtaccggtacgctcccacgcgctgtccggctgggattcgctgctgtccatcgtgcagatgccgggcggcattccggtggccaccaccgccgtcggcaactccggcgcaaccaacgccggcctgctcgcggtgagcattctgagcgccaccgacgagcgactggccaaggcgctgcaggactatcgtgactccctgaaggaaaaggtggctgaatccaatgcccagcttgtctgaggaaaccaacggccgtatcgaacgactgatgcccggcgcgaccatcggcatcatcggtggcggccagctcggccgcatgatggcgctgtccgcacgctacatgggcttccgcatcggcgtgctcgacccgacatccgactgtccggccgctcaggtcgcggatttccaagtgaccgccgaatacgacgacatcgccgccatccgcgaactggctgaaaagtccgacgtgctcacctacgagtttgagaacgtggacgccgacgccatcgaccaagtgcgttccctcgcggcggccccgcaaggcaccgatctgctgcgcgtcacgcaggaccgtgtcaacgagaagcggttcatcaacgaccatggcacgcccaccgcgccgtggaaggccgtcaacagcgtcgaggaacttgaagcggcacttgatgagatccactatccggctgtgctcaaaacccgttccggcggttacgacggccacggccagaccgtgctcaagtccgaagccgacttggagcaggtgcgcgcccgcgccgaccatgacggcagcttcccgccaagcattctggaaggcttcgtcgatttcgcgttcgaagcgagcatcctcgtcgccggcaacggcaagaattacgtgaccttcccgatcgtgcgcaacgagcatcgcaacaacatcctgcacatgaccatcgcgccggccgaagtggacgaaaccgtggccaaggaggcgcacgagctggcgttgcgactggccaaaggcttcgaactcgccggtattctggccatcgaactgttcatcaccaaagacaacaaggtcatcgtcaacgaactggccccacgtccgcacaattccggccactacaccatcgaggcctgctcgttcgatcagttcgacgcgcacattcgcggcatcgccggctggccgctcgaacagccgcagctgctcaagcccgccgtcatggtcaacgtgctcggccagcatgtggcgccgacccgtgcgctcatcgccgaccatcccgaatggaacgtgcacgactactgcaaggcggaagtgcgccacgaccgtaagatggggcacatcaccgtgctgaccgacgacaccgccaaaaccgtggccgaccttgaggccaccggctgctgggacgacttgaagaaagcctgacatcataggtaatgagtgaacatatcgtgcggcagacccgccagaaagacgccatccgcgacgcgctgaacggctgcgacgaattcatctccgcgcaggagctgcaccgcaagctggaagaccgtggcgaacatatcggactcgccacggtctaccggcagctcaacgccctggctgaagccggccgcgccgacacggtccgtctcgacgggcagcagctgttccgcctgtgcggcgatgacgggcaccatcatcacctcgtctgtacgaactgcggcaaaaccgtggaaattgaatcgccttccgaaagctggctgaaaggcatctccgacaagtacggcttcaccatcgaacggcacacgctggaggtgttcggcctgtgcgaggactgccggaaggcggacaagtagcggctgtctgccgtatttccgttggaatcgtatcgccatcggcgcaatccaatcgtaaaaatcgtaaagaaaaaacgttggacgttgtctttttcagacgcatatatgacaatagggcattgcaaacgaactaagtggggttatgcgtgaccaaagcaacatcgaaaaacgagccgattgaggagctcgacatcgctaccgtggacccgatggccaagaaagcgggcaaggagttccccggctggctctacggcgtgctattcgtgctgttcgatgcggtgggcgttgccgccctgcagatcggtgtcagcgaatccgccactcgagtccaactatcgaacaacatgtggctcaccggttggggattcgtcggcaagatgttcaccagcgccaatttcgtggcggtgctgaacctcatcctatggggcgtcctgtatgtcattctgctgatgctcaccaatcgtttctgggtggccacgccggtttttctggcagtcacgttcatcatcgccgtgattgagcatttcaaggtttcaatacgatacgaggcgattctgccaagtgatttgaactttctgaaggccgacgccggcaatctgatgagtttcatgccgtccggcgcgcaatggaccattctgatcgcggtggcggcgtttgccgcgttcgtggcgctgttcgtcttcctgaaccgcctcgacgcgcgtcacggcagactgtttcgcggctccgataagcgatcccgctccgtgaacgcgatcgcaagactgctgctgatcctgcttccaggcctgttcttcacgctgtattcgatgcaggtgagcaccgtcggctcgtgggccaaaggcttcgccaccgtcatgggggacaagccctccatgtgggactccgtatacgacgcccagcgcaacgggccgctggtggcgttcacccgtcagctcaacccgaaagtcatggtcaagccggacgactattccgaagagaccatgaagcaggtcgcggcccgctatgagaaggccgcgaagaagatcaacgcgaaacgttccgcgaacatgaccgacagcaccgtcatctacgtgctgtccgaatccttctccgacccgtcccgcgtgccgggactcaaagtcaacaaggattccataccgaacatccgcaagattaagcagaataccacgtccggcctgatgctgtcctccggatacggcggcggcaccgccaatctggaatacatgggactgtccggcctgagcatggcgaatttcgattcctccctgaccagcccataccagcagctggtgccgagcgagcattggacgccgaccatcaaccagatgtggggcgcgtccaagaactccatcggactgcacccgtacgagtcgtccatgtattcgcgcgccaccaactacaagaagttcggcttctcgcatttctacacgctgaccgggccggacgtcatctcgcatcaggacaagatcgacgattcgccgtacgtctccgacgaggccacctaccaaagcacgctggaggaagtcaggaaaaccaagtcgaaccagttcctgcaggtcatcaccatgcagaaccacatgccctaccatgactggtacaagcacaacgacttcaaagcctcctccaccacgggaaagccgttgaaggacgacgagaaggaatccatcgaaacctaccaaaagggcgcgtccctgacggatggggcgaccgccggattcctcagcgaactcgacaagctcgacaagccggtcaccgtggtcttctacggcgaccatctgccgggcatctactcgtcggcttccgctgatgacggcaactcgctggcgttacatcagacggactacttcatctggtccaacaaagcctccggcacgcaaggcaacaagatcgacaacgccgaatactcgtcgccgaacttcttcgtggcccaggcggccgagcacatggatgccaaagtttccccatacctggcgttcctcaccgaaatgcattccaagatctccgccatggaaccgccggtcgtgaacaacatccaaggctgggaccgcatccccgaaggacagaacatctatctggactccaagggcgagcccatggccgaagacgatttcgacgccgaaaccagacagctgctggccgattaccggctcatccaatacgacatcaccacggggaagaattatctgaaaaacacctcgttcatgaccctgccgtaacgaggacggcgcgccttccgcacggcactacactcgacgtacctttgtacgccttcgtgtcgtgccgcgtggaattcgcgcgcgtctgagaatacgctaaggggcttgttccaattatggaacaagccccttaaaacgtttcacggcgtcagcatgacgtcacatcatgcgttcaacgccttgaaaccgatgtcgtgacggtagaacattcccgtcgtgtcaagcttgtcgatgatgccgtagaccttgtcctgcgcggttttgatatcggccgcggaggtctccacgaaaagcacgcggccggaattcgccaccaggccatgctcgccacgcgtcacgccggcatagtagacgtgggaatcgtcgtcgaccttgatctcaggaatcgcggcacccttgaccacattggtcggatagccgtcggaagcgagcaccacgccgagagtggcattgtcctcatcccaagtgaattccggggtctcatcgttcagaatggcgttgatgccggcaccgagatcggacgtgagcttcggcagcaccacttcggtctctggatcgccgaaacgcgcgttgaattcaatgaccttcggtccgtcggcggtggcgatgaggccggcgtacagaatgccggtgaacggcgtgccctcgtcggccatggcctgaacggtcggcttgacgatggtttcgatggcggtgtcgatcacatcctgaccgatctgcggaaccgggctgtaagcgcccatgccgccggtgttcggccccttgtcgccatcgtaggcacgcttatgatcctgcgaaatcggcatcggccagaaatcggtgccgttcacaaagctcatcagagagaattcctgaccctcaaggaaatcctcgataaccaccttcgcgccggcgttgccgaagcggtggtccacgaaaatgtcctccaaagcggcgatggcggtctcctcatccatcgccacggtcacgcccttgcctgcggccaggccatcggccttgatgacgatcggcgcgccatgctcgcgcacataagcggtggaacgctccaaatcgtcgaacgtctggtacttcgcggtcggaatgtcgtgacgttccataagctgcttggcgaagtccttggaaccctcgatctgcgcggcggccttgttcgggccgaacgccttgatgccggcggccgcgaaatcgtcgacgatgccttcgataagcggcacttccggtccgacgaacacccaatcgtaaccattgttcttcacgaaatcgatgagcgccgcatgattggacgggttgagctgcgtggtgcggatgccgtcaagttccatgcccggattgcctggagccacagtgacctcgctgacgctgtcgccacgcatgagcgcgtgggcgatggcgtgttcacgcgcaccggaaccaatgaccagaaccttcatatttcctcctgttgtatcccttatggggaagagtgccaatctcaagaaataatatcgggggtgcctgttcggctacccccgtatgttcgtttactgcagttcgacgtcctcgccggtcttcttgacgatattgcccagcacatagccggcctcgccattggacttcagcagttccatggtcttatcggcatcttcggcgctgaccgccagcaccatgccgatacccatgttgaagatgttgaacatttccatatggtcgatttcgccggccttctccagcacgtcgaagatcggcagaaccggccaagagccgaggttgatatgcgccgcgagaccatcggggatcatacgcgggatgttctcgatgaagccaccgccggtgatgtgcgcgacgcccttgaccacgccggccttgaacagcggggacagcgtcttgacatagatcttggtgggggtgagcagcacgtcgccgagcttctcaccgccgagctcatccagctgggtgtcgacggtgtatccggcctgttcgaacagggccttgcgcaccagggagaagccattggaatgcacgccggtggagggaaggccgatcagcacgtcgccttcgacaatcgaggaaccatcgactatggcggacttctcggccacgcccacggcgaaaccggccaaatcgtactcgtcctcgtcgtacatgcccggcatctcggcggtctcgccgccgatcaggccgcaatcggcctgcacgcagccgtcggccacaccggatacgacctgctcaagcagggcaggatcgttcttgccgcaggcgatgtaatccaggaagaacagcggttccgcgccctgggccgcgatatcgttgacgcacatggccacgcagtcgatgccgatggtgctgtgtttgcccgccatcttggcgacgaccagcttggtgcccacgccgtcggtgccggaaatcagcaccggctccttgtaacccagggaggcgagatcgaacaggccgccgaatccgccgatgccgccgaccacgcccggacgattggtgcgcgccacatgcgacttgatgcgcttgacgacttcgtaaccggcttcgacgcttacgccggcttcttcatatgcttttggcatatcaaacctttcttgggtctcagtgttcttcttggggtgaagtggtggtgtactcgttgccttcgtacttgctcttgtacagggcgaattcgggtagtcggacacgatcctccggagtgagcgacttcaggaagtcggcttcgtaatcgtccaacgcggtcgggtaatcgccattgaagtaggccacgcacaggccgccatacggtgcgtccgcacccagaccgatggattcgaccaaaccgtcgagggaaaggaacgccagggaatcggcgccgatgtattcgcggatctcctcaacggacttcttcgcggcgatgagctctttggtggtggagatatcgatgccgtagaagcacgggtatttcagcggcggcgagctgatacgcatatgcacttcggccgcgccggcctccttgagcagctgcacgatgcgcttggacgtggtgccacgcacgatggaatcgtcgatgacgatcacacgcttgcccttgaccacgccacgaacggcggacagcttcatgcgcacgccctgctcgcgcagttcctgcgtcggctggatgaaggttcgcgccacatactggttcttgatcagacccatttcgttgggcaggccggcctcttccgcatagccggaggctgcggacaatgaggaattcggcacgccgatcaccatatcggcgtcgaccggcgactcctgcgccagacgtgcgcccatacgcttgcgggcggaatgcacgttcacgccgtagatatcggaatccgggcgggcgaagtagatgaattccatcgagcagatggccagctgcgtctgattcgtgtactgcacgatcttatagccgtggtcgtccaccaccacgatctcacccggacggatgttacgtaccaattcagcgccgacgacgtcgagcgcgcaggtttcggaagcgagcacatacgcgccgttcttcatcttgccaagggagagcggacggaaaccgttcggatcgagtgcgccgatcatggcgttctcggtcataatcagataggcgaaaccgccatgcacgatgttcagcgcttccttgagcttgtccataaacgtgcgttgcgtggagcggcggatgaggtgcatcagcacttcagtgtcggaattggaatggaagatcgcaccctcatcttccagcttgcggcgcagggacaggcaattcgtgagattgccgttatgacacagcgccatatcgccgtcatggaaacggaagatgaacggctggatgttgtcggtgccgccggagccggcagtggcatagcgcacatggccgatcgccctgtcgcctttgagtcgtttgatttcacgctcgtcgctgaatacctgggtcagcagacccgttccgcgatgaccgatgagatgaccgttatcgttggagacaatgccggcaccctcctgaccacgatgctgcagcgcgtgcagaccgaagtaagtgagtcgggcggcgtccgagtggccccaaacgccgaaaataccgcattcctcgtggatgtcttcgagttcagctgacaagccaaagctccttccaaaaccatggagacaaggggttcgctaccgtccaacagtatcaatgggcggctacaagagtcgggttttgtccagttctcagacggtatatggaaccggacatgcaatcgaacagccgttcgaaaaagctgttatgatggaagacgttgaaaacgcgaatcacggtcgtcggggtgcgggaagtcccccgtatgagccattgcatggaaggagcatcatggccggacggatatacgtggcaatcgacctcaaatccttctatgcgtcctcggaatgcgtggaacatggattccctccgctatccacacacttggtggtggcggaccaggagaggaccgacaaaaccatctgccttgcgatctcgccgtcgttgaaggcatacggtctgcccggacgcgcccgcctattcgaagtcaaagcgaaactgaaggaaatcaacgcggtccgtcgcgccgcggctccaggcggtgtgctgacggggaaatcgtatgatgcgaaggcgctcgcggccaatccgaatctggccgctgacgtgttcatcgccaaaccgcgcatgtctcattacttggcgatgagtgcgaaaatctacggtatttatctgaaatacgtttcggctgaggatatccacgtctattcggtggacgaggtgttcatggacgtcaccggctatctgcgcgcctatggcaaaggggtggaggagatgacccgtgacatcatccgtgatatccacacccagaccggcatcaccgccaccgcgggcatcggcacgaacatgtatctggccaaagtggctatggatatcgtggccaaacacatccaggcgggggaggacggcattcgcatcgcccggcttgacgagatgtcgtaccggaaattgttgtggaatcaccggccgcttaccgatttctggcgtgtggggcgtgggtatgcaaggaagctcgaagcgcacggactggcgaccatgggggatatcgcgcgctgctccatcgggcgtgccgacgaatactacaacgaagatctactgtacaagatgttcggtgtgaacgccgaactgctcatcgaccatgcgtggggttgggaaccgtgcaccatcgcggacatcaaagcgtacaagccggcggggcacagcttgagttccggacaagtgctgacgggaccggtgggttttgatgccgcccggcttatcgtgcgtgaaatggcggatacgctgtctctggatttggtggcgaagggcgtgaaagccggcagagtgggattgatggtcggctacgacacggcaagtcttgatccgaaacggcttggcaaggatgtttccgctgatttgaaggcgattgccgaacatgccgcggcaacatacgacggccctgtttcgatcgacaggtatggccgccgcgtacccaagccggccaccgggtcgatcgcattgccggagccgacgtcggctacgtcgcgtatttgcgacgcggtcgataagcttttcctttcgattgtcgacaggcgtttgctggtccgtcgggtgaatgtggtcgccgccgatgtactgaccgacgagcaacttgaggaacggcggcaggcggccgcgtccgaatatacgcagcctgatttgttcgccacgatggaagcgccggtggattccgcttccgctgatgcggccgaatgcgaggctatgcgttccgccgccgatggtggttccaaggattcgccgcaaggggacgccgaactgcatatgcagcaaacgcttctggacatcaaacgcaaattcggcagaaattccatcatcaaggccatggatatgttcgatgacgccacaggccagcagcgcaacaagcagataggaggtcatgcggcatgagccttacggaaacccatcgctacgacgacatcatcgatctgccgcatcaccaatcgcagacgcatgcccatatgagcatgcataaccgtgccgcccaattcatgcctttcgccgccctgaccggttacgacgacatcatcagacaaaccgcgcaatccagcgatgatgcggtggaacgcgccaacaggcccgtcgatctcgccgagggttacctttccgcctgaagcggctgctatgacgaatgtcgcggattgctgtatatgaaagggtgggttcggaatcatgagatttcgaacccacccttgattatgtgagcgtgaaaagagtcttgatgctcaggcggtgaagtactccacgccggctgcgaacagcggctgatccttctcgccgggcacgttcacgaacgtgccgttgctgtagcgctcggagtggcccatcttgccgaacacgcggccgtccgggctggtgatgccttcgatggccagcagcgaaccgttcgggttcacgtccagatccatgcccggcacaccgttctcgtccacgtactgcgtggcgatctggccattggccttgagctgggcgagcacgtcgtcggaagccacgaaacggccttcgccatgggagatggcgatggtgtgcatgtcgcccacctcggtcttcgcaagccacggggagaggttcgatgccacgcgggtgcgcaccagacggctctggtggcggccgatggtgttgaacgtcagcgtcgggcattcggcggtcatcggcacgatgtcgccgtacggcaccaggccaagcttgataagcgcctggaaaccgttgcagatgccgagcatcaggccatcacggttgttcagcaggtcgcgcacggcctcggtcacggccggagcgcggaagaacgcggtgatgaacttggcggagccgtccggttcgtcgccgccggagaagccgccaggaatcatgatgatctggctcttcttgatctcctcgaccaaagcggcggtggactcggccacggcagccggagtgaggttgttcacgataagcgtgctcacgtcggcgcccgcgcgttcgaaggcggctgcggaatcgtattcacaattgttgcctgggaacacagggatgatcacgtgcggcttggccacaccggtgccggtgtacacggtcttcttcggagcgtcgaaggacacggtttcaacggtcttgcccttctcgtcgccattggaacggtacgggaacacggattcgatgccgccctcccacgcgtcctgcagttcggccagatccagcgtctcaccggctgccgcgaactggtaggcctcggtggtctcgccgacctcactgacctcaaccaggttggatacggccggaaccttcgcgttgtcggcaagttcgatgatgaaggaaccataggccggggcgaacaggtcgtccacgctgatgccatcggccagcttcacgccgatctggttgccgaccgtcatcttgaagatagcctcggcggtggcaccgtagccaggcgtggacacggccagcgcatcgccgaaatcggtgagctcctcgaccgcggagaacacctccagcagcgcgtccttatccggcgtgagaccatcggcgttatagcgcggggcgatgcggaccacacggtgaccggcacccttgaactccggggatgtggcgcgcttcatattgcccacggctacagcgaaggagatcagggtcggcggaacgtcaagctgttcgaaggtgccggacatggaatccttgccgccgattgcgccagcgcccagatccacctgggccatcaaagcacccagcacggcggccatcggcttgccccagcgttccggctcgtcgcgcagcttctcgaagtactcctggaagctcaggtatgccttctcatgctcaaaaccggcagcgaccagcttcgagagcgactcgaccacggacaggtaggcgcccgtgaactggttctgctccatgatgtacgggttgaagccccaagccatcgcggaggcggtggtggtctcgccaaacaccggcagcttggccaccatggccatgttcggggtcagctgcttacgcccgccgaacggcatgagcacggtgcctgcgccgatggtggagtcgaagcgttcggaaagtcccttgttggaggccacgttcagatcggtgagcatggtgtgcatgcgttcggcgagcgtgccggtcttccacggggtggcgtagccgtgctgcgcctcgacatgcaccacctgatgcttcggagcgccattggaggcgaggaactcgcgggacagatccacgatcgtgtcgccgttccacaccatcgtcatgcgcggctcttcggtcacggtcgcgatgacctcggcctcgaggttctcctccttggcgtagcccaggaactcgtccacatcttcggcggccacgtccacggccatgcgttcctgcgattcggagatcgccagttcggtgccgtcaagaccctcgtacttcttggacaccttgttgaggtccacatacaggccgtcggcaagctcgccgaccgccacggacacgccgcccgcgccgaaatcgttgcaacgcttgatcagacggcacgcgtcaccacggcggaacagacgctgcagcttgcgctcgaccggcgcgttgcctttctgcacttcggcaccgtcaagctccagcgattcgacgttatgcgccttggaagcgccggtggcgccaccgatgccgtcacgaccggtacggccgccgagcaggatgaccttgtctcccggagccggggtctcgcggcgcacatgatcggccggagtcgcggccacgaccgcgccgacctccatgcgcttggccacatagcccggatggtagatctcatccacctggccggtggccagaccgatctggttgccgtaggaggagtagccagccgcggcggtggtgacgagcttacgctgggggagcttgccctcaagcgtttcggaaaccggcacggtcggatcggcggcaccggtcacacgcatcgcctgatacacgtaggaacggcccgacagggggtcgcggatgcagccaccgatgcaggtggccgcgccaccgaacggttcgatctcggtcgggtggttgtgcgtctcgttcttgaacaggaacagccaatcctcgtcgtggccgttcacatccaccttcaccttgacggtgcaggcgttgatttcctcggattcgtcgaggttcttcagaatgccgttcttcttgagccacttcgcgccgatcgtgcccatatccatcaggcataccggcttggcgtcgcggcccagctcgtgacgcatctcaagatacttgtcgaacgcggccttgacggtggcatcgtcgatcgaaacctcgtcgagctgcgtgccgaacgtggtgtgacggcaatggtcggaccaatacgtgtcgatcaccttgatctcggtgatcgtcgggtcgcgctgctcctcggtgaaatgctcgcggcagaactgcaggtcggccagatccatggcgagaccacggtcttcgatgaactgctcaagctcggcgtcgctcatagaacggaagccgttgatgacctccaccttgcctggcaccggcacctgggccttcagcgtggtcttgacatccagagaggcttcacgggcttccaccggattgatcacgtaatgcttgatggcctcgacgtcggcttcggaaagctcgccttccagcgcatacaccttggcggaacgaaccgtcggacgctcgccttgggagatcagctggatgcactcgctggcggaatccgcgcgctggtcgaactggccgggcagatactccaccgcgaacacggtgtcggaaccgaaatcaggcaggtcggcgtagacgttgtccacctgcggctcgctgaacacggtcggcgtggcctgggcgaacagctcctcgctgatgccttccacgtcgtaccggttgacgagacggacgttcttcaaagctccgatgccgagaatggtgtgcaactcgttggcgagctgctgggccgcgacgtcaaagcccggcttcttttccacgtacacgcgaaaaaccatggtcaactccttgaaaaagaggggttattggatttggattgacaaaagaatgaaggattgcgatataacaaggaagcccgcatccggctttcgcttcagatgcgggcttgcaaacgcattactctgcgacttcgatgccctcggacttggcgagctcggccaagcggctttcgatctcctcgtatgccgggatgatgtcgcccaggtcgcggcggaacaggtccttatcaagatgctccaccttgccggagtggtcgcgctgatcccacaggcggcaggaatccggggtgatctcgtcggcgagcagcagcgtgccgtcggaggtgcggcccatctcgatcttgaaatcgaccagcttgacgtcgatcttggcgaagatttcgatcagggcttcgttgatgcgacgggcgagcggcgcgatttcggccagatcctcgcgggtgcacacatcgagcgccaccagatcgtcgtcgttcacgaacgggtcgtgcagttcgtcgttcttcaggaagtactccagcaccggttccttgagctcgatgccctcttcgacgcccaggcgggagcagaagtggccggccgcggtgttacgcagcacgatctcgagcgggaacatcgtgaccttcttgaccagctgggaggtctcgcccacgcgtgccaccaggtggctgtcgatgccgcgcttcttgagcagatcgaagatcagcgtggtgatgaggttgttcagcctgcccttgccggcgaagtcttccttcttttcgccgtcacctgcggtagcggagttcttgtattcgacccagaggacctccggatcgtcagttgcgtacagttgcttggccttgccctcgtagagcttttccaacttctccattactcgcctttcctggtgtttgggaggtagatagtttggtgaacttgacagttaacaagataccaacgggaggctacaatcgcgcgacttttgggcgcgttccggcagcctcgtctcagcatccggcgatagccgtcaaacgattgcgatgtcgagcgattcggccacgttcccggctttggcgcgcgcgtccgcctcgtcgccgccgacggccagcgcgaccgccatgcgtcggtgcccatgcacttccggcttcgcgaagacacgcaggtcggtacccggttcggcgagcgcggcggcgacgttgcggaattccgcttcgccatcgccttggacgacgatcgcatggcttgccgcgacggtgccttccggaatcgacagggcgacatgttcctgtgtgatcggcaggccgaggatcgcgcgcgcgtgcaatgcgaattcgctcaaccgctgggaagccatggtgaccatgccggtatcgtgcggacgaggggagacctcgttgaacagcacgtttccgtcggtcagcacgaacagttcgacgccgaacacgccccagcctttttcgccggaagcctgggccttcgccaccagaccttccacggcggttcgtgcgatgtgctgcgcctgttcgagcacgtccggcgtgaaggtggccggctgccaggattcgcggtagtcgccgctttcctgacgctgtccgatcggagcgcaggtcacgatgccggcgctggagctgacggtcagtacggtcagctcgtagtcgagcggggcgagcgcctccacgatcacgcgtgacacgtcgccttcgtcgtgtgcgcggcggccttcctgcgcttccgtccatgcggcgtcgatcgcatccgcggaacgtaccacggactgtccgtggccggaggagctcatgatcggcttgaccacgcatggatagccgacgatttgcgcgccctcacgtagttcttccagagagccggcgaaacggtacggggtggtcggcagtcccagttcctcgtgtgcgagcacgcgcaggcgctcgcgatccatgcagatcgccgcgatttcggcgcttggcaccacctgcgcgccacgtgctgcggcggccgcgagttcggaggtggcgatcgcctcgacttccggcacgatgatgtccggctggatttcgtcgaacagcgcgcgcagctggtccgcgttggccatgtcgagcacgcggtattcgtgcgccacctgttgtgccggcgcgccggcgtaggaatcggccgcgcacacccatgcgccgagtctcatcagttcgatggtgacttccttgcccagctcgccggagccaaggaacagaacacgggtcggatgcttgccaagcggagtgccgagggcacgattctcttcagtcatgacttctattgtgccatcggcgtaggatggaacgcatgtccgagaatgaaaagaatgaaacgcagcgccccctgaccattgccatggtggtcgacacgtcggggaatcggggcaatggcacctcgaattcggcgttgcagtgggcgcaggagctggagcgccaggggcatcatgtccgtttggtgggcatcggcgcgcccgaatatcccgcgcgcgtcaatcatgtgccgttggtcagctgggtggcgaagaagcagcagatgcagttcgccgagccgagcgacacgctgtttcgcaaggcgttcgatggtgtggacgtggtgcatatctacacgccgttccgtttcggccagcatgcctgcaaggtcgccaaacagatgggcatcgccgttacggccggctaccacgtgcagccggagaacgtcacgtattccgcggggcctttgaaatatgtgcccggcatcgactcgttcatctactggctgttcgacatatggctgtaccgcaagatcgaccatgtgcatgtgccgaccgaattgggtgcgagcctgctgcgctcgcatggatacaagtcgaagctgcatgtcatctccaacggctacgaatcgcggttcacgccgaagcggcagcgcaaggcggacgagccgtcgccggtgccgttccgtatcgtcgcgtcgggacgactgaccaatgagaagaaccatgtcgcgttgatccgggcgatcgcccgctgccgtcacgcgcaggacatcgaattggtgatcgccggcaccgggccgcttaagaagaggttgcagcgtatggccggacggctgttgtctcgtccggcttcgatcggattccaccggaatgccgacatgccggcgttgctgcgttccggcgatctgctggtgcatccgtcgatcgccgatctcgaatcggtgagtgtcatcgaaggcatggccgccggtctggtgccggtgatcgcctcgtcgtcgctgagcgcggccggccagttcgcgctgctggacgaatcgttgttccccgtggacgatgtggacgcgctggcccgtcgtatcgactggtggatcgaccatccggcgcagctcgccaagtggggcggcacctacgccgaacatacgaaaaccaattattcggtggaatcgtccgtacgtaagttcgtcgcgatggaacgtgaggcgatcgccgataaccgtcgctgaatggcgcctgccgcaatcgcaatacaatcgttatacataagcggaaagccgggagcgatttcccggctttccttgttttgcggactgtcttttacagcagtgcgaccagctcgtccacctgctcgtcggtcgtggcccagctggtgcagatgcgcatcacggtatgcgcgtcgtccgccttttccgtgaagccgagacggacgtcgcgttgcagacgttcggaggtctcgttgtcgagcgtgacgaagatctggttggtcggcgcatcgaaagtcagcgtgtagccacgttccaccagcaccttgcggatacggtccgcggcatcgttggcgtggcgggcgatgcgcaggtacaggccgtcggtgaacaacgtgtcgaactgcagtcccagcagccatcccttggccagtagcgcgccatgctgcttgacgatcgtcacgaaatgctttggcatgttgccgtgcgtgaacaccacggcctcgccgaacatcgcgcccaccttggtgccgccgatatagaacacgtcggcgagacgcgcgatgtcctcgatcgtcacgtcgttgccggtggcggtcagcgcgtagccgagacgcgcgccgtcgatgaacaacggcatgtcgtacttcgtgcagaccttgcggatcgcctcgagttcggccagcgtgtacagcgtgccgtattcggtggcctgcgaaatgtacacgcagccggggaacaccatatgcgtgtagttgccgtccgcgtagaacgtggcgcagtattcgtcgagttcatccgcgttgattttgccgtcatggtgggggagcgtgagcaccttgtggccggtgaattcgatagcgcccgcctcatgcacgttcacatgtccggtggtggccgccaccacgcccgcatacggcggggtgatggcgtcgatgacgacctggttggtctgagtgccgccgacgaggaagaagatttcggcgtccgggcatgcgcaggcctcgcggattttggctttggcgctttcgcagacgtcgtcggtgccgtagccgggatactggttgggcgcggtttcggcgagacgggcgatgatttccggcgtcgcggcgcaggagtagtcgttttcgaaagacagcatggtcgttccttttgttgtgggttgcttgcgatcgggaaagtctggttccgcgcgttcggcctccgcggatagcaaaaaacctcggaatttcttccgaggtttcaccggggtggctaacgcggctcgaacgcgcgaccttctgaaccacaatcagatgctctaccaactgagctatagccaccatgttctcacttccatgcggaagcgcaacgaatggatactatacacgattttttggatgcgcgcgcgtcggcgtgttgcgctttcggctgccatgtgatgtgcattatgtgaacggaatgttacgcacttgatggatgggtgcctaatttgtaggcaattccaacggaagatgtcacgacggggtcggcagaaagccggtcccgttttgttttcctcggaaatgacttccatggaaacgtgattgagaaaagaggaaacgataatgcagaagatcaaggcgtttggtgattggctcaccaaatggttcaccgtgatcgtgatcgtatgggccgtgttcaactacttcgtgccgcaaaccagcctgtggggcaagtcctacaccggatacttcctgggcatcgtgctgttcggcatgggcctgacgctgacgctcgacgatttcaaacgtatcctcacccagccgctgatggtcgtcgtcggcacggtggcccacttcgtgatcatgccgttggtggccgtgctgctgtgctggatcttccgtctcgacggcccgcttgccgtgggtgtgattctggtcggctgctgcccgtccggcacctcatccaacgtgatgagctatctgagccgtggcgacgtggcgctcgacgtgtccatcggcatcctgtccacgctgtgcgcgccgttcatgattcctctgctgatgcagtggctcgcctcccagtatgtgaccgtgccggtcgagtccctgttcctcaacgcggtcaaggtggtgctgttcccgatcgcgctcggtgtgatctgccacgccatcttcaaggagaagatcgagaaggtcacggtggcgctgccgatcgtgtcccaggtcgccatcctgctcatcatcggcgtcgtggtcgcagccaatggtccgaagctgttcgtggcatcctcgctgcttgccatcccggtggtcatcctgcacaacctgtgcggttacgcgctgggcttcggtttctccaagctcatgtacaaggtgtatccgaagggcttccgctacgcgcagcagaaggccatcaccttcgaggtcggaatgcaggattccgctttgggcgccacgttggccttgagctccttcgcgtccaacccgcttgccgccgtgccgtccaccttcttcagcgtatggcacaacatctccggttcggtgctgtccagctggtggcgcgagcacgatgacaagcatcagatccacccggattccgacaatggcgagaagggttccgcggccaaggcttcggaagccggggacgccgtcaaggatgagtccgaggaaacggtcaacgcctgaatgtgattcgtggcatcggccaggcagcctctgaaccgtacagaacggttcagaggctgttctgttttgacctgtttttccatggcgatgttagattgtgttgctttgcgctgaagttcggttaagtattgaaaatattgggatttaggggtgttttgccccgtgtcatatgttcgtttgcggtatactaaaggtgaaggccggagttgcggatcggtcgagaattcgtcaggtcgcaatgaagcgccgatggccgtgaggcccatgcgcaacgccttcaagatataactgaagaacaaccgaatatagcgattcgagatggcggcataggcagtacggcgaggacgccgggccgcatggggttatgaaaagactcagaggtttgaagcgatgcgcgcaaggtggcgcgtgggagagtggctccgatgccaggatggcgtcggagccactcttcgtataacggccgttgctgtcgcgacacgattatccagcattgtccggcagacctgtatactggtaattcgtgtgtgccaacggcatgccttatgtaacaggcgtgcgggttgggatatcccggaactcgattgcatcacgcgcagcaatgcggcggtgagagagggacgggccatcgggccggtggactgtggctatctttacgattcagtgtcgtggagtgtgggtgcagtgcggcggtcacgcgaaaccaagagaaaccactgaatcggagaattcaagttgcctactattgaacagctcgtccgtaagggacgtcaggcaaagccgaagaagtccaagactttggcactgaagggaagcccgctgcgtcgtggcgtgtgcacccgtgtttacaccaccaccccgaagaagccgaactcggcactgcgtaaggtcgcccgtgtgcgcctgagctccggtgtggaagtcaccgcatacatcccgggcgaaggccacaacctgcaggagcactccatcgtgctcgttcgcggcggccgtgtcaaggatctgccgggtgttcgttaccacatcgttcgtggcgccctcgatacccagggtgtgaaggatcgcaagcagggtcgttccctgtacggagcaaagaaggcgaagtaagagatatgtcacgtaaaggaccttccaagaagcatcagctgctgccggatccgatctacggttccaccgttgtggcacagctcatcaacaagattctgcttgacggcaagaagtcgatcgccgaggacatcgtctacagcgctctcgacatggtcaaggagaagaccgaccaggagccggtcgccgttctcaagcgcgctctggacaacatccgtccgtccctcgaggttcgctcccgccgtgtcggtggcgctacctaccaggtcccggtcgaagtgaagccgggccgcgccaacacgctgtccctgcgctggctcaccgacttctcccgcgcccgtcgcgagaagaccatggctgagcgtctggccaacgaaatcctcgatgcctccaacggcctcggtgcttctgtcaagcgccgcgaggatactcataagatggcagaggccaacaaggccttcgctcattaccgctggtaattagtcgagaacgagagttaaggaacaatcatggcactagacgtgctcaatgatctcaaccagatccgtaacatcggcatcatggctcacatcgatgccggtaagaccactaccaccgagcgtattctgttctacaccggtaagaactacaagatcggcgagacccacgatggcgcctcgacgatggacttcatggctcaggagcaggagcgcggcatcaccattcagtccgctgctaccacctgcttctggaaccgtcagacccatgacgagaagcagaagttccagatcaacatcatcgatacccctggccacgtggacttcacggccgaggtggagcgctccctgcgtgtgctcgatggtgctgtcgccgtgttcgatggcaaggaaggcgtggagccgcagtccgagaccgtgtggcgtcaggctgacaagtacggcgttccgcgtatctgcttcatcaacaagatggataagctcggcgctgacttctactactccgtcgacaccatcaagaccaagctgggcgcgaccccgctggtcgtccagctgccgatcggcgctgagaacgacttcgccggcgtcgtcgacctgatccgcatgaaggcctacgtctggaacgacgtttccggcgatctgggtgcccactacgacaccaccgacatcccggccgacctgcaggacaaggctgagcagtatcgttccgagctgctcgaccaggtcgccgagtccgacgaggagctgctcgagaagtacctcgagtccggcgaactgaccgaggacgagatccgcgccggcatccgcaagctcaccatcaaccgtgaggcctacccggtgctctgcggctccgccttcaaggacaagggtgtgcagccgatgctggacgccgtcgtcgactacctgccgagcccggaggacgttccgtccatcgtcggcttcgacccgcaggacgagtccatcgagatcgaccgcaagccgaccaccgatgatccgttctccgcactggtcttcaagatctccacccacccgttctacggcaagctcgtgttcgtgcgcgtgtactccggttccgtcaagccgggcgacaccgtcctcgactccaccaaggagaagaaggaacgcgtcggcaagatcttccagatgcacgccgacaaggagaacccggtggatgccgccgaagccggcaacatctacaccttcgtgggtctgaagaacgtcaccaccggtgataccctgtgcgacgagaagtccccgatttccctcgaatccatgaccttcccggatcctgtgatcgaggtggccgtggagccgaagaccaaggccgaccaggagaagatgagcatcgctctggcgaagctgtccgacgaggatccgaccttccaggtgaagaccgacgaagagtccggccagaccctgatctccggcatgggcgagctgcagctcgacatcatcgtcgaccgtatgcgtcgtgaattcaaggtggagtgcaacgtcggtaacccgcaggttgcataccgcgagacgatccgcaaggccgtcatgaaccaggaatacacgcacaagaagcagaccggtggttccggccagttcgcaaaggtcctgatgaacttcgagccgctcgacaccgagaacggcgagacctacgagttcgtcaacgaagtcaccggcggccacatcaccaaggaattcattccttccatcgatgctggcgtgcaggaagccatggaatccggcatcctcgccggcttcccggtggttggcgtcaaggctaccgtcaccgacggccaggtccacgacgtcgattcctccgaaatggccttcaagatcgcaggttccatgtgcttcaaggaagctgccccgaaggccaagccggtcatcctcgagccgatcatggccgtggaagtgcgtactccggaagagtacatgggcgatgtgatgggcgacatcaacgcacgtcgtggttccatccagtccatgaccgactccaccggtgtcaaggtcatcgatgccaaggtcccgctgtccgagatgttcggctacatcggcgatcttcgctccaagacccagggccgcgcaatgttcaccatgcagatggactcctacgctgaggttccgaagaacgtctccgaggagatcatcaaggcccagcgcggcgagtgacacgcgctgccactgaagtggaaactgtctccagtcagcgctagtattttgtagcgctgactgggttcgggctccaaagtggcacaaacccgtcaaacccagtaaaatgtagcgagtgccttgaagtgagttcaaggcttactacgagacgtccaggaggacaaacacatggcaaaggaaaagtacgagcgtactaagccgcacgttaacattggtaccatcggccacgtcgatcacggcaagaccaccctgactgcagccatctccaaggtgctgcacgaggagtacccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgatcaccggcgccgctcagatggatggcgccatccttgttgtggccgccaccgacggcccgatggctcagacccgcgagcacgtgctgctcgctcgtcaggtgggcgtcccgaagatcctcgtcgctctgaacaagtgcgatatggtcgacgacgacgagctcatcgagctcgttgaggaagaggtccgtgacctcctcgacgaaaatggcttcgatcgcgattgcccggtcatccacgtgtccgcttacggcgcactgcacgatgacgctccggaccacgagaagtgggttgagcagatcaagaagctcatggacgccgtcgatgactacatcccgaccccggtccacgatctggacaagccgttcctgatgccgatcgaagatgtcttcaccatctccggccgtggcaccgtggtgaccggccgtgtcgagcgtggtaagctcccggtcaactccaacgtcgagatcgtcggcatccgtccgacccagaccaccaccgtcacctccatcgagaccttccacaagcagatggacgagtgcgaggctggcgacaacaccggtctgctgctccgcggcatcaaccgtgaccaggtcgagcgtggccaggttctggctgctccgggctccgtgaccccgcacaccaagttcgagggcgaagtctacgtgctgaccaaggacgaaggcggccgtcactcgccgttcttctccaactaccgtccgcagttctacttccgtaccaccgacgtcaccggcgtcatcaccctgccggaaggcgttgagatggtgcagccgggcgatcacgctaccttcggcgttgagctgatccagccgatcgctatggaagagggcctgaccttcgcagtgcgtgaaggcggccacaccgtcggctcgggccgtgtcaccaagatcatcgagtagtttctacccgacatcaagacacgcttgaattagcgttttaaagaaacctcccaaggatgcgaatccgagggaggtttctttatatatggaagggcaatgctccaaagtatgcacgccgtggcataatgagcaaggctttttgtaagcttttccgtcagatgaagaaataggtgagttaatttggcacagactaccaatgacatcaagaacggttctgttctgaacctcgatggccagctgtggaccgtcatcaagttccagcacgtcaagccgggcaagggccccgccttcgtgcgcaccaccatcaagaacgtgctttccggcaagatcgtcgacaagaccttcaacgcgggcatgaagatggaattcgaaaccgtcgacaaccgcaacctccagtactcctatgaagacggcgacaacttcgtcttcatggacatgaccacctacgaccagatcttcattccgaagaccctggtcggcgaccaggccaagttcctgctcgaaggcaccgactgcgtcgtgtccttccacgacggcaccccgctgtccgtcgagctgccggcttccgtcgtcctgaccgtcacccacaccgagccgggcctgcagggcaaccgttccaacgccggcaccaagccggccaccgtcgaaaccggcgccgagatccaggtgccgctgttcatcggcgaaggcgagaaggtcaaggtgaacaccaccgacggctcctacctcggccgcgagaactgagagtaaggacagcgaagtttcatggcacgttccaccgctcgcaagagggctctgaacacgttgtatgaagcggatgagaagggacaggacatcctgtcccttcttgctgagcgcatcgagcagcccggcgctcagaccccgctgcccgactacgccatcgaaatcgtccgtggcgtggcggagcatatcgccgccatcgacgccatgcttgacgaacattccaccggttggaaggtcaagcgcatgggcgtcgtcgaccgcaatatcctgcgcatcgccgcatgggagatcatgttcaacgatgatgttcccaacatggtggccatcgatgaggcgttgagccttgccaaaacgctgtgcgacgacgattcgccggcgttcatccatggtctgctcagcgcggtgagcgccgatgcggaagccactgaagtggccgaacaaccgaccgaaccttcggctgaataaagccgaaagttaagcgattcggccgggtcgcgagtcctaaccggccgctatccttggtacgaataccttgactataagggggttttggtgaaccagtatgattccgaagccgtgatgtttgaccctcaggatgccgttcttgttctcgaagacggacaggtgtatgtgggcgagccatacggcgcgatcggcacgaccagcggggagatcgttttcgcgaccggcatgaccggctaccaggaaacgcttaccgatcccagctacgaccgtcagatcgtggtacagacgttcccgcacatcggggacacgggaatcaacggggaggatccggaatcctccagaatctgggtcgcaggctatgtggtgcgcgatcccagcccgaatgtgagcaactggcgcgccaccggcagccttgacgacgatctcgaatccaaccacatcgtcggcatcagccatatcgacacgcgcaagctggtacgccacctgcgttccgccggtgtgatgcgcgcggccatcttctcaggcgacgcgctgctcgacggtgacggcaaactgcgcaccatcgactccatgctcgacgaggtcaaggccactccgcagatgaagggcatgagcctctacgacgaggtcagcaccaaggaagcctataccatcgaaccctgcggcgaattcgaaggcaaggaaccgctgtttaccgtggcggccgtcgatctgggcatcaagtccatgaccccgcatcgcatggccgaacgcggctgccgcgtgcatgtggtgccgtccaccatcaccttcgacgagctccagtcccttaatcccgacggcgtctttttctccaacggtccgggcgacccggaacaggccgattctgaagtgaatctgctgcgtcaggtgctcgacgccggatatccgttcttcggcatctgcttcggcaaccagctgctgggccgcgcgctcggcttcggcacgtacaagctcaaattcggccaccgcggcatcaaccagccggtcaaggatatgaccaccggcaaaatcgaaatcaccgcgcacaaccatggcttcgccgtggatgcgccaatcggcgaaaccgtcgacgcgccattcgagaacggcaaatacggcaaggtgttcgtcagccatatcgatttgaacgataacgtggtcgaaggcctgcagtgcgtcgatatcccggcgttctccgtgcaatatcacccggaagccgccgccggcccgcacgatgccgcatacctgttcgatcgtttcgttgatctcatgcgttccgtcaaggagggaacccgcaatgcctaagcgcacagacatcaagtccgtgatggtcatcggctccggtccgatcgtgatcggccaggccgcggaattcgattattcgggcacccaggcctgccgcgtgctgcgcgaagagggcattagggtcattctggtcaattccaacccggccaccatcatgaccgatccggaaatggccgacgccacctacatcgagccgatctccaccccgatcctcgagcagatcatcgccaaggaacgtcctgacgcgttgctgccgacgctgggcggacagaccgcgctgaacgcggccatggcgctgggcgaggcgggcgtgctcaagaagtacaacgtcgagctgatcggcgcgtcccttgacgccatcgatcgtggcgaggaccgcgaactcttcaagaaggtcgtggaggaggctggcgccgaatccgcccgctccgacatcgcgcattcccttgaggaagtcgacaagatcgccgagaagttcggctacccgctggtggtccgtccgagcttcaccatgggtggtctcggctccggcatcgcgcacgacgaagacgagctgcaccgcatcgccggcgccggcatccactattccccgaccgacgaggtgctgatcgaagaaggcatcgaaggctggaaggaatacgaactcgagctgatgcgcgacaagaaggacaatgtcgtggtcgtctgcccgatcgaaaacgtcgacccggtcggcgtgcacaccggcgactccatcaccgtggcaccggtcttcaccctgaccgaccgcgaataccagaagctgcgtgacattggcattgccatcatccgtggcgtgggcgtcgacaccggcggctgcaacatccagttcgccgtcaacccggacaccggccgtatcatcgtcatcgagatgaacccgcgcgtgtcccgttcctccgcgttggcttccaaggccaccggcttcccgatcgccaagatcgccaccaagctggccctcggctacacgctggacgagatccagaacgacatcacccagtccacgccggccagcttcgagccgaccatcgactacgtggtcaccaaggtgccgcgtttcgcgttcgagaagttcccgggcgccgatccgacgctgaccacctccatgaagtccgtcggcgaggccatggctctcgcgggcaacttccaggagtcgcttggtaaggctatgcgctccatcgacaagcgtcacatgggcttcaactgggatggtgacaagccgtccgaggacgaggtttcccagctgctcgacgccatcaaggtgccgaccgagcaccgttatctgcagattcagcgtgccctgtggggaggcgccaccgaagagcagatcttcgcggccaccaagatcgacccgtggttcatccgccagttcgcgctcatcaacgagactgcgctggaagtcaagaacgcggagaagctcaccaggaagctgctgaagaaggcgaagctcgccggcctgtccgacctgcagatcgcgcacctacgccgtctgggagacgagggcgagaacaccatccgtgagctgcgttggtcgtacgacctccgcccggtgttcaagaccgtcgacacttgcgccgccgaattcgacgcggcaaccccgtactactactcctgctacgcggatgagaccgagctgcgtcctcgcgaccgcgaggccgtgatcatcctcggctccggtccgaaccgcatcggccagggcatcgagttcgactacacctgtgtgcacgccgtgcaggaactgggcaagaactatgacacgatcatggttaactgcaacccggagaccgtgtcgaccgattacgacatgtccgaccgcctgtatttcgagccgctcaccttcgaagacgtgctcgagatctacgaggccgaaaagaagatgggtccgatcaagggcgtcatcgtccagctcggcggccagaccccgctgtccctggccgcccgactgaaggccgcaggcgttccgattctcggcaccacgcctgaatccattgatctggccgaaaaccgtgagctcttcggcgaggtgctgaagaaggccgacatgaacgcgccgcgctacggcaccgcgctgagcctggacgaggcccgcgaggccgcgcacgccatcggatacccggtgctggtccgtccgagctacgtgctcggcggccgtggcatggaaatcgtctacgacgacgcccaattgcgcaagtacgtcgatcgcgcattgaaggaagcccaggccgacaccgtcgtgtccggccgtctgccttcgccgctgctcatcgacaagttcctgcaggatgccgtggaaatcgacgtcgacgcgctgttcgacggcgaggagctgtatatcggcggcatcatggagcacgtcgaggaagctggcgtccattccggtgacgccgcctgcaccctgcctccgagcacgctgtccgatgaccagatccgtcgtctgcgtgaaggcacctacgccattgccaagggctgtggcgtgcagggcctgatcaacgtgcagtatgccttcatggccaacactctgtacgtcatcgaggccaatccgcgtgcctcccgtaccgtgccgttcgcttccaaggccaccggtgtggcactggccaaggccgccgcccgcatcatggtcggcgaaaccatccagcagcagcgtgacaacggcctgctcctgccccacggcgacggtggcgacatccatcgcggccagcaggtggccgtcaaggaatccgtgcttccgttcaagcgattccgcactccgctcggcaagaccgtcgacgtgctgctcggaccggaaatgcgttccaccggcgaggtcatgggcttcgaccgcgacttcccgcacgcgttcgccaagagccagctcgccgcatacgaaggcggcctgccgaccagcggcaacgtgttcatctccgtgaacgacaccgacaagcgccagctgccgctgttcgccgcgcgactggtcgagctcggcttcaacatctgggccaccgaaggcacggcatccgtgctgcgccgctacggcatcgattccaagatcgtcgacaagatcagcgtgcgtatggactccgatccagacgacccgatcaccacctaccatgcggagggcagcgtcggcaagaacgtcgtccagctgatcgaggaaggcgcgatcgacctgattctcaacacgccgaactcccgcggttcccgttccgacggctacgccatccgttcggcggctatcgcagccgacctgccgcagttcaccaccatgacggaattctccgccgtgttgatggctatcgaggcggtgcgcaataatgattatcagatcatgagtattcaggatcattccacgcagctgttcgaattggaaagccgtgactaatgatgagtagccccagcagtgaggaagtgaatgcccagcgttcggatttcggtctgcgactgagcaattcaatggccaaatacggcccgttgtgcgtcggcatcgacccgcatcggcagctcctcactgactggggctataacgtcgacgcgttgggggcggagctgtattccatgcgcatgctgcaggcggccaatggccgtgccgcagctgtcaaattccagtcctccatgttcgagcggtacggttccaaaggcatcgccgcgcttgaacgcgtgctctatgcggcacggcagatgggtgtcatcaccatcgtcgactgcctgcatggcggcctgccgaccacgatttccgcgttcgcggacgcctatttcaagccgggcgcgccattgctggcagacgccatcaccctgctgccgtattacggcgcacggtcattgggaggcgtcatcaatgacgcgctcaacaacggcaggggcgtgttcatcgcatcgttgacgtccaaccaggaaggcgccagcctgcagacggcgattcgtcaggcaggcgaatacaagggcaaaacagtggcgtacggcatcgccagcactgctcagaaattcaataagggcaatgatggaatgggttccgtcggccttatcatcggcgccaccatcgggcagtggatcaacgattcgggcgtcgacccggccaagttcaccggaccgattctttccccaggctacggatggcagggagcggagacacgcgatctgaagaccgtgttcaaaggcaccaagggcaatgtgctggtcacggtatctcgttccatcgccacgcacggtcccgacatcgcaaaattgaccgaagccaccgcgtcggtcgccagggatattcggcaggcattgaccgaggctcaaaacgaaagcgccgatgatgcggctgatggagacgtcgaataaattctttttctgaatagcttcctttttggaaaacaagacataaccaagagtggggatggaatggctgattctcaacatggacgtttgattgtgctctgcggacccgccggagtgggcaaaggcactgttctggggcgcgtacgcgaacagcaccccgaaatctggctgtcggtgtccgccacgacacgccagcctcgtccgggcgaagtgaacggcgtgaactatttcttcatgaccgaacctgaattcctggccaaagaaaaggcgggggagtttctcgaaaccgccgacgtgttcggcctcgcccactacggcacacccgtgaaaccagtcgtggaacatctggaacgcaatatccccgtggtcttggaaatcgacctacagggagcccggacggtcaaacggcgcgcgaaggaactcggcctcgaagtgcttaccgtgttcattgagccgccgtccttcgaagaactgaaacgtcgtctgatcggccgtggcaccgaaacccctcagcagcaggccaaaaggcttgagaccgccaaggtcgagttggccgctgcgccggaattcgacaaacgcatcgtcaataacgtggtcgacgaggccgcagacgagctttggcatatcatcgccgaagagttcggcctgtaatccgtcaatccgactatccagccaataaaaaccggcatacgaaaagggcctgcacgatttcgcgcaggcccttttcgtatgtttgaatcaggcgagaccggacagcttgtcaatcagctccggatcacgggtcgctcccttgtcagcggagcgggcgaaggcggcgtaagccttcagagcctgagaaaccttgcgatcacgatgggcgacatagccatcgccggcctccagctcggcgcggcgctgagccagctcctcgtcggaaagctcgacgttcaccgtacggttcggaatgtcgatgttgatgatgtcgccgttcttgatcagagcgatcgggcccttgttcgcggcctcaggcgcgatgtgtccgatcgccagaccggaagaacctccggaatagcggccgtcggtgagcatggccacctgcttgccgatgcccttgcccttcacgaaggaggtcgggtacagcatctcctgcatgcccggaccgcccttcgggccttcgtaacggatgaccagagccatgcccggcttcaacgtgtcgttgaggatgacctcgatggcctgctcctgggattcgacgaccagcgccggtccgcggaacgtccagatctccttcggcacgcctgcggtcttcaccacgcagccgtcaggcgcgaggttgccgcgcagcacggccagaccgccttcggtgaccgccggatggtcgatatcgtggatggcgccgttgacacggtcacgatcgagcgaatcgaacagcgtggtgtgcgtccacggttcaggggagacgatgtggcccggagcggccagatacatctgcttggcttcctcggtgcaggtgtcgcgcatgatgtcccagtcgttaagcttgtcttccaacgacttgtaatcaatggaatgcacgtcgcggtgcagcttgccggcacggtcaagctcgccgaggatgccggtgatgccgccggcgcggtgcacgtcggaaatctcccattcgccggacggcgacgccttgcagatgcacggcacggtgtgggagatacgctcgatgtcatccagtgtgaagtccacgtcggcggactgcgccatggcgaggatatgcagcacggtgttggtggaaccgcccatggccacatccatggtcatggcgttctcgaaagccttcttggtggcaatggaacgcggcagcacggaatcgtcgtcatcgtcgtaatactgcttggcgatcttcaccacctgctcggcggcgcgcttgaacaggtccttgcggtaggaatgggaggccagaatggtgccgttgcccggcagagccagaccgatggcctcggtcaggcagttcatggagttggcggtgaacatgccggcgcaggaaccgcaggtcgggcagacggtcttctcgtaggcgagcagatcctcttcgttcagattgtcatcggcggaggcgtacatcacgtcgatcagatcggtgttcttcttcacggtgccgtcgggcagcacggtggtgccggcctccatcggaccgccggaaacgaacacggtcggaatgttgagtcgcagcgcggccatcagcatgcccggcacgaccttgtcgcagttcgggatgcagatcagcgcgtcggcgcagtgcgcgttcacctgatattccacggtatcggcgatgatgtcgcggctcggcagggagtacagcatgccggtgtggcccatggcgatgccgtcatcaacggccatcgtgttgaactcgcgcggaatgccgccggcttccttgatggcatcggaaatcagacggcccactttgttcaggtgcacatgtcccggcaggaactcgtcgaaggaattggcgatggcgatgatcggcttgccgaaatccttgccatccacaccggcggcgcggtagagggcgcgagcgcccgcgaatactcgtccattcattagttttgcagatcgcatttccatgcctcctattgtgctggctaaacgggacacgtgttttgtcaagagtcactatgtggaaattttcggaaaaccgtgtgattcccttacaggttggataactacgctggtggagaaggcctgtgggagaggcaaggttgaggtccagtggattgcctatactaatgattttggaaaagaagcttttggcttatctgatgatttggagataatcactatggcattcggcactgagccaaccccgaccggtcttgcggatccgccgatcgacgatttgatggagcatgcggactccaagtacgctctggccattttcgcggccaagcgtgcccgccagatcaattcctatttcacccagctcaatgagggtctgctgcagaacgtcggcccgctggtggaataccagaatcaggagaagccgctgtccatcgcgttccgcgagatcaacagtggtctgcttgaggaaacccttggtgaggacgatctgaccgaaggcaactgatctacacggttcccatagagggactggcatcatttttcattcgccccgatacctgagcggtgcgctttgaatagtcaacaattaactattgattgcgtctgtgaaggacggggcgtttttcgtgggcgatcacaggatgcgaacggttgggtgttcgcgaaaggagcagccgtatggctgaattgaagttgatttccgccgagtcggtgacggagggccatccggataaggtctgcgaccagatttccgatgcgattctcgacgatatgctcgcgcaggatccgcattcccatgtcgccgtggagacctgcgccacggtcggacagttcttcgtgttcggtgaggtgaccagcgaaggctattccgacatccagaacatcgtgcgctccgtggtgcgcaatatcggctacaccagctcccgcgtgggacttgacgccgattcctgcggtgtgacggtgtcgcttaccgagcaaagtccggaaatcaaccagggcgttgcccggttgagtggcgaggaggagtcgaaggcgtcccgtgaacagcggtatgaggcgcaaggcgcgggcgaccaaggcgtgatgttcggctatgcgtgcgacgagaccgacgtgcttatgccgttgccgattcatctggcgcaccgtctggcgtatcgtctcgccgaagtgcgcaagagcggtgaggtgccgcatcttcgtccggatggcaagacgcaggtgaccatcgaatacgacgacgatgaccatcccgtgcgtctcgacaccgtgctggtctccacccagcacgacccggaagtggaccaggcatggcttaaggaacagctcaccgaacatgtgatccgtccggtgctggatgacgtgctcgccgaccgtgtggcccacgacgaataccgcgtgctggtgaatccgaccggctcgttcatccttggcggtccggcagccgacgccggtctgaccggccgcaagatcatcgtcgacacctacggcggcgctgcccaccatggcggcggcgcgttctccggcaaggatccgagcaaggtggatcgttccgcggcctatgcggcacgctgggtggccaagaacatcgtggccgccggccttgcccacaaggtcgaggtgcaggtcgcctacgccatcggcgtggccgatccggtgtccatcaacgtggagacctacggcaccgagatcggtgtgacccgcgagcagatccagcaggcggtgcgcaaggtgttcgacctgcgtcccgccgccatcatcgacgagcttgacctgaagcgtccgatctactccaagaccgcggcctacggccatttcggtcgcgaggatgccgacttcacttgggaagccaccaacaaggtcgacgaactcaaggaggccatcaaggcttgaaaacgcggccgacgtcctacgatgaaacaggcgtcggcgcatgcgttacccttgcattatgaccaatgaggatgccgagcagctggcgcttgacgggcttgccccgcgcaagcggcgcaaacgcgcgcccgccgtcaaaacgccagccgccgaacatcccatagcccaagtggtgctggacatccaggccacgcatctgggacagaccttcgactatttcgtcgaggaaaaatactctgcggccgcccaacccggcgtgatggtgcgcgtccgcttcggcgggcagcgggtcaacggcatcatatggaaacgcgccgataccagcgccacacccgaatcatcgatacgttacatcgaacgtgtggtcaccgaccgtgtgctcgttcccgaatccatgcgcgacgatatgacgcgcatcgcggacgcgttcggcggcacgcgcgccaatatcctccgcctggcagtgccgccgcgcgtggcaaaagtcgaaagccagctgcgcgtcggcaatcgcgatgccgcaggaaccgcggcgggcaaacaacggctcaccgccgtcgaccaggagatatacggccagttgcaacgtcaatacggcaacatcaatctgctgcatgacgcgctgcaaggcagacgtttccaatcgttcgtcttcgacctgctacccggtgccgaccattggcggcgctgcgcggcatggatggtggccgcggcgctcgctcagaacaagccggcggtgctggtgctgccgaccatgcgggagatcgccgacatgactgagaccctacggtcggtcggcttgaaaccgttcgctccgaccggagccgcgaacggcgtctatgacggcgatttcgcggtgctcaacgcgcagatggcgccagccgaccgttaccgggcatatctcgcgatcagctgcggacaagtgcgttgcgtgctgggcacgcgcgccgccatgtacgcgccggtggaaggcaacgcgctgttcctcatccttgatgacgtgtgctaccaggacgccgacggcatgatgccgtacgccaacgcgcgcggtgtgcttcggctccgcgcgaaatcgcataacggcgtgttcgtcgcgatggccaatgcgcgcagcgcgcaaagccaatgggaaaccgacgcggcgcacgtcggagatacgcaggtgagcggcttcagcacgcccatacacgcgttgccggccgtgaccaaggaagcgtctccatggattcgctggctcaatcgcgacgagctggcacgactcgccgatccgaccatcggcgcacgcgtgccacacaccgcggtccggatactgtccaaagctttggaaaccggtccggtgctgctgtccataccgcaggacggcatcaccgaagcgttaagctgctcgaaatgccaccgccaagtgcgatgcgcgcgttgcacgggaccattggaacggttggcggacggaacgattcgatgccgctggtgcggcgccgccaccgtgcaatggtcatgcccgacatgccataacgagcgcatgcgcgtggtcagggtcggcgccgccggaaccgcgatggaactggccagactgttccgtggcgtgccgatggtgctgtccacgccaagccagccaagaggcgtcgtgtccgatatcggattcgctccgcaactggtcatcgccacgcccggcgcggagccgcgtgtgcgcggggagagtccggcacaatgcgaataccgtgccgtggccatcctcgacgcgtggaccagtttgtatgcgtccggcatcgacgccgatgtggacacgttgaccggatggatgcgcgcggtgtcgctgtgcgcgccgcggacccgtggaggacaggcgctgctgatcggggaaacagatcccgtgctcgcacgatcgttgatgctgtggaattcgccgatgcttgcccaagtcgaagtggaggaccgcgcccagaccgcgctgccgccggtattcgccgcggcctgcgtgtggggccgacgagatgcggttgggacgatgttgaaacgaatcggcgcgttggccggtggcgacatggccaccatcgacacgatcgccggtacgatgccgtccgtcttgggtccggtgccgattccgcagccacgcaccatcgattcacgtgaattggaaggcaccgcggacagggtcaaagcagtcgtgcgcgtcccacagggcagacgtgccgaattggcgttgcggctgcgttcggcaagcgcccgccacgtggcttcacgcgaacctggggaactgcgattccagatggatccgaaggaacgcatctgacggacgtcccctcaacgtgaaacactggaacgactgatgacgttgacgttaggaatggagaaacgcatgaaaggctggccgggagagccgcaaatggaatatgacgtgcttatggccgacggcaacgccgctgcgaacgccggccggcagatcaccgacgtgatcttcgatttcggcaacgtgcttatctattgggatccggcggcggtgatgaccccacggtactcggacggactggtggaacagttcctcgacaatgacgtctccggcttctacgacatcaacaacgaactggacgccggcatgtccaatgacgatggcgtggctctgatgcgtgaacgccacggagaccagtgggccgatatgatgcggtactatctggacaatttcgtcgattcgctgaccggcgtggtgccaggcgcgcgcgtgctcatcaacgatctgaaagcagccggcgtccacgtatggggcttgagcaactggcagaaggacctgttcccggtggcgctcgaccattacgacattctgtgcagtcttgaggaccgcgtggtgtccggttacgtgggactgcgcaaaccgcaccgcgatatttacgattacgctctaaaacagttcggcatcgacgcttccggcgcgctgttcgtggatgacaaggcgatgaacatcgtcggcgcgaacgaagccggcattcgcggcgtacggttcaaggatgcccgcgcgttgcgcaccctgctgatcgacgcgggcgtggcgattcccgcggtacatgaaaaataacgacatacgcagattagacagacggttgtgcttgcggtcgctatgcgggatcgacgcatacggtcgcatgcattgatggatatgaaaggtgaggagattcgtctcatgttgaaagtgctgttcgcaggtacgccggatgtggcggtgccgtcgttgaaactattggcccaggataccgagcatttcgaagtggtggccgtgctcaccaggccggacgcgccaaccggacgaggtcgcaaactggtggcgaatccagtcaagcaggccgcgctcgaactcggtctgccggtcatcgaatccgatccgagcgaggaaacgttcgtgtccgagcttgcggccaccggcgcacaggccgccgctgtggtggcgtacggcaagatcctgaagcaggacgtgctcgacgcgctgccgatgggctggtacaacctgcatttctccctgctgccccaatggcgtggcgccgctccggtgcaacgttccatctgggcgggggagaaggtgacgggcgccaccgtgttccgtatcgtccgtgccatggacgccggcccgattctggcgcaatccaccgtggaaatcggcgcgcacgagaccgccggagaattgctgggacgtttggccgaagacggctcgcatctgctcgcagcctcgttgcaggcgctggccgatgatcagatcgcaccggtggaacagcctgccggagcgtatgaggtcgcgcagaagatcaccgtggaggacgcgcatatccgcttcgacgtgccggtattcgccgccgaccgccagattcgcgcatgcacgccgaatccgggagcctggtgcgaactgcatgcccatgcggacgccgaaccggcgaccctgcacgtattgcgcgcgcagccggccgacatgtccaatccgaacgcaccggcatcgcttgaacccggccatatcgtggccggcaagaagaacgtgtgggtcggcacctccaccgagccgctcgagctgctggaagttaaagcgcaaggcaagaaagccatgcgcgccgccgactgggcccgtggcgcccacctcgataacgccttctgtgagtaagatttttgtttctactgtaagtatgtgagtggctgcggcgtccgcgaccggcgggcggcatgcattgacgacacgctccgggccgctcaggccaagtctttacggtcttacaacgcatgccgcccaccggtcgctcgtaggtgcggaaaagttatttgagataatcgaggattttcgccagatcacgttcattgagccggtgcggagcatcctcctgcactttcggtttggcgcagaacgccacgccaagaccggccgcatgaatcatcggcagatcgttcgcgccgtcgccaaccgcaacggtctgcgccatatcgatgcccatccgcgcggcccacgcgcgcaacgattccagcttcgtatccttcgtgacgatatcgcccagcacgtgtcccgtcagcctgccatcggcagcctccaaacggttcgcaatccaataatcgagatgcgcatcggccgcgagacggtccacaacctcgtgaaaaccaccggagaccacgccgaccttccaatcatgcgcgtgaagcgtgtcaatcagttcaagcgcgccatgcgtgaaatgcactcgatggtagacctcatcgaaaatcgtggtcggcagacccttcaataacgccacgcgtgcgcgcagcgcctcgcggaaatcaagctcgccgttcatggctcgagcggtgacggacgctatctgctcgccgactcccgcggccacgccaagctcgtcgatgacctcttcgtcgatcaacgtggaatccacatccatcaccagcagtccgggagtggacagcgtgggcagggatgccatggatgcgatgttcggcgtttcttgttcaagcatggttccgattgtcggaaatcattaggacaatgggtattcttgagggttgaacgtgttggaaagcgaggtcgacatgaacgatcatgacgaagagacgctcgcgtcgctgcagcaggccaacgaccagctcatggccaagaaccatgcgctggtcaaggcgttgagccgcgccacgcaggaaatgacgaaaaccaaggcccaattgaaccagctggcggggcctcccatgactttcgccaccatggtccgcgtgcattcagccaaaacggacgggcagggcgtgcagcatgccagcgccgaagtggctgccggcgcgagacgcatgatcgtgccgatcgcggcgaatctgcaagcttccaggctcgaaccgggacgtaccgtgctgctcaacgagaacatggtggtggtctcacagctcgacaccgacacgctgggcgcggtgcgctcggtacggcaggtgtgcgatgacggccgcctgctggtcgcggatggcggcggcaacgtgacgttggtccgatgctcgggaacgcttgccaaacaggccatcagcgcgggcgatcgcgtgaacgtcgacgcatctctgcggttcgcgctttcgttggttcccccgaaaacgacgacgatttggttctggaagaagtgccggacgtcaccttcgccgacatcggcggactggacgagcagatagaacgtatccgtgacgccgtgcagatgccgttccagcatcgcgaactgttcgaacgctacgacctgaaaccgccgaaaggcgtgctgctgtacggtcctccaggcaacggcaagacactgatcgccaaagccgtggcgaacgcgctcgccgaaggcaccgacgcgggaagtggcgtgttcctgtcggtcaaaggaccggagctgcttaacaaattcgtgggcgaatcggaacgtctgattcgcatgatcttcaaacgcgcccgcgaacgagcggccgacggcaaaccggtcatcgtgttcatcgacgagatggattcgctgctgcgcacccgcggcacgggcgtttcgtccgacgtggagaccaccatcgtgccgcagttcctgaccgagctggacggtgtggaatcgctggacaacgtcatggtgatcggagcctccaaccgcatcgacatgatcgatccggcggtgttgcgtcccggacgcctcgacgtgaagatccgcgtggaccgtccgggcatccagcaggcgacccagatcgtccgccactatctgacagacaagctgccgttgtctccgaacgtggatgcgaaggcgttgatcggcgtgctggtcaacgacatctacgcgcaggacgagcatcggcacctttgcgacatctgcgacgaccatggccagtggcgtccggtgtacctcgccgacgtggtgtccggcgcggtgctcaagaacatcgtggaccgtgccaaaacctatgcggtgaaactgtccatcaccaccggacaggctgcggcgatcggcatcaatctgctggccaaagccgtggacgaagaatacggtgagacccgggacgcgctgctggatgcggatccggaacagtggagccgcatcaacgggcttgaacccggacgggtgaccggcatcagaccggtggcatgaatgccggccggcgtatgaatgctggacggtatggtatggaacgcaatctaaatacggaaaggaacggcgcgatgagcgttcgcagggtcatgggcacggaaacggaatacgcggtctccgcgccaggacaaggccgctacaatccggtgcagctctcattcgacgtggtcggcgccgcctcggatgcgtcacgcagccatatccgctgggactaccggcaggaagaccccgtcaacgacgcgcgcggcaccagactggaacgtgcggcggcccacccggacctgctcaccgacgccccacagctcaacatcaccaacgtgatcgcccctaacgggggtcgtatctacgtcgaccacgcgcatcccgaatactccgcgccggaaacaaccgaccccttcgaagcggtgcgatacgaccgtgccggcgatctcatcatgcgcgccgccgcagccaaggcaagcgagacgacgggacggaaaatcgtgctgcaccgcaacaacgtcgacggcaaaggagccagctggggcacgcacgaaaactacatgatgctgcggtcggtaccgttcgacctggtgacacgcctcatgaccacgcacttcgtctcccgacagatcttcatcggctccggccgcgtcggcatcggcgaacatagcgaaaacgccggctaccagctaagccaacgtgccgactacttccatatgaaagtcggtttgcagaccacattcgaccggccgatcatcaacaccagagacgaatcgcacagcaccgacgaataccgcagactgcacgtgatcgtcggcgacgccaaccgcatggacgtgccacaggccttgaaactcggcaccaccagcatgctgctgtggctgctcgaacacgccgacatggccgaaatcgacttgaacgaggcgctgggaccgcttacgctcgccgacccggtggaagccatgcacacggtatcgcacgacctgaccctggccgccccactaccattggaaacaggtggaaccaccaccgcatggcagatgcaggtcactttgcgtggactggtatatgcggccgcggcaacggtatacggcaccgacacatccggagagccggcatggcccgaccgctccacccgcaacatcatggcgatgtgggggcaggctctcgccgacgtcgccacagtacgccatgccgacgatgacggacgactgacgatgcgggaacaggcgtcacgtctcgaatggctgctcaaatggcagttgctggagaagctacgccgcaagaccggttcggattggaccgatcggcgcctggccgcggtcgatctgaaatgggccgcgctcgatccggccgattcgattttcacccggcttgccggacagaccgaacgactggtgacggataagcagcttgccgaggcggtcggccaagcgccggccgacacacgcgcatggctgcgcgcggagatcgtacgacgtttccccgaacaggtcattgcggcgtcgtggtcccaccttacggtgcgcggcgagtcgtccggtgatgaaaacgtggagaattcgatggtctcgttggacatgtccaatccgttgaaattcacggaatccttgtgttccgaagcgttcgagcgtgtccacactgcgagcggaatcgtggaatccctgcgttgaatctcatgttgtgcgggtaccattgccgtaggtgatggcagaggccatacccatattcgatgaaccacacggcaggacgcttgagggagagggtgcgtccaggccggttatgaggaaacgaaaaggcatactacatggaattgaggcaagtggccctcgaagtggcccgtatcctgcaagatgcaggcaagcacgcgttgaacgatcaaatgaatccgcgtgatctgaaaagttttgaaatgacggacaatcatctgagcttcacctccgacatcgataagcggttggcgcaattcatcagcaaccgcatcacgtatgtggatgtgttcgatggtttctggcagttccgtccggaagaatgccatccgggggaacggtattggtgcgttggcggcatcgacggcgcgatcaatttcgtgcgcagcatgccggaatggaccatcaccgtctcactgttcgagtttaacgaccaatgttccgcgcagccgatcctttcggtggtgcatgctccggcgcttggtctgacctacctggcggtgcgcggatccggagccatccgcatccgcaagacgccgcttggagacaaacgcgagaagattatgccgtccaccaccccgtcccttgactatgcggtggtgagcttcggcatgtcccatgtgccggaggaatccaagcgtgcgcttgaagtggtgtcgcgtatcgccggccgtccggccgacatcaagcgcgtcggccccgcctccttggatttgtgcaaggtggcggacggtacatatgacgcgtatttcgaagcgcatctgcacaagtgggacgttcccgcggtttccgccggagccgtcgtggtctgggaagcgcaggggcatctgagccggtggaacggcgatcttgtccactggcgtcaggaaaacgacgtactcgccaccaacggtctgattgccgatgatctgcgccagtatttggcataagactgattgactgccccacacctgggtaaggtgtggggcagtatgctattcgcaggagaacccgcaaggacgctttcggagaaaggaagggccatgccccagaaatttgagcagatgcaatccgccgaacaaaaacatgacgaggatgagaccattgcgcaggctggcacccagatcgatgacacggtcgatgcgcttgacgcggtgctggacgacatcgaatcggtcctcgaatccaacgctgaggaatatgtgggcagcttcgtccaaaaaggcggcgagtgatgccgcagctgcgtgacagcggcaaccattccacagcgccgcttgacgcccataccaaggacgaaatccaatccttcgcccgtattttcggcatcgaaaccgaatacggtgtgagcgtgaccggttcggaccgcccatgcgacgccggacagacggcgatgatgatgttccagccgattgtggccgaagcgagatccaccaacacatatattgaaaacggttcaagactctaccttgatgtcggctcgcaccccgagtacgccacggcggaagcccgggatccgatggacgcgctggcattggatgcggccggcgaattggtgatgagggatcttgccctggacgcccaacgtcgtctgcgctccatccagggagccggctccacggtccatgtgttcaaaaacaatgtggattccgccgggcattccttcggctgccatgagaattacctggtgcgacggttcgtgccgttgaagacgatcgaacaggagctgctgccgttcctgatcacccggcagctgttcaccggcgcaggacgtatgggggagcagggcttccagatcacgcagcgtgccgacttcctcgatgaggcggtctcatcggccaccacgcgctcgcgtccgatggtcaacacgcgcgacgaaccgcatgccgatcctgacgcgttcagacggctgcatgtgatcatcggcgattcgaaccggtcccagtgggccacgatgatgaagctcgccaccacgcatctggtgttgtgcgtcatcgaacaggccgggcgcgaaggcaaggattccgggttcgcccgattctccttcgctgacgccagtgcggccaaccataaggtaagccgtgacctgacgggcgtcgaagcgtccttcgacatggcagacggcactgtcatggaaggcggtgccgtagcgattcaggaacgttatcttgaaatcgtcgaacgattcgttggacaacatcccgaagtgtgctcctcgttgccgcgcacggacgtgcatgaggtgattcgccgatggaggcgtgtcatagaggcgttccgctcgggggttagcgaaacgttcgccgacaaggtcgattggcttgccaaacgacggctgttcgacatgctccgcaaccgtgcggggggacgactctccgtcagcaagttggaacagttggacatggactaccatgacgtggccaacggcgcgctgtacgcctcgctgtgccgtcgcggagccatgcgcacgttggtcaacgagtcacaagcacatgaggccatcgatgttcctccccacgatacccgcgccgcactgcgtggacggttcatccagtcggcacgatcgcacaacgcgcaatattcctgtgattggacgcgactatcgctgacctcgccgaacaggatggacgtgacgttgcttgatccgttcgacgcacaaccgtccgaccggttcctcacgatactagaggctttgcagtagccaaaagcctgcgatggaagactcgtctccaccgcaggcttttgatattggttggtcggattgtaactgccgctcagacttctccacggtatttggccatcatctgcgactgcagttgttgcgcgcttggcggcgtccatgtgatcgcgtcggcgcccgcatcaatggtggcgagaatacggtcttcacgacctccgcccgaagccagaatcgggatttccggatgatgcgcgcggatgcttgccacgacttgcgcggttcttgcaccggctgccacattgatgatggccgcaccggcaagaatcttgcattcggtgatttcatcatcctccgtgaccgtggcgatgacagggatgtccaccatcgacatggtcgtttcgatggtttccgccggtgccggagcgttgatgaccacgccggccgcgccctgcatctccgccaccatggccagctctgccacacgcggaccggtggtggtgcctccacccacgccgacgaacagcggcatctgcgccacggtgagcagcgcctgcgtgatcaccggttcgccggtgaaagggtacaccgcgaggatggcgttcgcgttcgtgttgcggataatcaccgcatcggtggtataggcgaacgatttgagcgtatgacctttgacggtgatgccgccgcaacgctgcgtgatgatttccggaaccctggcattgggggaggtgagtctgccttcgaccttcgccgtaccgtaggtgcttcgcgacacgtgcggcacggctgaatgctgctccacagccactgacgcgctgggggtgaatagcgaacgcttgttgagacggatgagatccggatcgtccgcaccggaatcatgttcctgcccgacgctcattcccgcacctcctcatccgtatggttcagcatgaggaattcgtggatcgccttgcggcgttcggaaatctcctcatccagaagtttggtatcggtgttgtcgatgatacgctgcagcagttcgccgagagtggaaagttcctcgtcgttcaggcagtcgagcatatgaacgtcggcttcgatgggtttggacggcttgggccgtggaaccattccccgtcttgccgcgtcgacgttccgcacgtgtgtggtggcgcgtgccatggtctgggcacgtgtcgttttgagcttggtgtggatgagcaggatgttgagtttgtggatttcgtcgatgatctgtctgcgttggtcgaccatgacatccccctttatctagtcatattgtctaatatcatagcgcatagtgtgggatgacattgcctttgcctgttataaaaagaaaaaaagagaggttccaaccatccgtggttgaaacctctcatataggtctgcgtggtcgacttacttggtgacggccttcttcagcagggagccggcagagatgcgaacgccgtaggttgccggaatctcgatggtttcgccggtgcgcgggttgcggccggtgcgggctgcgcgcttgacgcgctcggcggagaacaggccggtcagcttcaggccttcgccggactgcattgcctcgacgaacacgtcctggaaagcgttcaccgcagcctcagcctgagccttggtcaggttggacttctgggcgatcttcgagacgagatcagacttgttgtatgccataaagcatccttcttgagtcaggggatattccgcttatgaacatccacgttcattgcaataatagcgcacgcatgtgccaaaaatgccattttccaagggttttggcccttttgattcagcataggggggagaaaaaccctaaaggggggttgggctagatcaaattatgcctgtccagccatttcatagccacggctcccattggaattctcagccaatagaaggcgattcggtagacgagagtagcggagacggcgatggtggaggggatgcccacggcggtgaaggccacggacaacgcggcttcgaccgcgccaaggccgcctggcgtcggcactgcggaaccgagcgtattcgccagcaggaagatgaatgtggtctccaccggattggtgtggcatccgaaagccatcaatgcaatccagaatcccaatccggtcgagatgttgagtatcagcgcaccgagaatgccgaaggccagttctttcggatgggacagcacgttgatgagactacgtgcgtaggacttgacgatgggcaggtacttctccgtgacgatgtgccgcaccgggggaatggccatggccgcggaaatcaccaatgcgacgatggtgatcaccaaaatcagcgtgttggtgggaatcatgccggacagtgtgttgcgtccggtgaagatgccgatcagcagcagcagaatgatggtggtgccgccctgcactgcccatacggcgctcatgatggcggtggccgcggtattgcggtagccgctcttgcgcaggaactgcaggttgacaaaggccgggccgacgccggcgggcatggagaccgcggtgaagcccgaagccatttgggaacagtacaagccgatcggattgcgtttatcggcatccatgaaacagccaagggtcatggccgatccgaaccaagccagcagtccgaacagcacgcataccagagccatggcgatgttggcctctttgaccgccttgatcatttcggccggttgaatctgggtgaacaccacatacacggcgacgaccagcagcgcgatcgcgatgaaggaacggaaactgaaccgcgacagcgtgaccgtttccatggaatccgcgacctcctgcggagccaaagccgcgatacgggaacgcagcgtgttgagcatgtgcttgtcgcaggtggacagggcgcgtgtcgccgccggaaccgccgtcttctggatgaatggcgccagatcgatcagttgctcgtcgccccacgtcctgcgggcgcatgcgatcgcacggtcgatgccgttcaacgctccgagcagaaccagcagctgtactttgtccagcgcatagtttggcggcgcgctgccatagtcgccattctgccatcctgcgatcaccggctgtccgttttccatgcgcgacaacgtttcgggagtgattcgacgatgggtgaagccgtgccggtgcgcttcggacagataggtcatgaacaattccatgtcatggtcggacatggtgttcggattgcattccaagggcatgtggtcgcggtgaaacaccagaatggacgattcgctgctgtctgcgactccgtagactcccggcactgtcaatccggcgttctgcaggccgagaatcatcgcgtaatggtggtggatggcgtcgaaggaggaacggtcacggcgcatggagaccccggtcagcctgacccattgccatagctggttgagatagcctgccatatgcacttggttatcgagaacggataccgtgtattggtggccgtcgacgtcgatggcgtcgtagatgcgtgagttctcggtcagatcatcgtccaatgtggtcttcagcatgccggaatcggtgtaggtcgcgagcctgcgggagagcgacgccacgtcgatgccgatggaacggagcgcctgcgccacctggttgccccaagccccgttggtctgtgtgccgagcatgaaacgaatcagcatacccaaggcacgtcccgcggcaaaggagaccagcacgccggaaagcgaattccatgacagcaccacgaacagcactgcgaccgtgtagaggatgttccagccccatttggtaccggaacgggtgcgacgcggtccggcgacggtaaggaatgaggccatcgccgcataaaaatcgggaagcagtccggttcccacggaagtgccgttggacatcatggacatgatgagggtgccattgcccgagccgctgataagagcggaaataccccatatcgcagcgaaaccgagaataagggcgatggcggaaaccacactttgcagccattccttggcgatgagcagctggataagcacgctgacggtaatgaaaactatggcgatctgctgcaacagcgatgtcggcacatccatgagccaactgaccacgtggcccgcggaacgcacgtcggactccactccggaggtggtgccatgcaagtagatggagaacaggatgacggccgcgccgacaagcacggcgaacagcgcatggagcagatccgcgaaatcgcggttccgtttcggcggaacatcctcaatgcgcgtttcgtgtttgctggttgggaagtcgtgagacactattgacctgctttataggtacgtgggtgaatacgtccgggtgacatgcacctattatcgtctccgatgatacgccttggggcggctgtgtgaaaacacagccgccccaaggcgtatcatccgcaagatgagtgtggcgatgcgttatcagcggtcgaagtcaaccagcttgctggcaactccggtgtatgtcgccggagccaacgccttgagacgcgccgcagtggcttcgtcgaaggcctgctggtcgatgaaccgttcgacgtcatccttggagatctcgtgaccgcgcatgagctccttgaccttctcgtacggcttatccatacccggcagtccggcaagctcgcaggcgcgcatggcggtctgaatcggctcgccgagcacctcccaattggaatcgagctcggcctggatgacaacatcgttcggatggatggagttcagaccacccatcagattgttcaacgccagcagcgaataacccagcgcggagccgatgttgcgctgcgtggtggagtcggtcagatcgcgctgccaacgtgattcgaccagcgtcgccgacaaagtgtccaacagcgagcaggagatctccagattggcttcggcgttctcgaaacgaatcggattgaccttgtgcggcatggtggaggaaccggtcgcgcccttgaccggtacctgcgcgaacacgccacgggagatgtacatccacacgtccacacacaggttgtgcaggatacggttggtgtggctgatggtaccgtacagttcggcctgccaatcatgcgattcgatctgcgtggtcaacggattccacgtcagacccatacggttggtgacgaactcgcgggagacggccacccagtcaacatcagggcaggcggccagatgcgcaccgaacgtgccggtcgcgccattgatcttaccgagatattcctgggccttgaccttgttgagctgacggttcagacgatacacataaacagccagttccttgcccagcgtggtcggcgtggcaggctggccatgggtcagcgacagcatggccttgtcgcggtaggcgtcggccttctgtgccagatggtcgacaatggcctgtgctgcgggcagccacacctgctccacaccgttcttcacgcaacgggcgatggataggttgttgatatcctcggacgtgcaggcaaaatgcacgagagtcttcaatccggtcagctgggtgtcatgacccaacacatcggcggccttctccagctggtcgtcgatgtaatactccacggccttcacatcatggtgggtcttagcctcataagcggcatgctgggcaatgccttcggctccgaaattctccggaatggaacgcagatacgcctgctcatcatcggtgagcggcttgacacccggaacgatggtctgattgccgttgccctcgaaaccgttggcaagcagaatcatccactcgacttcgacgcgcatgcgctcgcggttcaacgccggttcgctcatgtattcgacaaggggagcggtctgcttgtggtagcggccgtcaagaggggtcagtgcgattgcgggggagatgtcagtaagcttcatagacaacagcatacgttcagccgtgaaccattggtcccgtcatttgctgatgcgtccctcataatactggacctcctccagctcgccttccacgacctcttggaaatgacggtcatggtccagcacggatttgcttccggtgtcgtaggcgtaccggtatcccgcctcatggtatttcgggtagtgcgtggagttcttctccccggacgaatcactgacttcggctcctggaaaagccctcttcggcgcatcttcctcatggacggagcatcgtatggtgagccagttctccgtatgggggttggcctccccgtcaagtgccgcgatgccttcatcatccatctcgatggcggtgacccgtgttttctcgggaatctcgaaattcgctatcggggagccaagcgtggcgatatgttgtatgtcgtatttgtcttggaaatccgtcgccgccgctgccgcgatgatgccgccctgcgaatggccgacgatttccacgggatcatccggctggatgccagcctgtttcatggtctcatccaggaaacggaggctttccgcggttccgcgctgccgctcatcggcactcatcagctcgaaattggtgtaccagtccataggcgaatcgtgattgccgtcggtcccgggaatgatgatcctccaagcatatgtgccatcggctttgcggtacttgcagcatgcgatggttccgtattccagaccgctttcacgttcgccgttgagaggtccttcggacagccgccgttggtcggcgatggcgtccttcgtgcttgtaccgcctctgaccactttggttttcggatacacacgggttacggagagattgtctccatggtctttgtcgaagtacggtatgagcagtctgtcgattttcttaagaccgcgattgaccgagcctttgccggaaagcccctctgctataaccgctcccggtttggtgaccatgaataaggttttcgtgatgtattccaggatggacgtgtcttttgaaggtcgttcctgtatgttcaatcggctcgcatgctctccgaggacgctcacgaagctttcctgcatccatgcggtggattccacaagatagaatttgttgaatttcccctctttggcgtaactgcgtcttacccccatcagtgcgctggcggtcaaggcgagaatcgcggattcccgtgatgacatgaaaagccctcgcaacatgatattcagccctttcctactggcttcctcagcttgggcgtataaggattgggcttgtgcgatcaatgatgatagctcattaagctgggatgccatggattgcagggcctcggcatgtgcttcgcaacgtccgagcagctgccggtacggcaattcgatatggtcctgcgccgtacaccgtggacttgccccggtcaaagcggacaggagcggtgtggcgcgagggtggattttgagttcatagcctgcggcaatgaaggatctacgggaagtgccaagacgattcgcttgatctctgaggattcttgaagcattgaagtattcccggtattcggcggtggtgaatctctttccgccaacgatgcgggccgtcactcgttggttcatgccgcacctgccgaccagagaagacgtgacgtggcgatcatatcgtcacgtagcagagcggattgccgtgcgatgcgattgagacgggtgcggtattcctcggccgcggtgccggtccagtcggccagtctgttggaggctattgccgcatcaagttcatcgagaagccgtgacgcggcaacaagtttcgcattgatcaatgtttgggtggtccgcacgccaattcggcaacgacaggacattcccgacagggatgccaacgaattgaaggctgcgacgcctggggcggcaccaagaaaagcatttgaaacgttcatggcagccatttgaccacattcggtgttgacgccaatcggaaaacagagcttgtggtcaaagaacgagtctatgaaaaaccgtcggcgtgtcgttattgggaaaacaacgaaaaccacgtcgacggcatgtggataactatattcgaaaaagccccctaccagggtttggtctgcgaggatgacgtgcttgggttctttttcgcagccgaacctgaatcgtcattgggatccgattgcgtggattgggcgttctgagccaatagctcctctattttccgacgttgttcgtcggataggttttcgtcgttcttgtgacttgatttatccgattcctgagcgtcggcggtgtttgaatccgtggaggcggactgatcgctctgctcggctttgatcttcttggacgcgtgatccgtaagctggctggaaacatgactgttatgctcgattgattcgcgcacttggggcagcagcagcggcttcatggctgatgcctcgttgaattgggcgtccgtctgctgttgcctggtgtgcagcttgtcccaatcggcatcgtcttttctgctggtcgagatgttctcctgcaggctttgcgtggcctggttgtagctattgacggctgcgagattcactatggcccatagggcggccatgaccagcaacgccgccatgacggccaaaacgatgcgaaccgtcagcgaggcacgcggtttcatggttgttctggtcatagcaaactcctcgactgaattatccaagcccccaattcgcatgcgagcagcagcagcgtgacgatggccagtggccatacgacgggcatcgtcctggtgcgcttcttggtggtttgggtgactcgccacttatcggacgcttccttggacacgccgtcacgcatggtgttggaggcgttcaacaccagcgcggtaccgctcaactcgtcggcgatggacgccatctcatccttgttcatgcgtgacactccgggtttgccggtatcagggtcggtgacccactggtccgcatttccatcgacgccgtcggcgattacgggaatgttgcctccctgctcgctgccgatggctacggtgaaggcatcggataggtatcgtcgcaatgatgagaacgtgcgccgtgcctttgatgaggtctgttctccatcggaaaacaggtacagcacgatcgcatcatcgggatgctgatcatgaatggacttgcaggtcagcagcagctggtcgataggggcatccaacgtcgaaccggccgaaacggaagtcgcctcgggcgcgagtgtatccgcccaattgtcgatcgcgttcgaatccggggtcaacggcacgtccaacgtgccggaagctccgaatcgcaaagcggcgaaactggaattgggatatagcgcggtgacgtccttcacggcttgttttgccacgtcgagacggcttgactgttcggctgaaccatattgcgcgtctttgacggccatggaaccggtcacgtcaacggccaccaccacgtcggtggcgttcaccgcacggctattggtcggcgccacgatactgggcgtcaatgccatgaccgacaccgtcagacaaagcaatacgcgccgaacgcatgcccaaacggtttcgtcgctgtcagcgcggcgacggacatgcaatacgatctgcgcaatggcgcaggccagcagaaccacggcgacggctccgccgacaggccaacccaaagcaggggaaagcgtcagatggttcatctcctcaacctccaagccaatgccagccagaccatcaaaacgatggccaaggccagtgtccaccatccgggagcatccaccatggcggccttgttgctcgactcgttttcatggttccgccgagattcgatttcctcgaccagcgaagagacggatgctccattcgattgggtgagaaacaccccatgatgagcttcgatggcggatttgaatttctgggtggtctcgtcggcctcgctttgcttcggtccggagaacaatccatccacggtgatttgggcctgcttggtcaggttcagcgcctcgtcaagcgtataggttggttttccggaaacgacgttgtccgtggcaagcacgatggatgcggcgcgttgacgctcggcattgtcggcgcttgcgttcccataggcgaatccgggaagcatggccgcgcagctcaccacgccatcgccaatcagcgaagtggactccttacggttctgcgtgccttccagccagtcggaaatcgcctgataatcgctgtccttcatcttgtcgatatcgtcttgggactcgacgcctgcgaggatgctgctggctttgccaagctgtttggacaccagttcgtagtcgtcggtcaacggaaaaacggtacgtgacgtcgaattgaagatgctcaggccgattctctcgcccttgaagctgtcgacgagttgacggtaggtgtcgatgacctcgcggtcgtaggggagcgccgagccggaaacatccaagcacagcacgatgtctcggctgctggccttctcctcgccttcatccacggtgctgggacgtgccaccagagccgtggcgagtgccaacgcgaccactagaagaatcaccgccaaacgtgaaagaaccctccactggcggaataatctcgatgcggattccgtgttgaggtcatcatccaggctgaaggtgcgggcactctcgatgccatcggttttgtggcgcgcggccaccagcaacgtgacgccggcaacggccagcaccacgatgacgcctgccagaaaggcccaaggccaatgccatgacagttgcatctatcgccacctttccacaagattggccacccattcgccagcctgctcgaccgtggcctgcctggcgatgtgattgcgctcggcatccgcgaattccggcggatacaatgcctcgatggtttgcctgagcaaggtgagaccctgctggttccccgtggtccgaggcgtctcttcgatgtcggtgagcgtctggttgcgcacgtccgttccggtggcagtggaagcaaaatccctggcgattgcggccagctgtgcgaaagcctcctcgcgctccagctcccccgggcatggcgggacacaacatcatcgatacgctgatgccagacggttttgccggcaagcgcgtcatgtcggccgcgattgactatttttgcgggcttccggctcggccgggcaagccagaccacaagagccaccaaaacgacggcaagcaacagacagaccgcgatgacgacggccaaaccgttctcaagatgaatctggtccttgatgacgaggtcatcctcggcaaggaagagcatcatgccttgtctcccaacgacaatacggacggggctctcaattggttacgtgtggactgggccaaagccgtggaaaccatgcgcacgaactcatggaacatgcgttcgctggaatcggatcgaattaccgtcgagccacagcgattcagctcatggcgaatggacgcagccaggtattcacgatgcgttcgcacttgcccagctgtgtttcccctacgcaggaacgcaggcacgcgtcgttttccagccccgtcaagcaccacgcgcgcatggctgacatcaaacggattgatggtggccacatcgatgagcaccatcggatgtgtccttgcaatcatgcggatggcgctcaaatgacgttcctccaacgcatgctcctcggtggcgatgacgaccagcgcctctttgtcccgaatgcggcgcgcgtattccagcaacgcgtcgatattgcggggcctggtccactcgcgctgcaatgccgtatccaaggttcgttcgaactgcgccaggccaccgttgaacggcacccgggtgatggaagcgctgtcgccgaacaccatggacacttcgtcgcctcggcgcaggctgagcgcggcgaacatgcataaggcgtttgccgccacctggtacgcctgttccgaggaagggcatgcggcggtcatttcctgtccgacgtcaagcagcaaccatgccttcgaagtggagggacgctcacgctgcaccaccattggacgtcccgctcgggcactggtcttccaatcgatgcgtttcgcctcgtctcccggctcataggcgtggatatccacgacatcgtcggcgccgaagcgtttgttcgatgcgtgcgcgccttcgagtatgccgagcgccttgcgtaccgtcggcagactcagcgtggttccaagcgtctcgatttttctgcggatcggatcgtcggaacggatctggtcgatcatggaacggggaccgcctgcacgatcgaatccaccacctggtcgctggtgacgccatcggcaagtgcttcgaacgtcatcagaatacgatgacgcaacacttcgtgggcgaacgccttcacatcctcaggaatgacgtaatctcgtccctgcaggagcgcgttggcctgtcctatgcgcaccagcgcgatggacgcgcgcggcgaggcgcccagcctgacgagcgaggaaagtccttggacgggcttggttccagcgccacgggaggtggccgcgatatcgaccgcatactgcatgatcgcatcggacacgtgcacacgacgtgccgcggaacgcaggaattcgacgtcgctgatggaaacggtgtcaccggtgagcgcgtgctggtctacggtatcggagccgcggcgggtcagcatggcgagcatgcgttgctcttcctgctctgtcggataggtcagtacggccttcatcatgaaacggtccatctgcgcctcgggaagattgaaggtgccctcttcctcgattggattctgcgttgcgatgaccatgaatggtttcggcagcgcgatgcgttggcctccgatggtggtcgcgccctccgccatggcttcaagcatggcggactgggttttcgcgttggaacgattgatttcgtcgagcagcacgaaattggcgtggatcgggccgatctgcgtggagaatttctgcgtggcgaaatcgaagacctgagtgccgaccaggtccgaaggcatcagatcgggagtgcattgcacacgtttgaacgagccggacaccgaagtggccaaggtctgcgcggcagtggtttttgccagacccgggacggattcgatgaggatatgaccgccggccaccaaagtggtgatcagcgattcacgaagattgtcctgtccgaccagggtctgcgcgaaacgtccgcgaatctgcgaaccgatgttcctggcgcgtgcgatgtcttcggccgacagcgtggttggtcttgcggctgcgggcatggggatgggtgccggtgctggcgccggattctttggagggaataaagccatggttgctactctaacgggtcaagctgacgggagggtccaatccaccggctgttctcctgcttcgattagcgcctgattggcgcgggagaacggtttcgagccgaaaaatccgtagcgggcggacatcggacttggatggggggatttgatgatgaaagcgttggtgagcaggggctccaacgtctgcgcctttcgtccccacagaatcgcgaccagaggcttgacgctgccgtcaggccgacggcgattgttcaatgcgctgatggccgcgtcggtgaccacttcccagcctcgcccctgatggcttcccggctttcccggttcgacggtcagacatctgttgagcagcatgacgccctgtttggtccagggtgtcaggtcgccgttggccggcatgggcacgcccagatcgtcggtcagctcggtgtagatgttcgccagactgcgcggaatgggcttgacgtccggtgccacgcagaagctcagtcccaccggatggcccggcgtggggtagggatcctggccgacgataagcactttgatgtcgtcgaatggaatggtaaacgcgcgcagaatgttcctgctggccggaaggtacttacgtcccgccgcgatttccgacctcagaaagtctcccatgagatgtatctggggttcgacatcggcgagggcctgggcccatccgggctccacaagatccttcaatggtttgatatgagtcatactttcccactgtacgacgtgccctgtggatgtccatgccgattccatgcggaaacgtgtcgaatacgcgcaaaatcgacgatgctgattgtgggctgactgcacgggccggtacactggggcggtaagtgtgagaaatgaggttgcagaaaatggctaagcaggacaaggagacctacgaatcctacgccaaggatatgttcgacaatcctccggcgggaccgatgggcgtgcaccgtggcgcacgttccatggcgtccagggctctgccgtatgtgattgtcgtgattgtggctctgctcgccggcctgctgttctggggagtctattctggtgagatcagcaacctgagaatgccttggtcggccaaggaggactcttcatcgtccgtctccacggcggataaggcggataagaagacggacgacacgtccaaagacgccaagacggagaacaagaagtccgaggacggcaagaagaccagtacttcggatggccagtcgaaggacgcttcggacgccaaccagaacgcggaacagaataacgatcagaacaatggccaggatgcggcttctgagcagagcgtgaatctggccaccgagatccgcgtggtgaacgccaccagcatcaccggttacgccaagagcaaggccgatgccctgacccaggccggatacaccagcgtgacgcccagcaatccgaccggcaacgttcccagccagacggttgtctggtatcagaatgaggccgacaaggcgacggcggagaatgtcgcgcagacgctgggaatctccaatgtccagcagagcagcggattggtcacgccgatcgttgtggtgctgttgaactgaaaaaacgccgtccgaaccggtttggaacctcgcccgaacataggcgaggttcttttattttcttggaaatccggcgtttttcaagttgattcgatgcgactggcatcttgctcacagcgcaaagaacgtcatcgggtttggcactctcgacgtgagagtgctaatctgcgaattagcactcgacgagtgagagtgataactggcggctgacggctggttctgattgtcgctccgaaggtggaaataataccgtgtagccatatgtggaggaacaatggcaaagatgattgcatatgacgacgaagctcgtcagggaatgctcgcgggtctcgacaagctcgctgacaccgtcaaggtcacccttggtccgaagggccgcaatgtggtgcttgacaagacctacggcgctccgaccatcaccaacgatggcgtttccatcgcaaaggaaatcgatctggacgatccgtatgagcgtatcggcgccgaactggtcaaggaagtcgccaagaagaccgatgacgtcgcaggcgacggcaccaccaccgcaaccgtgctggcccagtccctggtgcacgagggtctgaagaacgtcaccgccggttccaacccgatcgcgctgcgtcgtggcatcgagaaggccgccgacgccatcgtcaaggaactcgtcgcagcggccaaggacgttgagaccaaggatcagatcgctgccaccgcaacgatctccgccgctgatccggaagtcggcgagaagatcgccgaagctctggacaaggtcggccaggatggcgtcgtgaccgtcgaggacaacaaccgcttcggtcttgaccttgacttcaccgagggcatgcgcttcgacaagggctacatcgctccgtacttcgtgaccaacgccgaggaccagaccgccgttctcgaggatccgtacatcctcctgacctccggcaagctgagctcccagcaggatgtcgtccacatcgccgagttggttatgaagaccggcaagccgctgctgatcatcgctgaggacgttgacggcgaggctctgccgaccctgattctgaacaacatccgcggcaccttcaagtcctgcgccgtcaaggctccgggcttcggcgaccgccgtaaggccatgctgcaggatatggccatcctgaccggtgcccaggtggtgtccgatgagctgggcctgaagctcgactccgtcgacatgtccgtgcttggcaccgccaagaaggtcatcgtctccaaggatgagaccaccatcgtgtccggtggcggctccaaggaggacgtggccgctcgcgtcgctcagatccgtggcgagatcgccaacaccgattccgattacgatcgcgagaagctgcaggagcgcctggccaagctggccggcggtgtcgccgtcatcaaggtcggcgctgccaccgaggttgaggccaaggaacgcaagcaccgcatcgaggatgccgtgcgcaacgccaaggccgctatcgaggaaggtctgctgccgggcggcggtgtcgccctgatccaggctgccgccaaggccaaggacgacgtcaagctcgaaggcgacgaggccaccggtgccgcgatcgtgttccgtgccgtcgaagccccgatcaagcagatcgccgaaaacgctggcctgtccggcgacgtggtgatcgacaaggtccgctccctgcctgacggccagggcctgaacgcggccaccaacgagtacgaggacctgctggccgcaggcgtcaccgacccggtcaaggtgactcgttccgctctgcagaacgcagcttccatcgctggactgttcctgaccaccgaagccgtggtggccaacaagccggaaccgccggcagccgctccggcagctggcgccgacatgggctactgattgaaagaccggaagcttccataggctcaaatagctgatatgaggcccgcttcccgatggggagcgggcctttgcttatctggaaggcgccttacgcgcgctttctactgcgcgaacaaacgcgacgcctgcatttcggtctccgaatacaacgtggaggcctgcatcaatgcgcgctggattgattcaagcgactgctccatctgctgctgcgcggcacgccactgttcggcgaccgctgtgaactgcgtcgcagccccgccgcgccaaacgctctgcagattgttgagattgccgtacatgccctgcacggcctgtcggatggattggatggaggcgttgacggcggcgctcgaggactgaatctgctcgctgtcgacttgatactgtggcatgtgccggtcctttcaatgatgattggtgtgtttctccatgcgatcgcggttggcgcaaccggacggtacagtggatgctatgtcatcagtgagcgtgtgcaacgaaaaaaacggagctgtggtcggagaacatatgcatttgggttccgtcggcgtgtcgcgaaacggcggcagaacggcaaaaggttggaatatcgcgatttgcatgttgctggcgagcgtgctgggtttgtgtttgatgctgtggataactccgccggtccatgcggatgacagtgccggattgggcattacagccacggacgacatcaccgacacgcagaatctgctcggttcgaatgtctcggagatcacggacgccatcaaccagacgaaaaaggagaccggcgtcaccgtccgtttggtgtatctggacagtttcaacgccaaaggcaagccagataaatgggtgagcgcgctgctggaatcgttgaacccgaaaccgaataccgtgatgttggcggttgcctcgaatgacggcaatctggtggtggccgtgtcttcgaactcggaggaatggctgaagaagaagtcgaccgtcgacgcgctgtccgatgccgcgcaaaaaccgttgatggaaagcgatccggactgggcgaagtccgcgaccgacatgatgaatcagatttcggtgcagaaaaagacctcgacttcgtcgcggaccatatggattggcgtgggaggattcgccggcgcgctgctgcttctggtggtgattctggtggtgttccatatcctgcgcaagaaggacgtgatcgggcatcggcgtaagggccgccatagcggccgtcatggtgcggtcgccgaacgtatccaaccggtcaaagagtggggcgccgaatcggaaaacgaggattatgtcaatccggataccgcttcaacgcaagattcagaatccgttcaggaaacatccagtgaagggagcgatgcttaagccatgagcaagcctattgaagcatccattgtcgttgtcgatgacgagccgtccatccgagagctgctggtggcatccctgcatttcgccggtttcgaagtgaacacggccgcttcgggatccgaagccatcgaggtcatcgaaaggctgcagccggatctgatcgtgcttgatgtgatgcttccggacatcgatgggttcacggtgacccgacgcatcaggcaggaaggcatcaccacgccggtgctgtacctgaccgctcgcgatgacacccaagacaaggtcatggggcttaccgtgggaggcgacgactatgtgaccaagccgttcagcctcgaagaggtcgtggcccgaatccgcgccatcctgcgtcgcacccagcagcaggtggaggacgatccgatcatccgtgtgggcgatctcgaaatcaacgaggactcgcacgacgtgtcccgagccggacagccaatcgacctgagccccaccgaatacaagcttcttcgctacctcatggacaatgaaggccgcgtgctgtccaaggcgcagattctcgatcacgtgtggcaatacgattggggcggggacgcggccatcgtcgaatcgtacatctcctatcttcgcaagaaggtcgatggcatcgtcatcgaggatgagaacggcgacaagcacaaggtaacgccgctgatcgaaaccaagcgcggcattggctatatgattcgcgctcccaagaactagattcagccatgagcaagaatcccaattcgccgtccacgggccacgcctccaatccttcggccattccggcccccatgcagcctccccggtcgctgccgaagcagaacaaggtatggagccgtttcacccgcaggattcaagcgattccgctgagcacgaaactggtcacctgcatcatcgtgctgctgaccatcggcaccatcggcatctccttttccatacgtacgttggtgggcaattatctgctgcagaagaccgatacgcagctgatcaaccaagcccagctgattttcaacagcatggactcgctcagcagcgacaccggcgatgacgggcgcagcctcatgaacacgtattacgtggaggtgcgcgacagcgaatacaaaagcacgggtgccggatcggtgcccatgctccgtgacggagtggtttcggaaccaagcctgccggccgacggcagcatcgacggcgtcactcttggacagccattcacgacacgtgcggtggtgcacatcaccacaagccgcaccccggatcattccatcatgcaggctgcgcagtcgccatggcgtgttgtcgcgttgccttggaacgagaagacacggaccgggcaagtcaaggacagtggcgtcgtgttcatcggcctgtcgctgagcgatcagatcgacacggccaacacattgacgcgattctgcgcgatggtgggcatcgcggtggtgctgatcggcgcgatactcggcaccattctggtgcaaagcacgctcgcgcccttgaagcggattgaaaaaaccgccgcgaaaatcgccgcgggagatctcagccaacgtgtgccagacctgccggaaagcacggaggtcggctctctgtccatgtcgctgaacaccatgctgacacgcatcgaggagagcttccacgcgcaggaagagaccaccgaaaaaatgaagcggttcgtctcggacgccagtcacgaattgcgtacgccgctcgccgccattcacgggtacgccgagctgtacaaaatgcagcgcgacatgcctggggctttggagagggctgacgaatccatcgaacatatcgaggcatccagcgcgcgtatgacggttctggtggaggacctgctgtctttggctcgtttggacgaaggacgtggcatcgacatcacgcagcaggtgaagctgacctccgtggtgcgcgacgcagccgatgacctgcatgcgctcgaccccgaccgcggcatttcctgcggacaggtcgtgctccaaccaggtaccgatatggaccatcccgcccaattcgccttccaaaatggccagatgccccagattgagttgaagggtgatgcttcgagactgcgtcaagtggtcaccaacatcgtgggcaatatccaccggtatacgccggcggactcgcctgtggagatctctatgggtgtgctccccgcgtcgatcagtcccgaatccctatcccgtatgccgtccaatgagcagtcgcttcgccatctggtcgaagccatcgaagtggggcagtccatgcaagtgggtatgaactacgcgattgtgcgattcagcgaccacggtcccggcgtgccgccggaggcacggtcgaagatcttcgaacgtttctacaccgccgacccgtcgcgtgcgcgtcagaagggcggtacgggactcggcatggcaatcgcgcaatccgtggtcaaggcgcatcatggattcatctgcgcatccggcagcgaaggaacgggactgatcctgacggtggtgctgccgatcgccccggtcgaacccaagccgcagccgattacggcgagcgagaatcgaaaaaacgaaaaaaagaatcgcaaatcaaagaaataacgctcttttccgtcgggaaagcagacgctatcggcgcggaaggatgggtgcggcccacctcttgcgctaaactgtatctttggtttgaaaatgggcgaatggttttacctattcgcgtgaaggtatctgatcagcaaaatgtgaggtgacaatgccgagcggacgtgttcgttggtttgatgcgaacaaaggctatggtttcattcagacgggtgagagcacggatgatgtgttcctgcccgctgccgcccttcccgagggcgtgaagacgctgcgtaagggcgccaaggtcgagtattccgtcattgatggtcgtcgtgggccgcaggcgatgggagtgacgctggttgcctcggccccgtcgctggttaaagccacccgtccgaagccggacgatatggccgccatcgtggaggatctgatcaagctgcttgactccgcgggcaatcagcttcgtcgacatcgctatccttcaccggctgaaagcaagaagctcgccacgcttctgcgcgcggtcgccgacaatttcgacgtacaggaatagagtttcatgtccgataccacaatggatcccaaggcaatcgcccaagcggtcgctgtcacagtgtccgacgaggacggtcaggtcggcgacttcgtggaagccatcgacctgggagacaacgtcaccgatttccgcttcgaatcccgagtacgcggctacgaaggctggcaatggtcggtcacgttataccatgatgtcgaactggaccattggacggtcaacgaatcatccctggtcccgaccgacaaggccctgcgtccgccaaaatggattccttggaaggaccgtctcgagccgggcgatttggcggtgaccgattcaatcggcaccgatcccgatgacccccgcatggaagagggcttccgcaagacgcaggatgccgagacatcggacgatacggacgacaaaccgtcagtcgcggatgaaaccgtacaggaaccggcgatggatggaaacgcttcggatgagtctgagaagacggacgtttcggaggattccgaacagcctgtgacgtccgaagaggatgtcgaagaggcggtcgaggaattcgacctgtcccgcaggcacgtgttgactccgcttggccggtcgcagaccgcgaaacgttggtacgaaggcccacatgggccaaaatcgctatccaccaagacggccgacggcaatccttgctccacgtgcggattcttcattccgctgaagggtgagttgaacctgctgttcggcgtgtgcgccaacaagtggagcccggatgacggcagggtcgtgtccatcgatcatggctgcggagagcattccgaaatcgatccaccggagccgtcgcatctgtgggtgcagtcgaagccggcgttcgacgacatgcatatcgatatcatcgcccaggcgccgcgtgacgagcggggctccgtggagctgatcgaacagctttcgtccgatgacgaccataatccgaatgaggatgaggaaggttcggacgcggacatcgaagccaacaccatcgacgacgacgccagccaagaggatgtgcttgagcatgtggcttccgacgatgcgcctgaagtagagaccaccgtcaccgtggtcgacgagaataagccggaaacgtcggacgataccgaatcgactgatacggctgagccgactgaatcggacgagccagtcgaacaggctgaacaggttgattccgccgattccgtcaattccgccgagtcgttcgagccggttgaacagatggatgagacggtagttgagccgactgctgaaaccaccgggcaaacggaaaacaaatcgatggaagacgaatcggcggaagctgagtcaacagaagccgaatcggcggcggctgaaacaacggaaagcgaaatgacggaagctgattcgtcggcccaagccgaatccgacgaataatcgtcatcgtatatgagagggccacgtacctgaatgtgtacgtggccctctcatatcttgttttcttttttatgcggtcagtgcacgacggtgacggtgcagtctgcgaagttgatgatttgcttggaaaccgatccaaggaaatgcgcgtccagaccggacaagccgcgcgaaccgaccactagatgacgtgcgtagcgggaagccgcgataagccccttcgaggcgggaatatggaaagcgtgcgattcgatttggaaatcgtcgggaatgttcgctgatgaaacctgaaccgaatcgagcaattcatcaagcatgcgttccgcctgcgcctggccgacggagatgggggcgacggcgttctcataccctttgaccacgcccaaatctttcagctgccagcagaacatgacctgcaggggagcgtgatgcagggccgcgaaatcgatggcgaaacgcaaagcgtgtttggaggtctccgaaccatcaacgcctacaaccaccggacgctggttccgaggcaggggagaacccggcatcgtgtaggagaccgtttcctcggtcggcgtaagcgcattggcgatggcgtcctgcacggatgcctcttcatcatcgaggatacgcaccacggtgacgggcaccttcgcctcctctgcaagagaagcggaaagcgatcccagaaaccatcgtgccacgcgtccaagcgaacgacgtccgacgacgatctgttgggcgtccttgccgatttccagaagcgctgccgttccggtggctttgacggaggtgagtttgacgcggttctcgtcaatcgtcatgccttgcgaggcctgggccacccattcgcgcagccgacgggcgatatcatgacgcatctgcgcccattgctcctcatcttccggctgggatcccatatcccatgaatgggtccatgcgtagaccgcattcacctgctgtccggtcagcgatgcttcgccaagagcccaacgcagggctgcgaaggattcatcggacccgtcgacgccgacgacgatgtcgcctcggcgggaatccatcacatcatttgattgcaggatggtgtcgctcatttggtgacctccttggtcgttgccataagtcaagcatatccgtttctttgcgtccatagcgcaatttacgcgccggcggaataaacgtcaccgcgaatcggtagagtgttgaaggactaacaagagtggaaggacaagcatgttcgaacggtttaccgaccgtgcgcgacgcgtgattgtgttggcgcaggaagaagctcggaccctccagcacaactacatcggcaccgagcatctgctgctgggcctgattcgtgagggtgaaggcgttgccgccaaggcattggcctcgaagggcgtgaccttggacgacacccgcaagcaggtcgaagagatgatcggcaagggaaatgcgtcgccgaacggccacattcccttcaccccgcatgccaggcaggtgttggagctgtcgctacgtgaggcgttgcagctggggcacagctatatcggcaccgagcatatcctgctcggtctgattcatgagggcgaaggcgtcggcacacaggtgctgatcaagatggatgtcaaccttggcgaactgcgtagcgccaccatcgatctgatccgaggcaattccagcgacggcaagaacgatagcaagggcgaactcgccaatgccggtggcgtgcaggaccgtcgcaatcagaccggttccgcgattctcgaccagttcggccgcaaccttacggctgaggctgccgctgggaagctcgatccggtaatcggacgatccaacgagatcgagcgtgtgatggtggtgttgagccgccgcaccaagaacaacccggtgctgatcggcgagcctggcgtaggcaagaccgcggtggtcgaaggactcgcgcagaagatcaacgccggtgatgtgccggaaacgctgaaaggcaagcaggtctactccttggacctcggttccatggttgctggttcccgctaccgtggcgatttcgaggaacgcctgaagaaggttttgaaggagatcaaaacccgcggcgacatcgtgctgttcatcgatgagattcacaccatcgtgggcgcaggctccgcggatggcgccttgggcgcttccgatatgttgaagccgatgctggcccgtggcgaactgcagaccatcggcgcgaccaccaccgacgagtaccgcaagtacatcgagaaggatgccgcgctggaacgtcgtttccagccgatccaggtgcacgagccgaccatcgccgagaccattgagattctgaagggcttgcgtgagcgttacgagaaccaccatcatgtgacgatcaccgatggcgcgctgcaggccgcggcggaactttccagccgctacattcaggaccgccacctgcccgacaaggccatcgatctgatcgatgaggccggcgcccgactgcgtatccgcaggctcaccgctccgccggagctcaaggaattggacgccaaggctgccaagctggccgaggagaaggaccaggccatcaaggaccaggactttgagaaggccgccgagctgcgtgacaagcaggagaagatcgagtccgagcgcaaggagaaggaatccgcttggcgtgagggcgagtccgatgtgaagatggtggtggatgaggacgtcatcgctgaggtgatttcccagaccaccggcattccggtgttcaagctcacccaggccgagtccaagaagctcatgggcatggagagtgaactgcacaagcgcatcatcggtcaggatgaggctgtgtccgcattgagccgttccatccgtcgcgcacgcgtcggattgaaggatccgaagcgtccggctggctcgttcatcttcgctggcccgaccggcgttggtaagaccgagctggccaaggctctcgccgaattcctgttcgacgatgaggatgcgctgatccgcgtggacatgtcggaattctccgaaaagtacgccgcgtcgcgcctgttcggtgcgcctccgggatacgtcggctacgaagaaggcggcgaacttaccgaaaaggtgcgtcgcaagccgttctccgtggtgttgttcgacgaaatcgaaaaagcccatccggacattttcaacacgctgttgcaggtgctggacgatggccatctgaccgatggccagggacgcaaggtggacttcaagaacaccatcatcatcctgaccaccaacctcggcactcgtgacatcgccaaggccgccaacaccggtttcaacctgggcacgaacaccgaatcgagctaccagcgcatgaaggaacaggtctccgccgaactcaagcagcagttccgtccggagttcctgaaccgtctggatgacatcatcgtgttcaagcagctcaccgaaccgcaggtgcgtcagatcgtcgacttggatgtcaagcagctcaacgaccgtctgttcgaccgtcacatgtcgctcgaactgaccgacgcggccaaggatctgctcgcacagaagggcttcgacccgctgctgggcgcccgtccgctgcgtcgcgtgattcagcgcgacatcgaggacgccatttcggagaagatcctgatgggcgacctcgaagatggccagcgcgtgagggtggacgccgaaggcgaaggcattctgggtgagttcacgttcaccggcgaggccttcgaagagccgaaccagaaggataatccggcggaggcgaccgaaacggccactgaaaccgatgccgccactgaaccgacggcatcgacggaaccggctgattccgcgcagtcacagaactgatttccaacgttgccggggtaagaaccccggcaacgcgtatgcaaaaagaccggtgggtttcatgatggaatgtcatgaaacccaccggtcttttttacatatgcctattcgtccagctattcgttcagctggacggttgtggttccgcccgcttccaagcggaaccacaaccgtatcgctctatgggagcgtcattacttgatggcgttcagccactgttccttggtggccttctccgcctcaagcttggccttcttcttcggatcggactcagcggcgatctgggcgttaagttcggcgagctgtgcgttgagctgctcctcgaaggaggacttacgggcgtcggcttccggatcagactgcttccaggcggcatcctcaacagccttgatctgcttgtcgacagcatcaagacggctttcgatgcggtgcatgtcatcgcgcggaacgtagccgatctggtcccattcctcctgaatggcggccaatgcctggcgagcctgcttggcggccttctcatccttgaccggcaccaaagcctcagccttggtcagcagttcttccttcttggcgagattttccttttcggacgagctaatctgctcgcgatcggtctgacgggcgttgaagaacgtgtccgccgcagcacggaaacgtgcccacagcgcgtcatcatcacgacggcccgcacgaccggccttcttccaacgatccatcagctcgttgaacttgcgggaggtttccacccaagcggtggaatccttgatctcctcggcttcggcgatgatggcctccttcgcggccttggcgttgctgcgctcctcatcgcggccctgggcccacttgcggcgggcgctgttgaacgtagtgcgggcggaggagaaacgggaccacagggcgtcggcgtcggccttgtcgagacggacgctattgtgctggtgatcctgccactgctggaacagcgaacggaacttgtccgcggtggaacgccagttggtgttgtcgcccagggaattggccagagcctcggccttctccacaatcgcggtacgttcggccagcgccttggcgacggcggccttgtgagcctcgctcagctcggccttcttggccgctccggcctccttcagtgcttcgaactgggacttgagcgcctcaatatctccgacgacggccggctgctcgatttcggcggaaagcgtcttgatggactcgtcgatctcacggttcttcacattgctggacttgagcctgttggcgaacaggtcgagctttgccttcagatcgagatagcgacgggcatacagtgccagggcctcttccttggaagcgtccggaaactgtccgacctcgcgttctccctcgccttccttcacgaacacggtgccgtcatcggcgacacggccgaacgcttcggtggccttgatatcggcttcggagaatccggtggaggttgcaggacgctgcggagccttcttggcgaaggccgcggggctcggcgcatgcggcttcatggccgctgggctcgggacggccggtttgctggcctgggttgcgggcgtcgctgcctgctcgttggtttcagtggtgttctcggacgcggtgacattctcgtcggccatggccagctccttacgtaagcttcatgtagtgcagaggtgacggtccgtgacgtgcgcttccacaccttgaaaaacgcgcggcattttccgtaacctcatttattatagagaaccgtggctaaaggtgcatctatttcaggatttccagagtggctcccctctgaacgtgttgtggagcagcgtgtcatcgacacgctccgtaatgtattcgagctcaatggcttcataggcattgaaacccgtgctgttgagcagggttccagcctgctcaagaaaggcgagaccagcaaggagatttacctgctgagccgtcttcaggaagtcggacacgagtccgacactccgattgaggatcgtcttggtctgcacttcgatctgaccgttccgctgagccgttatgtcgtcgaacattccggcgatctggcgttcccgttcaaacgttggcagattcagaaggtctggcgtggcgaacgcccgcaggaaggacgtttccgcgagttcgtgcaggccgacatcgacgtgatcggcaatggcgatctgcccgaccattacgaggtcgaattgccgttggtcatggtgtccgcattggaacgtctgcgcgagttcggtctgccgaaggccaccgtgcatgcgaacaaccgcaaactttccgaaggcttctaccgtggtttgggccttacggatatcgaaggcgtgctgcgtgagatcgacaagctcgacaagatcggcgccgatgaggtggccaagctgctcgtcgaaggctgcggcgccgacgaagcccaggcccgtgcctgcctcgaactggccgagctgaccgccgccgacggcaaggaactgtccgacaagttcgacgcattgtgcgccaagcatgacatcgcgtctgattccgacgcctacgtgttggcacgccagggactcgacacgctggcgatgatcgtcgacgaggccgcgcgcatccgtccgggctccgtgatcgccgatctgaaaatcgcccgtggtcttgattactacaccggttccgtgtatgagacgttcctcgacggcgccgccgctttgggctccatctgctccggcggccgttacgacaacctcgcatcgcagggcaacaagaagtacccgggcgtgggcctgtccatcggcctgtcccgcctggtctcctacatgctgcacaccgcgggcgcgcacgccaaccgtgtgtctccggcatccgtgctcgtggcggtatggaatgaagccgaccgctccgcgtccaacctgatcgccaaccagctgcgctcccgtggcatcgcggcggacgtggcgccgaccgcggccaagctcggcaagcagatcaaatatgcagacaagctcggcatcccgtacgtctggttcccggccgacgcttccgaagagggcgcccaggacgaagtcaagaacatcatcacaggagaccagcggccggctgacgcacagtcgtgggagccggatactgtgtatgcccagcaaaccgttaccgttgaagcctgaaatcgcaagacttcgcaacatacaagaggataaggaataggggaagcatgagccagacggcttacagaacacatcatgcaaccgaagtgaccgaacagctcgtcggtcagaaggtgacgctcgccggttgggtcgatcgtcgccgcgaccacggtggcgtggccttcatcgatcttcgcgacaacaccggtctggtgcaggtcgtcatctatgacgaggagatggcccgtccgctgcgctccgaattcgtgatccaggtcgtcggcgaggttcgtctgcgtccggacggcaacgagaacgagcatctggccaccggcaagatcgaagtcgtggccgaaagcatcgaagtgctggccaagtccgatgctctgccgttccaggtctccaccgctcttgagaacgagtccgagaacaagctgccgggcgaggacgtgcgtttgaagtaccgttacctcgacctgcgtcgtccgtccatgcagcgcaatctgaagctacgcgcccagatgtcgaaggccgcccgccatgcgctggaggaaatgggcttcgaggagatcgaaaccccgaccatgatcaagtccacgccggaaggcgcccgtgacttcgtcgtgccggcccgtctggtgccgggttcctggtacgctctgccgcagtccccgcagctgctcaagcagctgctcatggtctccggcgtcgagcgttactaccagctggcccgctgctatcgtgacgaggacttccgcgccgaccgccagccggaattcacccagctcgacatggagatggccttcgtggaccaggaggacgtgatggccatggccgaaaaggtcatcgccgccatctggaagtccgccggctacgacatcaagctgccgatccagcgcatcacctggcaggacgccatggacaagtacggttccgacaagccggatctgcgtttcggcaatccgctgatcgaactgaccgattacttcaagaacacgccgttccgcgtgttccaggccccatacgtcggcgcggtgctcttcaagggtggcgcggccacgcctcgccgtcagttcgacgcatggcaggattgggccaagcagcgtggcgccaagggcctcgcctatgtggtgttcgccgagaacggcgaactcaagggccccgtcgccaagaacctgtccgaagaggaacgcaacggtctgaaggaagccgtcggcgccgaagacggcgacgccgtgttcttcgcagccggtcgccgcacctcctcccaggaactgctgggcgccgtgcgtgtcgagcttgcccgccgcgcgggcctgctcaagcccgacgatttcgccttcacttgggttgtggacttcccgctgttcaagccgaccgatgacccggacgacgacgatgtggcagtcggccactccaagtggacctccatgcatcacccgttcaccatgccgtccaaggattggatcgacaagttcgacaaggatccggaacacgccatgtccgattcctacgacatcgtatgcaacggcaacgaaatgggcggcggctccgtgcgtatccaccgcgacgacattcaggaccgtgtgcttgacgtgcttggcatcacgccggaagaggccgcagacaagttcggcttcctgcttgaggcattcaagtacggcgctccgcctcacgccggcatcgctctcggctgggatcgtaccgccgcaattctggctggcgccgactccatccgcgacgtcatcgccttcccgaaggctggcggcggccgcgatccgctgaccggcgctccggctccgatctccgctgagcagcgcgccgagaccggtgtcgattacgatccggatgaggacgaggactgatacggtttcgcccatagatgaatgaaaaatgtccgaacatcaatgatgctcggacattttttattattcgcgttgtctattttccgtcgctgtcattacagtggagcgtgtttgattatccggcaaccagaaagggttgaagcgcggtatgaaatcgaaaacacaggacaagaagcgactgaacacggtcggcatgcgcatatgcgcgctgttcgccgtgctcgccgtggtctttgcggcattcatgacgaccgttccgcatgcgctcgcctccgaaactggcaatccggcctcggtcaagggcaagacatataaaatcggcaccgacaccacgttcgcaccgttcgaataccgtgagaacggcaagatgaccggcatcgacatggagctaatccgaggcatcgccaaggaagagggctttaaggtcgagatacagtcgctgggattcaacgccgcgttgcaggccctaagctccaaccaggtggacgtcgtcatagccggcatgtccatcactgacgagcgtaaagcctcctatgatttctcgaatccgtatttccaatccggcatccagatggccgtcgcggccaacaacgacgacgtcaccggctataaggacctcaaaggccggacggttgtggcgaaaaccggctcggagggcgaatcgtacgccaaacagcatgccgacaagtacggttacaaggtgacttccgtcgaccaatcctcaaccatgtacgagatggtcaaatccggcaatgccgtcgcggtgttcgacgattatccggtactggcatatggcgtatcgcagaacaacggtctgaaaatcgtgactccgaaggtgccgcacggcgaatacggcatggccgtgaacaaaggcatgaacgcagatttgctggccgccatcaacgatggattgaacaagatgatcgcttcgggagaatacgagcgaatcgtcgcacaatatcttggcaagcaaggcgcgaaagagcaggccaaatcgatttccggcatgatcaccgacaatggcgacaacagcgctgaacaacagaaggtcggtttcctcggactggtcaaacagtcgatgccggcattgctgacgggcttgaggaacacgctgctgatcacgctgctttccttcgcgatcgcattggtgctcggcgtcgcgttcggcctgatgaaggtttcggaaagcaaaatcgccgcaggattggccaatgtgtacatcgcggtgttccgcggcaccccgatcctggtgtgggcgttcttcttctacttcggcgtgccccagctcatcggacatagcgtgaacatctgggtcgccggcgcattgaccttgtcgctcaactccggcgcgtacctggcggaaatcgtgcgtggcgcagtccaatcggtcgattccggacagatggagggcgcgcgttcgctgggactcaaccacaggcaggccatgcgccgagtgattctgccgcaggccagcaaaatcgccatgccttcgatcatcaaccagctggtcatcatgatcaaggactcctctctgctgctcgccatcggcttcggtgagctgctgtaccaggcgcagcagctgtacgcggcgaacttccgcgtaaccgaaacgctgctgatcgtcggcgtcatgtacttcgtggccatcaccatcctgacgtggctggccaacatcgtggacaggaaggtgaaccgatgaacgagaacgacgtgatcatcgacgtcaaggatctgcacaaaagctacgggcagaccgaggtcatcaaaggcgtcgacatgaccgtgcgcaaaggcgaggtgatctgcatcatcggaccgtccggcgccggcaaatccaccatattgcgttgcctgaacggactcgaacaggccaccggcggcaagatcgtggtcaacggacacgatttgacggacagccatgtgaacatcgaccaggtgcgcgagcaggtgggcatggtgttccagcatttcaacctgttcaacaacatgagcgtgatcgacaacatcaccctcgcaccgaaactggtgcatcatgaaacggatgagcaggcccgcgcgcacgccatggaactgctgaaaaccgtaggattggccgaaaaagccgacgccatgccgaaatcgctgtccggcgggcagaagcagcgtgtggcgatcgcgcgctcgctggcgatgaatccgaaggtgatgctgttcgacgaggcgacatccgcgctcgacccggaaatggtgggcgatgtgctcgaagtgattcgcgaccttgccgccaaaggcatgaccatggtgctggtgacccatgagatgggcttcgcacgcgaagtggccacgagggtcatcttcaccgatgccggcgtgatcgaggaagagggaacccctgacgagatcttcaaccatccgaagagcgaacgattgaagaccttcctctccaaggtgctgtgacattgctccggcggcgatccgtttgatgaatatgttcgtcaaacggtatgaaatgtctcatattccggacgaaatgatgtgaacgggcagtataggaaacatgaatttcgcattgctttcttatactaccctttatgtctgaaatgaaagaaaccgaagcgaagcgtcccatcatgccggacgcgggagcggataacaggccgctcgtcgaactgacccatgtcgagaagcattatggcgatctgcatgtgctcaaggacatcaacctcaccgtgcgcaaaggcgaggtgctcgtcatcgtcggaccgtccggctccggcaaatccacgatgtgccgcaccatcaaccgtctggaaaccatcgattccggcgatatccgcatcgacggcaaaccgctgccgcaggaaggcaaggaactcgccaaactgcgtgcggaagtgggcatggtgttccaatcgttcaacctgttcgccaacaaaaccattctggagaatgtgacgctggctccgatcaaggttcgtcatatggacaagaaggccgccgaagatcttgccatggatctgctgggccgcgtcggcgtggcctcgcaggcttccaaaatgccgtctcagctttccggcggccagcagcagcgtgtcgccatcgcccgcgccctcgccatgcagccgaaggtcatgctgttcgacgagccaacgtccgcgctcgacccggaaatggtcaacgaagtgcttgacgtcatggtcgaactcgcccacgaaggcatgaccatgctgtgcgtgacccacgagatgggtttcgcgcgcaaggtggccgacaaggtcgtgttcatggccgacggacagattctcgaacagagcacgccggacgacttcttcgaacatccgaagaccgatcgcgccaaggacttcctgtcgaagatcctcacccactgaagtgacggaacataacgacagaagaaggaacctgatatgaaaccactttcgatcacggcgaaacgcatgttgcgcagagccgtcgcggcattctgcgcgtgcgcgtgcgtgttcgcggtatccgcatgcggcgcggacgaaaccggcaagatccgcatcggcatcaaattcgaccagcctggcctgggcttcaagaagaacggcacctacgtcggcttcgacgtggacgtggccaagtacgtggccaagaaactcggctattccgaagacgagatcgtatggaaggaatcgccgtccaagcagcgtgaggctatgctgcagaacggcgatgtcgattacatcgtcgcatcctattccatcaccgacgaacgcaagaaggtcgtcgatttcgccggcccgtatttcgtggccggacaggatctgctggtacgcaaggacgaaaccggcattgacggacctaaggatctgaacggcaagcggctgtgctccatgaccggcaccacatccgccgtcaacgtcaaggagaagttcgccaagcagacccagctgatggaacagcccggcatggcggaatgcgccaccgcgttgctttccggcattgtggacgccgccaccaccgacgacatcattctcgccggcctcgcatccgcctcacgtggacgcctgcgcgtggtgggcaagccgttcacccaggagtattacggcatcggtgtcaagaagggcaacaccgagctgaagaacaaaatcaacaacgccatcaccgatatgattcaggacggttcttggcaaagggccatttccgacaacaccaggggagtggcctacacgccgaacgccaagtacaatccgccggtgccgaatggaaaggggaataagtgatggacggattcctcgcgttgttcagccaatacaacattcccggcgcgtttctggtgaacatcgagctgaccctgtggtcggcgttgttctccacgattctgggcgtcatcctcgtgatgatgcgcatttctccgatcgcctcgctccgtaccgtttccggtgcctacgtcgaactgttcaagaacctgccgctgaccatcatcatggtgttcatggtgctgggtgcgtacgcgcagctgaagttcagcttctccgacacgttcgccaccaacttcttctggctggccgtgacgggcctgagcctgtacaccgcggctttcgtatgtgaatcgctgcgctccggcatcaacaccgtgccgcttggtcaagccgaggccgcccgcgcgttgggcctgaacttcatgcaggccgccactcagatcatcctgccgcaggcgttccgcggttccgtggcaccgttgggcaacacgctgatcgcattgctgaaaaactccaccgtcgcggcggcggcatccgtggccaccgaaacctcgacgatgatgagcgaaatgatcgaataccacgccgaccaaatcgtaccgatcttcctgatcttcgccttcggctatgtggttctgatcattccgatcggcatgctgaccacgtatctgtccaacaagctcgcggtgaggaggtgacgcgacatggcaagcaatgaaagcgcggtgctgttcgaccagcctggtccgaagggccgcaaaaccatccgtatcgtcaattggatcgcaggcatcatcttcgcggtggtggtcgtgctgatcctcatgcgtctgcacaatccgccggacggcgagaaccagctgagctgggaactgtggaaaccggcgcttgacgccgaagcatggaccgacttctatctgccgggactgtgggccacgatccgcgcgtccgtactggccgtggtcggagccgtggtgttcggcctggtctttggtgtgggccgactgctgccgagcctgctgatccgtaccatttccggcgcgatcgtggaattcgcacgagccgtccccgttctgctgctcatgatcttcttctggcgctggttcgccttcgcaggtctgcccagccccgcgtatcgggcggtggtgctcgcgcttgtgatctacaacggatccgtggtggccgagctggtgcgttccggcgtgggcaacctgccgaacggccagcgtgaggcctcgctcgccttgggattgacccgcacgcagtcgctgttgcagatcgaagtgccgcaggccatctacgccatgctgccggcggccgtgacccagctggtcgtcgtgttgaaggacaccgcgctcggctcgatcatcatgtacactgacctgctgcaggaatcacgtcgactcggctccatgtatttcaacatcctacagacgctggtggtggccgcggtcgtctatttcatcgtctgctggctgctaagcagactggccgaatggctgccgtcgcgcatgcagcagcatacggctgcaccggccgaaccggaaccggtcgcgccgatcgccatcatggatccgtcgaacgtgaaccagatcgccgtggccaaggaaggcgtgccgctgggtggcgcgcagcgtgtctaccatgtgcaccatcgcggcaccaacgcgtccatccaccagtggcgtcagaccaggtacgcccaaggcttcgatgagacgcatccggaaagccaggtcaaattcgacaagaatggacatccgatcaaggacaatccgttcaagacgaagggcgatggcaaggacaagaacaagtccgaagccgacgaatagcaccggtatcgcataacacgcgtaggggtcgtttttccgcgaaatacggggaagcggcccctttcgtgtctacgatggactgcacgcatgtggtccgtaccaagcagggaggcttgacatggcggataaaaccaaggatgcgaaaaaagacgacgccagaatgtcgtcgatcgcgaaaacgctgaacaaagtggaagatcggctggaaaaaagcgagaattgcgattccgtcgccgaaggattggcgaacgccgccaaagcgagcgaactactgagctcggtatggacgttgccgccgacccagctattgcgattccatcacgacacgaaggtatcggacatagatggcgattccactcctggttttgacggcaacaaggatgatgccgaacgattcatatccatcagctcgtcggagatcgcccgttaccagcggcttatgtacgccaatggcgtgaaaggctcgcatcggcgactgctgatcgtgctgcaaggcatggacgcgtcaggcaaaggcggcatcgtacgacatgtgttcagccaaggcgacccgatgggcatgcactatcacgggttcggcgcgccgaaaggcgaagaactggaccatgactatctgtggcgcatcaaacgcgagctgccgaacaacggatggatctccatcttcgacaggtcccattacgaggacatcgtcatgccgcgcatctacaaaacgcagccggaagaaatgtggcaggcacggtacgacgaaatcaaccgattcgaatcgcaattgacggccgacggatgcgccatcatcaaaatcttcctcgtggtcagcaaagacgagcagaaacgccacttcctgagccgtctcgatgatccgaccaaatactggaagttcgatccgagcgaccttgaggcgcgcgcccgctgggacgactacatggccgcatggcaggatgtgttcctgcgcaccagcaccgagcaggcgccgtggtatctggtgcctgccgacaaccgctggtattcgagggccgtcgtctccgagctgctgcgcaacacgctcaagaacatgaacatgatctggccgccgctcgaagtcgacgccgacgaaatgcgccgtcagttggacacgctgtagtcgaagaagacaacctcgccgctggattgcgtggcgtccaggtcgacggttccggtgatggcccaatcgtggtcgccatcggaatcgtcgatgatctgccgcaccttccaggcgtgctcgctgttctctttgctttcgtcgaggatgaacagttcgccgctgcgtgccttcgcgtcgatgttgacgtattcgtgctcgtcgtagtaatcgtcgagcgtgtcctcccactcgtgcacgccgtagccccagtccttatcgagcgcgccgagctcgtccggcttgtcgaggtccatgagctgcacacggcggaacatggcattgcgcaccaatacggtgagtccacggcgatcctccaccacggcctgttttgcgccgggcgcggcaagattggcggccgcttcggacgcgtcggtatcggttccggcatgctcccattcgtccaccagcgaggagtcgatggaacggaccaccacgcgcagccaggagatgatgtcgtcaagctgctcgtcgcgcttttcctgcggaacggtacgcgccaacgcacggtaggcgtcggacaggtaccgcagcagcgtgccttcggaacgggcgatgttgtagcgggcgatgtagccggtgaaatcggaagcggtctccaccatgtcgcgcaccacggatttcgggctcagccaatagtcgttcgcccacggaacatcatggcggtattcatcgaacgcggcctgcagcatatcctccaacggcttcggataggtgatctcctgaagcctgtccatacgctcgtcatagtcgaggccatcctctttcatgcggatcatcgcctcgtcgcgcgcctgacgttcctgcgcgcgcagcacctgcttcgggtcctccaacgtggcctcaaccatggatatcacatccaacgcatacgtgtccgactccgggtcgagcagttccaacgcggccagcaggaacgggcttagcggctggtcgagggcgaaatcgtccggcatgtccacggtcatgaaataatccttgccgccatcgtcacggtcttcggtctcgatgacgttcgtgtcgaacaaggtctggaagatctcgtccgcgcgggcgtgcaggcgctccttctgctccggagtctgcgccgaatcgtcgataagccggtcgatgcggtagcgggcgtcgccgccctgctccacctcgttcaacaccatggaatgggtgatcttcatatgcggcaccagtgtttccggagccgcgtcgataagcttgtcgaacgtgttctcgttccacgttacgaaaccttcaggagccttcttgcgcttgatcttcttcagtttcttcggatcgttgcctgccttggccagagccttggcgttctcgatttcgaattcgggggcttcggctatgaccagaccctccgtgtcgaagcccatgcgtccggcgcgtcctgcgatctgatggaactcgcgggcgcgcagcttgcgcatcttcgtgccgtcgaacttggtcaacgcggtcaataccacggaatgaatcggcacattgataccgacaccaagcgtgtcggtgccgcagatcactggcagcagtccctgctgggcgagctgctccaccagacgacgatagcgggggagcatgccggcatggtggatgccgatgccggtacgcaacagacgctgcaggatcttgccgaacgcggtggtgaacttcgtgcccttgatggcttccgcgatcgcggcgcgctgctccttgctggacacgcccgtgctggccagcgcgttggcggtctccaacgcggcatcctgagagaaatgcaccacgtaaatcggcgtctcgcccttgccgaacgccaattccaccgtcttctccaacgggtcgagtgtgtattcgtacgtcaacggtacgggacgtggcgcatcggcgatgatatccacgtcggtgtccgtcatgtcctcaagcttgtcggcgattgcgtcgacattgcccagcgtcgcgctcatcaataggaactgcgtatccggcagcgtaagcagcggcacctgccaagcccagccgcgctcgggatcgccgtaatagtggaactcgtccatcgccacgcagccgacatcggcgtggcggccctcgcgcaacgcctgattggcgaggatctccgcggtgcagcagatgatcggcgcatccgcgttgatatgcgtgtcgccggtgatcatgccgacgttctcgcggccgaaaacttcaaccaagtcgaagaacttctcagacaccagagccttgatcggagccgtgtaataggaacggcggcccgtgcacaacgcggcgaaatgcatgccgagtgccaccagcgacttgcccgaaccggtcggagtgttcaaaatgacatggtcgccggccagcagatccatgatggcctcctcctgatgtggccacggttccacgcctttgacgtcctccacccaggtgaagaaacgctcatagatctcatccgtgtcgatgttgcgctcgccctcgtcccaattcggcgccaacgcgcccagcgagccataattcgtatcgtctgccatgcttgccagtctaccggttggggcgaacgcatgcatcgaacgtgtgttcgaattgttgggtgtgttgcggtacagtggaaagcatgactgacgatttgtttgccgcgatggacgcgccggatgatgtgacgcgcccgcttgccgtacgcatgcgcccagcgagcatcgacgatgtggtggggcaatcacgggtattgggggaggggtcgccattgcgcagactcgccaaccccgcttcgaaaggctcgctcaccgcaccgagctccatcatcctgttcggacctcccggagtcggcaaaaccaccctcgcctatatcgtcgccaaacagtccggccgtgtcttcgaggaactgtccgcggtcacctccggcgtcaaggacgtgcgtgacgtgctcaaacgcgcgcacgaacgtctcgtctccgaaggcaaggaaacggtgttgttcatcgacgaggtgcaccgcttctccaaatcgcagcaggatgcgttgctgcccagtgtggaaaaccgcgacgtcaccttcatcgcggccaccacggaaaacccaagcttctccgtcatcaagccgctgctcagccgatccgtggtcgtcaaactcgaatcgctggaaccggacgatctgaaaacgctgatcaatcgcgccatcgcaagcgaacacggccttgacaacgaaatcagaatcaccgacgaggctgtggatgagatcatccgcatggccggcggcgacgcacgtaagacactgaccatcctcgaagccgcggccggcgcgctcactggtgacaaagagcgcaaaaaaggcgcgaaacggcccatcatcacgcctgatgtggtgtcgaaggtcatggacgtggccaccgtgcgttacgacaaggacggagacgaccactacgacgtcatctcggcgttcatcaaatccatgcgaggctccgatccggacgccaccatgcattatctggcccgcatgctgcgcgcgggggaagacccgcgcttcatcgcacgacgcatcatgatcgccgcatccgaggaagtcggcatggccgccccgcaggtcctgcaagtcaccgtagccgcggcgcaggcagtggccatgatcggcatgcccgaagcgcgcatcattcttgccgaagcggcgctcgccgtcgccaccgcgcccaaatccaacgccagctacaacgccatcaacgcggcgctcgccgacgtggacgcggggcttatcggccaagtgccgctgcatctgcgcaatgcgccgaccgcgctgatgaaaagctggggcaaccacgaaggctaccggtacgcgcacgattggccgggcgcggtggcgccgcagcagtacatgcctgacgaattgcaggggcgcgagtattaccatccgaacgaccgcggttacgagcatgaggtcaagccgagattggagcggattcggaagattctgcacgaagaggacgataacggtgacggccgttccggccagcgcaatgcctgatgttcgtttcctgcaggcattgggtcaggggttccgctaaaattcttcgctggggttgacgcctgcttgctttgcaaggcccatgcgtcaatcgcggcgtcgcacatggccgcaggaaaaagtgcgcggaaagtgattatgaaagaacggaatacaacgctcgaaaccaccgaccataacaatcggaacaatagcgaaaacatcaaggaaacgccggacgaacgcattcccggcaaactcatcggcgccatcgtggcggtcggctcgctcgccttcatcggcatcctcaccgaaaccgtgatgacggtgctgttcccacagctcatgcgggaattcaacgtgaacactgctactgtgcagtggatcaccaccatctacctgctgacggtcgcagccaccatgccgctgtcgtcgtatcttaaccgcaaattcaagcatcgcgtcctgttcctcgccgcggtggcgcttgcgatgcttggctcgctgaccatgatcttcggccatgcgttcccggtgattctagtagcccgcatcatccagggcatcggctccggcgtggccacaccgctgatgatgaacatcattctcgaacagtccccacgcagcaaggtcggacgactgatgggcgtcggttcgctcgtcatcaccgtggcgcccgccatcggcccgaccgtgggtggcgcggtgtcgagcattctgccatggcgtgcgattttcgtcatcgtcattcccgtgattctgctgatttcgctgcctgtcggcctcaaatgcatcgaacagcaccgtccgacggaagaggcgcatctgaatccgctgcagttcgcggcgattgtgctggcgttgtgcggtctagtgatgttcctgaaccaggcgggcgtggctgttgccgccgccgtttcgggtggtgtggctacagcgccggcgattttcgcagtgatcagcctgatcgtcggcttgggatcgcttttcttcttcggatggtcgtcccgtcgttccttctcgccgctgattcgcttgggatggctgcgtgatccgatggtgctgctgcatctgatcgcctacatgctgctgccaatcgtcggcatcggcttcggctatgtgatcaccaatcttgcccagctttccctgggaacgaacgcgttcctggcaggcgcgctggtgctgccgggcgcgttgatcggcgctttcttcgcaccgatcggcggcacgctgtacgaccgtttcggccctgtccgcccgattctgggcgcgttcttcctggcgatctgcggcccgatcctgctgctggtcttctccatgcggctgacgccggccacgcttgccggtttctacttcatcttcggacttggctatgcgcttggcttctccaacatcatgaccaatgcgttgcgcagcattgcgccgcaattcatgccggatggcaacgccgtgttcaacacctgcctgcagttcggtggcgcagccggaaccgcgctgttctccacggtgctgtccgtggcccaggccggcgctggcaaggaaggaaccgaggcattcagccatgccacggcggttggcggcagttggacgttcaccgtcatgatcgtgattgtcgccgttgcaatctgctgcctgattaccgccttccgcatcggcgcgaaacgcgaataaccgtgttttcgccgtcgacttctccactgtgggcgcaattttgttccccgtcgcttcgaagcggtaggctgtgaaactatagagaacactggaaaaggagacaaggtgagcaaccttagtgcacccctgcccgtcatggctggcgaagacatgccggcaggacccaccgatccgattttcaaccgcctgctcaaggaccgcatcatctggatgggtgaggaagtcaaggacgagatggccaaccgcatttgcgcgcagatgctgatgctggccgccgaggatccgaaaaaggatatctggctgtacatcaattccccgggcggctccatcaccgcgggcatggccatttacgataccatgcagctcatcgagccggacgtggccaccgtgggcttgggcatgtgcgcatccatgggccagttcctgctgagctccggtaccaagggcaagcgcttcctgacctcgcatgcgcgtgtgctgatgcatcagccgtccggcggcatcggcggcaccgccactgacgtgcgcatcaacgccgagctgatcatggacatgaaaaagaccatgagcgagttgaccgccgagcagactgggcacaccgtcgaggaaatctaccgcgacaacgagtacgaccactggttcaccgcccaagaagcgttggagtacggctttgtggacaagctcgtttccacccacgacacgatgagcgccaccaagggagagtgaccatggcaagcgaagaagcacagtttgtagcccgcgccgaacgtctggccggaccgaccggtgtggtcggcttccagggggctgcggcgcgtgaggccgcgttcgcaccgcagaaccgttacgttctgccgcagttcgaggaaaagaccccgtacggatacaagaggcaggatccgtacacccgcctgttcgaggatcgcatcatcttcatgggcgtgcaggtggacgacacctccgccgatgacatcatggcccagctgctggttttggaaagtcaggatccgaaccgtgacgtgatgatgtacatcaattcgccgggcggttccatgacggccatgaccgccatctacgacaccatgcagtacatcaagccggacgtgcagaccgtatgcctcggccaggccgcctcggccgcggccatcctgctggccgccggcgccaaaggcaaacgtctgatgctgccgaacgcccgcgtgctcatccaccagccggccatcgaccagggcttcggcaaggccacggagattgaaatccaggccaaggagatgctgcgtatgcgtgaatggctggagaacacgctggccaagcataccggtcgtgacatcgagaagatccgcaaggacatcgaagtggacacgttcctgacggcccaggaggccaaggaatacggcatcgttgacgaggtgctggaacatcgcagctgagcctgcggtggaatgatatcttcacaaatgcaatacccctgccgggtcgcggcaggggtattgtgttttctaaacggcagatatgtgaaacgaagaggttgcgaatgggacgcgtggtcagctacaacgatgcggtgccgagatgcacgttctgcggcaagtccgagagccaggtgcgcaaactggtcaccggttcgggcgcggccatctgcgacgaatgcatcgaattgtgcgtggacatcatttccgaggaacgggacaaggacgcccagctcaatatcctgcaactgcccaagccggcacagatcagcgcctacctcgacaatcacgtcataggccaggagtccgccaaaaagacactttcagtggcggtgtacaaccattacaagcgcgtcaacatggaaatgcgcgagtcgtcgcgaatcggcaaggaacggatgcatggacatgacgattcgttcgagggcgtgcaagtggcgaaatcgaacatcctgctactcgggccgaccggcgtgggtaaaacatatctcgcgcagacgctggcccatgtgatgaacgtgccgttcgtcatagcggacgccaccacgctcaccgaggcaggatatgtgggcgatgacgtcgaaaccgtgctgcagcgcctcatccaggctgctgacggggatgtggcgcgtgcgcagcagggcatcgtatatatcgacgaaatcgacaagatcgcccgtaaaagcggcgaaaacacctccatcacgcgtgacgtgtccggcgagggcgtgcagcaggcgctgctcaagatccttgaaggcaccgtcgcctccgtgccggtggaagggacccgcaagcatcgtgaaatggaaaccgtgcagatcgacacccgcgacatactgttcatctgcggtggcgcgttcgtgggactcgccgacatcgtggcgcaacggttgggcgccagggaaagcggtttcggtgcggtctggcatgaccatgaggttcccaagcgtgagctgcttgcgcaggtctccgccgatgatctggctgatttcggattattgccggagttcatcggacgtctgccggtagtcagcgtgcttgaggaacttaccgaagacgatttggcccgaatcctcgtcgaaccggaaaacgcgctggtcaagcagtaccagaagctattcgccgtcgatggggtgacattgacctttaccgaaggggcgatacggcagattgcggcgacgtcgattcggcggggtacgggcgcacgtggattgcgttcgattattgagaagacgctggaggacaccatgttccgtcttcccagcatggaaggcgtcgaagaggtggtcgtagacgaagccgcagtcaccggatcgggcactccgaaactactcaaggtgtcgacgcagaaaattcctcgtctacgtgaggcgtaaggccgaaaactcctgcgacacgccgagattttgcctggagttcatttgggtgtatcttattcgagttgccgaaaacaagacaacgttgcgcgagtagcccagcggattagagcagctgactacggatcagcaggtcgcaggttcgaatcctgtctcgcgcaccagccaccagtcatcaggtggcgcaaagaaataagatgacgttgcgcgagtagcccagcggattagagcagctgactacggatcagcaggtcgcaggttcgaatcctgtctcgcgcacatgaacctccttcgcgaatgcggaggaggctttctttattttccatggatttttgtgaagcctgcaattgattgcgcgcacagcggagcgcaatatgcggcatggacgaacgccaagaccctccgatacacttaatactacgttttacggatactgcggtcgaacggggaccgcaagacaaggagcatgatggccacatcgaagaggggaacctgggcaacaatccgacgcatagccgcgtccgaccgcatatccggtctgattatgctcggtttcgctcttgccggcctattgctcgccaatctgccgttcaccgcgcatgcgttcgaacagcttgagaacttccatatagccattccacacaccaatatcgacatgggattgggccattgggtgcaggatggcctgctgacggtgttcttcctgaccgtagggctggaattgaagcaggaactcaccacgggatcactgtccaatcccaaagccgcggccgtgccgatgctgtgcgcggttggcggtatgcttgcgccgccggtactgttcatcggcgtgatctcattgttcgcggcggcaggatcagggcaactcgtcatcgcttcaggaacgtcgttctccttcgcacagatgtccaatggctgggcggtgcccacagccacggatatcgcgttctcattggccgtattggccctgttcgccaaagcgttgccgggatccatccgcgcttttctgatgacattggccacagtggacgacctgctggccatcatcctgatcgcggtgttcttctcatcggtgaacgcatggtactggttccttggcatagccgtatgcgcggtcgtctggtacttccttgtccgcatgcgcaaggtaccgtggctggccgtggccatcgtgggcgtgctggcatgggtcatgatgttcgaagccggcgtgcaccccactttggccggcgtgctcgtgggactgctcacgccggcgcatgagcgtttcggtgagaagacgccgcgtgcggaacgttacgccgacaagctgcagccgttctccgcactgctggcgttgccgatcttcgcactgttcgccactggtgtgcacttcgagtcgttgaccttggcgctgttcgtctcgccggtggtcgttgccgtgatggtggcgctcgtggtcggcaaacctctgggcatcatgaccaccgcatggctgtccacgcacgtgggcggtctgaagatggccaagggactgcgcgtgcgcgacatgttccccgctgcctgcgcctgcggcattggtttcacggtgtcgtttctcatcgcgtcgctggcgtatcaggatgccgaactatcggctgaagcccgtttcggcgtcctggtggggtccatggtcgcagccgtgatctcaggtattctgctgagccgtcaatccaaacgattcgaactggaggacggtacgaagcataagcatcataccggcgacgaagacgccatgaacgaagttgagacggtgctggaagacggtaccgtggtggtcagccagataatcggcacccaccaggaacagtaaaaggaatctccatatgttgaaagggccacgcatccccatgcatggccctttcaacatatgcgtgccattgcggcacggctgattaatctgattggtctatttcttgacggcaaccagcagaccagtgccggtcggcgtcaacgcagtgacgaaccgttcatccgactccaccgtttccagcaattcgcgcatcgcgatggatttggcatcacgattggcgggattcagcacgccgccggccgatgtggccgaatcaaaggcaagcacatcggtgaagacaatcgcggcatgcggtttcagcaggcgtggagcctgagcgaaagccgcagcataattctccgaatcgccggccacgacgatcaaatcgtaattctcggcgttcaggcggggcagaaacacacctgcggacgcgttcacggcacgcaatgtggtttcggtgtcatcggacagacgattgaacagtttgcgaatcagcgcgatgccctgcgtggacgaatcgacggccgtaagctggcctgcattgtcaagaccgttgatcagctgcatcgtctccaccacggaaccggtgccgatggcgatcaccgacgaggcgtccaacatccgcaccagcatgcgcagcaattcggcctgcgccgcggatccttggggaatgccggcttcctcggccgcggttctgatcgcattgagttcggcagactggcgtgagaacgcatgatcctcgacgtattcccacgatttcgcgagattggtatatgacgtcctatccatttcagcgctccttgatttgggcgatcagctgccagatctcctcaccgacatcgatgccacgcgggcattcacgcgtgcaggcgcgcaccgactggcacgcggcgatgccatcggcggaatcgatggcatccatacgtgcatccgtctgaccgtcgcgtgaatcattgatgaaacgggaggcggcgataagagccgcagggccgatgaacgcctcgccgcctgcatataccggacagcttccctcacaggtgccgcaggctatgcagttgctcagcagctcatacttggagagctgctggggattctgcagatattcgaatgcgttgatcttgccgtccgcggtggtggcgagttcgccactggcctgcagatacggcttgagcttcctgatttggccaagcatctggtcgatatcggcgatcaaatcacgctgcacggggaaaccgggcagcggtgcgagctcgatgacacccaaatcgtcggcatcctgcgtttgcgcgggttgaacgtcttctcccgtatgacggaagccgtcctcatccacctgtgcgtcggatggctgctttgcccaagccttcaccgtggcggtgcacagaagcgtaggcgtgccgttgatggacacggcatcggaaccgcacatgccatgaccgcacgaataacggaaggcaagcgtcggatcgatggtgcgcttgactttgagcaggcagtcaagcacggtgtcctccggacgcgccggcaccacgtaatcctgcacccactgcttgcctcgcggacgcctgcgcgcggatccggaatcgccgaagggagagctcttcctagcgaacggcgagccgcctcgttcacggccgcgttcgggacgcggcgtgaacctgttcacccgcaacgtcaccgtttccatgccgttctccatgccgctcatatacctgcctttcgataaaaaaccgtcaaccagtctgccatacgccgtgcccagggtgtcagtattcacgggcctttggcggcatgtccacgatgtgcaccggctgccaggagacctggcaggaaacatccgtcatggaatgggccaggaaatgctcgtcgtcacgctccgggaaatcaagacgcttcaacgatccacgggattcgtgacgcgcatcggaggcggcgagcacggccttgccgagctccaacagatggcgcacctcccagatggcggtgatttcctgattgaacgtgggggagtcggaatgcgcatgcagcgcctcggcacgcggcgtgagcgtatcgtccagcgtagccaacgcctgttcgatgctgttccggtcgcaacgcaccgcgaccgcctgctccatgacggatcccaaatcggccatcagctggtacggattgtccgacgacgcatcgtcgtcatcggacggccgcgtcaacagttccttgacctgcgcggaacgcttgtcggcagcctgcgacaccgcgtcgatagatgcttcgtcggcaggctcggccatcggatcgttcactggattatcgacgacacgttcagccatcgccttgcccgaacgggtgccgaagagacaggcgtccaacagcgagttgccgcccagacgattcgcgccatgcaccgacacgcaggagcattcgccagcggcgaacagaccgtccacgacggcgcgttcgccatcgacccaacggtagacttcgccgtcggtggtgatggggatgccgcccatggtgtaatgcgcggtgggtttgaccggcacatagtcgcgggtcggatcgagatcggcatactgttcgatggtctccaccacctgcggcagcacctcatgcatatgatccgcatcgatgccggtcatatccagccagacacaatccttcggcccatccggatccttcggatcggcgattcctcgtccggcgtcgatttcagccatgatggaacggctcaccacatcacgcgcggcaaggtcggcatgacccggcgcgtaatgttccatgaacgcctcgccatcggagttgcgcagcatgccgccttccgcacgtgccgcctcagacagcagaatgccggtatgggcgagaccggtcggatggaactgcacgaactcgctatcctcaagctgaaggccggcggacaatgtcaacgccatgccgtcaccggtcagatcccacgaattcgacgtggtatggaacagacggccggcaccgccagtggccatcagcacattgcgtgcgtggatggcatgcgtctcgcccttgtgcgtgtcgaacgccaccacgccctcgaccttgccgtggtcttcggaaaccaccagatcggtcacataccattcctcggcgaactcaacgccctcggccacgcactgctgccacagcgagaacagaatctgatgcccgatgcggtcggccgcataagcggcgcggcggaccggttccttgccgaaatccttggtatggcctccgaaacggcgctgcgcgatatggccgtcatcggtacgcgagaacgcgacgccggcatgctccagcgcgatcacagtggcaggagcctgttcggcaagcagcttcgccgcatcctggtcgacaagccagtcgccgcctttgactgtgtcatagtaatgccaatgccaatcgtctttctccacgttgccaaggctggccgcaatgccgccttccgcggagccggtgtgcgaacgcagcggctgcagtttggatatcaccaggacgttcggttcgatgccgtccgccctcatctggcgcatccgctcgctacggagcattcccaacgctgcggacaggccggccgcgcctgcgccgacgatcactgcatcatacatatcttcaacatgcttcggactcataccaccgattctcgcacaaggtgtgacctcgcacgttcgacgcggctgaggtggaggtgccgggcctgctatcgctgctcggcgatgatccatccggaccgcatgctgatgcggccttcaagctccaaggagcccagttcgcgcatgattcgcgagacgggatattctcccggatgcgtcttgtccattagatcgagcagattgtcggcggagacgtggccgtttgcttcggcgcaagttttaatggcggcgagtatggcatcgtcggattcatctgtcgattcctgcggatgttcggtgtcatccggcaggtcgacatgttgcgggcgatgcgcgctatggcatagttcgtcgatctccgccagtgagcagacgatggtggctctgccgtcttggataaggcgattgcagccggtgttatgcggcatggtgatgtctcccggcacggcgaacagattgcggttgagttcgttcgcccagcctgcggtgttgagcgcgccggaacgcgcacgtgcctgcgccacgatcagagtggatgacaatgccgcgatcagacggttgcgcagcaggaaccgtcttgcctccggcacggttccggggcacagttcggaaatcaaagcgcccgaatggctttcgatctgctcgaacaggttctggttgcttttcggaccgatatggttcagtccgccagcgaatacggcgacggtgcgtcctgccagcgcggcgctcatttcgtccatggctttgaccgcgccccaatgtgccgcggcgtcggtgcccagcgcgccgccggataccaccagatgtccggcacgcgccatccgaagggccaactcgtgggcgctttgcctaccgtagtcgcttacgccccgtgagccgacgatacccaccggctcggggcatgacaccagcgccttcggatcgcctttgccccataggcagagcggggaggcccagtcggtgcgcagtgaaaggtcgttcagttggctgggccaacaggggtgatgcggggcgatgatccactgcgtgccgtctgctgtgaaccagtctcgcaatgcgtccggatccttgctgggcaacgatgccagacgttgctgccatgacaccagcgagccatggaacgaagccatcccgcgggcgttgatggtgcgtccccaacgagtgacgccgttgatgaacgccgcatccaatgacgtgcaggccgcggccgtcacattttcgtgattgccagggccgctgtcagcgatcagctgtagcgcgcttgccgcggagccggtgcctttgaccagcgcgtacatcatcgcgtcggcgctgtccaggcagaaggtgagcaccgcgcgggccagggtctcgtcgtcgatcgtcaccatcatgccagcctcgttctcatggatattccctgcatcatttcctcaggtcctggggaagtctttcccgccagatcggataatgtccacgcaagccgcatggcacggtcggcgccacgcaggctcagccgctcgctcgccaaggcgcggttgaccaattcgatggccttgggggaggtgttggctctcagccaggtgctggtagcctgcgcgttgcagcaccagccgaattcgcggaaccgttcctgcgccatctgccgggcaacgatgacacgcagacgtatggcatggctcgaatcgccggagggagcgttccccggacttatccgctccaccggaggcacctcgatctggatgtcgatacggtcgaggatcggtccggaaagccggctgaaatacttgacgcggtccttttctcggcaggtgcagcgctcgccgttgccgtacgcgtagccgcacgggcagggattcgccgccataatcagttggaagcgagccggatagtatgtggtgcctttcgctctggaaatcgcgacatatccggattccaaaggttcgcgcagcgtctgcagcgtacgcgccgagaattccggagcctcgtccatgaacaggatgccgcgatgcgcgcgggtgatggctccgggctgggccaatcctgcgcctccacccaccagcgcggcggtcgacgcggtatggtggggcgcctcgaacggtggaacgtcgctgattccgtatccgggaagcgtgccgcataacgaacgaatcgaggccacttcaagctgttccgtctcgttcaaaggactcatgatgccgggaatgcgcgaagcgagcatggtcttgcctgtgccgggcggaccggtcatcatcagatgatggcctccggcggcagccacctccaacgcccatttggccgcttgctggcccatcacttcgctcatgtcgccgggcggagggcacatgcccgtggcgccgacatcggcgttcacggcatgcgtggcttcgggaatccggtagtccgcatcgcctcccatcagttcgatgagctctccgacatgcctcacgccgatcgccttgacatccggaacgagacgggcctcatcaaggttggcgtaaggcacgatgattgttgcgattccctgctcccgcgcatgcagcatgatgggcagcagtccgttgatgggcaatacggtgccgtcaagattcacctcgccaagcacgatggtgccggccagacagtcatgggcgattgcgccggccgcgctgagcacgctggccgcgatggccagatcatgcgaagagcctttcttcggcatggacgctggggagagattgaccgtgacacgggtttccggccatttgaaaccacttgcctggcatgccgacttgacccgttcgcgcgcctcggacaatgaggtgtcgggcaggccgatgatggagaaatagggaagtccaggggatacgaacgcttgaatctggacgatgaaggctttcaaaccgatcagtcctacggaaagggcgctgccgatggccatcagaacgctccctcgatatgatgcagcaaaggtctgtctccctgcaccacgacggtgacgacgtcaaaacgcacgccactgttcggcatgcggtgctccggcgccgtcagccattgcacggcggcatggcgcagattgatttgcttggaagcggtcaccgcctcctgaggggtgccgtagcgcatcgtacgtctggttttgacctcgacgaaaacgatctggcccatcggattgcgcgacacgacgtcgagttcgccgtatcggcaatgccagttgcggtcgagcgtccgccacccttggctttccaaccatgcggcggcgtactgttctcccagctcgccaatctgtcgggaacgcagcgtgccgtcatgcagacgccgcgctagggaatcgagaatctgctccggcggctgcgttggggccggaacatcatgtgatgatgaatggttcatgtccctagtccaacagacagaagccacgcatgacaaggccgataggctaatgtggataacttacgtatctcgggcgtgtcgtggatagtcggtggatgagtcgacgctatccacacctatccacaacacgatccaaggcctctgtgcgaaaagagtgaccgatgaaccgtcaacgacgggtcaaagcggtcaattcgtcgagattgagttcgaagctcacgcctcgttcctcatgattcggctgatactgggtgctttccatcgcatggcggacgaactcgccggcgatgttcgcggcctcggccagaggacggccagccatcaccgcgccgcacagcgccgacgcgaacgcgtcgccggtgccgtgggtcatgaacggcagcttggcatgcgccagctcctgttttccggcgacgcccgtcgaagctgacgccacatagttgcgaatcatgccatcccctcgatcgatgcccttaagcaccacgttcttcgcgccggcggcaagcaacgccccaagaatctcatccacctgcgcgtcgtcgatatcctggcctggatagtcacggcccgtcaaaatggatgcctcggtaagattcggcatcagcgcatccgcgccatccaccagcgtgcccatcgcccgacacagctcaggagtgtacgtggcgtagatttctccgccgtcgcccatcaccggatccaccaaccgcaaggcatgcggatactccgcgtataggcgtttgatgattgcgacctggtccgcggaaccaagaaaaccggaatagacgccatccaaatcgacgttctcctgacgccatgcgtccagatagccgtccagaatctcggtcgtatcgtggaacgtgaatacctcgtagcgcgtgtgcgcggaaaacagcgccgtcggcaccggacaaacgtcgcagccggccgccgacagaatcggaatggccgccgtcagcgaacacttgccataaccgcacatgtcatgcaccgcggcgacgcgcggaatataccgcggatcacggtcgtacagaatctcatcgctcatatcggaacctctcttgcgatttgcctgcccatgactttagccgttcccctgacctgacgcgcatccgttcctcacggtgggtcaccggcatgcgggacttcggcgtgtcgaatggttccgaatggttttttcaacggttgggggagtggggaaagccaatgattccaacggtttataaggggatataggcaagtgcgataacgttcggcttgcgttgcgctcgccggccggtttattgtcgctaccaacacctggccaagcgccctacacggcagggcgggtggccaaccaagacgagaacaacgaacccttatccaaggagagcgcatcatggcaaacaagaactatcgtttcgaaaccctgcagctgcacgtcggccaggagcaggccgacccggccaccgactcccgcgcggtgccgatctaccagaccaccagctacgtcttccacaacttcgaccacgccgaggcccgcttcggactggcggacccgggcaacatctacggacgtctgaccaactccacccagggcgtgttcgaagaccgcatcgcggccctcgaaggcggcaccgcgggcctggccgtcgcgtccggcgcggccgccgtggaatacgcggtgcgcaacatcacccagtccggcgaccacatcgtcgcagccaagaacgtgtacggcggcaccttcaacctgctgcgccacaccctgccgcgcgacggcatcaccaccaccttcgtctccgccgagaacccgcaggagttcgaggacgccatccaggagaacaccaagctcgtctacttcgagaccttcggcaacccgaacgccgacctgcccgacttcgaggccatcaccgccatcgcccacaagcaccacctgccggtgatcgtggacaacaccttcgcctccccgtacctgttccgcccgctggagcacggcgccgacgtcgttgtggaatccgccaccaagttcatcggcggccacggcaccaccctcggcggcgtgatcgtggaaggcggcaagttcaactgggccgaagtgccgggcaagttcccgaccctgaccgagccggatccgtcctaccatggcctgaacttctatgaggccctcggcggcgccgccttcgtgacccgcgtgcgcgccatcctgctgcgcgacaccggcgccaccctgtccccgttcgcggccttcctgctgctgcagggcaccgaaaccctgtccctgcgcgtcgaacgccacgtccagaacgcgctgaaggtcatcgactacctgaagaccgtgccggaggtcgagtccatctcccacccgtccatcgaaggccgcaaggacaacgacctgtacaagaagtacttcccgaacggcggcggttccatcttcaccttcgacatcaagggcggcaaggacgcggcacgcgtgttcatcgacaacctgcacctgttcagcctgctggccaatgtggccgacgccaagagcctcgtgatccacccggcctccaccacgcactcccaggagacgttggaggagctcgaggaccagggcatccaccagggcaccatccgcctgtccatcggactggagaacatcgacgacatcatcgaggacctcgaaagcggcttcaaggccttgcgcgaatccggtctggccaagtgactttggtctgaaacaactgtcgggcggtccgctgcaccatgagaagggggtgttgcgggccgcccgctttgcactgcgcttgtaacgcggatgggataaaattttcgcttgttgcgatatggtatgtcgcaatttgatacatcgaaagaaattccttgcgatttctttacaaatcgtaggaaaagcaagatgattttgctattttggtaaaaaagagagaagaagactgtattatggcgcaggacgtcaagaacgatatcaagaaagctattcaggtcaacaccatcccgttgatcgccatcatgaccgcggtcaccaccgtgctgaccatgttcgtgaagattccgaccccgacccgtggatacctcaacctgtccgacacgatgattttcttcagctcctatgcgttcggcccgtgggtcggcggcatcgtcggcggtcttggaccggcgttgtccgacctcatctcgggatacccgcagtgggcaatcttcaccttcatcatcgacggtctgcaggcggtgctcgtgggtctgctggtccgtgaattcaaaccggccaacgtcgtcatcggctctctggtggccggcgtgtggaaggtgttcggctacttcatcgccggcggcatcctgtccggcttcggtccggccctaggcgaaatcatcggcaactcattccagatggttgtcggcctgatcgttggcttcgcactgttctccgcagtgcgcaaggcttatccgccgctggtgcgactcggcaacctcagcgtcaaggccggcgagtgatacattattgtcttgcataaataaagcccgtgggttcaccgatgaacggcgattccacgggctttatttatacatattcgttcatatagtatccgtagtggctgtgttcgcggccggtgcaatgggctgatgtgctgaaagatatggagaagagcgcatgatcacggtacgtgatttgagttggcagtatgagccattggtggatggcggcaagccggtggatagcctcaagcatgtcagcttcgatatcaaatcaggctcgttcgtgggcgtcatcggaccgaccggcgccggcaaatccaccctgtgcatggctttggccggaatcatcccgaatctggcggacggcaccatgaccggactggtggaagtcaacggcatgaacaccagccgtcattccgtatcggcgttgtccgaacgtatcggctacgtgcagcaggatcccgaagcgcagctgttctgcgcgagcgttgaggatgagatcgcctttcctttggaaaaccgcggcatcgcaccggacatcatcgacaagcagatcgacgtcatgctcgatctggtcggcatgaccggctaccgcaagcgcgtgccggccagcctgtcgggcgggcagatgcagcgtgtggccatcgcggcggcattggcggcggaacccgacgtgctcatccttgacgaaccgactgcggcgctcgatccggaaggcaagcaggaagtcttcgatgtgcttgaacgcatccggcagacccgttccatgacggtgatcatggcggaacaggacacggagcatatcgcctattgggccgaccaagtattgttcatggtcaatggggaattggtgcgcaacggcgacgccagcctgttcgtccgtgaaaaaggactgctggaatcctccggcgtgcaggtcgcggacgatccgctgccgcaggtcaaggccgtacagcagggcaaaaagcataagaaggacaaaaagaatcagccggaacggtccaaggacgtggtcatcagcctggaccatgtctcctaccaatatgagcgcggcggcaatgcatcgaaagctctggacgacgtgacgttcgacatcgaacgtggctcattcatcggactcatcggacgtaacggctccggcaagaccacactcgccaaacatctgaacggactgatccgacccacgcagggcacggtgacggtggatgggctcgacgcctccaaacacagcgtcggcgaaatggcggcccacgtcggattcgtcttccagaatcccgaccatcagatcttctgctccaccaccaaggaggaaatcgcattcggtcctaccgcgcttggactggacggagccaccgtgttcaaacgcgtcgacgagatgctgacgctgttcgacctgcaccgttatgaagacgtctcgccggccacgctcggctacggcgaacgccgtgcggtggcgctgtcatccgtgcttgcaatgcgcacgccgatcctcgtgctcgacgagcctacggccggtctcgaccaccgtctcgcagcacgcttcctcggcaccatcgagaaactcaaccagcgcggcgtcaccatcgtcatgatcagccacgacatgcgcgcggtataccggtactgcacgcatgtgctggaattggaggacggaaaagtcgtgcagtatgggccgatcgacaggtccgaagcggcgcagaagcaatctcggaccatccgcaaaccgcgtaaatccaatgggcccgtttcggcgacgcatgtgctgctgaaagtcaccaagcatgaggaaggacgacactgatggacgccgatttgtatgtaccgggcgacggctggctgcatcgcgccgacccccgtgtgaaattcctcatcaccgtggtcatgttggtgttgtgcctggtatggcgcaactgggcgttcatacttgacgttctgatcatcgaacatctcatgctcatcaccgacggcgtgccgctgaaacgcatcggctgggtgtggaagatcctcgccgtgatcatcgtgttcatcgtggtgctctggccgattttcgacccatccggcacgcacgtgctgtggcagtggggatggctgaaactcacgcgagagaacctcgtcatggccgcggtgatgggattgcgcattccggcgctcggattcgcgtgcttcctcacgttgttcaccaccagccagaccaagctgatccgagggctcacctccctgggcatgccgtacaaggccggactcacgctcgccaccgcgctgcgctacattccggtgttcttctccatcttccaatccgtatcggccgcgcaacgggcccgcggactcgacttgaacggcaagaaagacgccaccggcaagaaacgcaacgtattcgtacgcttggtggaccggttcaaatcgtatctgcccatcatcatcgcggtgctgatccgcgcctacaaaatgagccaaagcgtcggctgggctatggaatcgcgcgggctcaacctccaaggcgtgagacgcacctaccgcatacagctgaagatgagactctccgattggatcatccttgcggtcactgccgccgcgacgacaggcagcatctggctgatgctgtggcagttctgaggtaggccaatgttccagaacgaacaacgcatcaccatcaccgcacgcgacctgaaagtggtctcggccctgcaatgcgacggccgcatgaccatgcaggcgcttgccgacaaggtcggcatttccgtatacgcggctacggaaagctaccgcaggcttacggaatccaacatcatgagcatcgtgccggtatgcaatccgttgaacctaggcaactacagccaggtgctggtgggcctgcgcatcaacggcaacctcgacaaggcgcttgccatgctcaaatccatgccgcaggtcacgtatgtggtctgcgcgttgggcgatgccgacatcatcgccgaagccgtcgtgtattccgccgaaggcatggaccatttccttaagcatgatctgcgcgcattgccgggattgacacgtctgcaggtgttctcctgcggacggctggtacttgacgaccacaacgtcagcgtggtcaaccggctcctggccgcgcatggcgagaccggtttcctgaccaaacgtgaggcgagcgttggcactggcattcccgcacaccgtctggatatgcgcttcgtgcgtacgttcaacgagttgcagcatgacggcagagccagctatgcgacgttgggggagcggcttggcgtgacgcataccgcgattcgtgggcgcatcaagaagctggaggaatccggcgtgatgcgcatcatggccaccgtcagccccatgcgtttgggtggattccgtcaagcgttcctcggcctcggtgtgaaaccgccttatcggctcgacaccgaacagctgctggcgatcgatgaggtgacgtatgcgatgagcggcgtcggattgaacggcgccgattacctgatcgaggtcatcgccgacaccgacgaggacctatggcgcgtggtggacgagtctattcgaccattgccaggcgtggagcaggcctggtgggcttccaccgtcagcgtggaaaaagagtcgtactggctcgaacctccgcaggatggtgtgctcctcgacgattgatgaatcaatggcatggggcgtctcatttttgctcattctcaaggatgagatgataattcagaccaacgcatgatattcgaatcagctgtttttccgtaattttggaggtaatccaaagaaaggaatgacagcatggatatcagggacaccatcaaagctaccaatacggccattgcagcagtggatcttgtgaaggactacggttccggaaataacacggtgcatgcgttgcgtggcgtcaacgtcgctttcgaaaaaggaaaattcacggcgattatgggaccgtccggttctggcaaatccacgctgatgcacactctggccggccttgactcggccaccagcggccacatcatgttcgatggcaaggacctgacccgtatgaacgatgaccagctgacattgctgcgccgtcaccagatcggcttcatcttccaaagcttcaacctgctgccgatgttcaccgccgaacagaacatcgtcatgccgcttacccttgccggcgagaagccggaccgccagtggctcaacctgctggtcgaaacgcttggactgaaggagcgtctgaaccatcgtccgaacgaactgtccggtggccagcagcagcgcgtcgccatcgcacgcgcgctcatcaccaagccgcagctcgtgttcgccgacgaaccgaccggcaacctcgactccgtgtccagcgcggaagtattgagcttcctcaaacgctccgtgaacgaactcggccagaccatcatcatggtcacccacgatgccgtcgcagcctcctacgcggaccgcgccatcgtgttcgccgacgggcagattgtggccgacgtcgaccagccaagcgccgagcagatgaacgatctgctgatgaaggagcgcgaatcggccacgcagaccatataccccgcccgccacgccggctgacgcatttcgtaaaacccgctttcgcaaaatgtacttgaagaaggaaaccgaactcccatgtggtccatcactttgaaactcatgcgtaaaaccaagcgcatgctcatccccgccggcatcgccatcctgatcggcacggcgttcatcgccagcaccttcctgttcggcaacgccatgggcgattcgctcgcccgacagatgaccgccatgttcggtggcgccaactatgccgccaccgcgaacgtcgatggcctcagcgataaggaaatcgacaaagcgtattccgtcaccgtcggcgatttccacgtcgaccagctgaaagccgtggaaggtgtgaaagccgtgcgcgtcgcgtcggaaagcgccgtcaccgtctccagcgacgacgacaacgtcagcggcgaactgatcaccggcgcatccgacgcgtcgatgctgccggtgcgcatatcgcaaggcagccagcccaaggatgccaacgaaatcgcgttgcctgagcagacggcgaaaacgttgggcgtgaacgtcggcgacacggtgacgctgacgtcccgatacgccacgaccgaaaccggcggtaaaaccaaagcgaacgacgtgcgcgtggtgggcctgaccgccgatccggaaggcgcgtactcgttctacggcggcgcgatcgtcggctcggacaatctcatcgcactgatgcaaggcgcggacgatttcaacgcggtcaacgccaccgccgtctacttcgatttcgccatggacggcaacaccgtcgccgcgaaaaccctcaacgacgcacagaaactgctgcccgcgcactacgaattgagctcgcgccagaatgtcagcgacgaggccgtcaaatcgttgggcggcaacggcaccaacgtcgtcaccatatttcttatgtgcttcggcatcctcgccatgttcgtcgccgcgctcgtgatcgccaacaccttccaggtgcttgtcgcgcaacgccgacgcacgctcgccctgctgcgcaccatcggcgcgaagaagggacaactgtaccgttccgtcctgttcgaagcctgtgcgctcggcctgatctcgtccgtgcttggcgtggcgttcggcagcctcatcatgtggggcatgtgcgccggcaacgtcatacggcagggcatgcggctcatcttctcctggcaggtgttcgtcgtgccgatcatcttcggcatcatcatgaccatgctcgcagccctcggctccgcacgttccgccacctcggtgaccccgctggaggccctgcgcccgatcgaactgactgacaccaagcgcgccggcatcgtacgcgccgttctcggcattctgatggtcgtcgcaggcattgcgatggcggtgttctcagtctggcgcattcaatccaccaacggcggacagacggctcaagccaacgaattcacaatggcggtgctgatcgccattgccggcgccgcgctcatattcctcggcatggtgctcaccgccgtcttctggctgcccgcactgatgaaaggcgccggaacgttggtgtcgcttgccgggccgtccgcgaaaatcgcgcacggcaacatacagaagaatccgcgacgcatcgcagctacaggcgcggccctgctcatcggcgtgaccttggtctccaccatcgccaccggagcggccagcgtcaaacaaaccatgaacaacacgctcgccacccgctacagcgtcgacgtcgtcgcctccggcgaagacctgacccaaggaatggcggacaaggtcgccggcatcaaaggtgtgaccgacactgtgtacgcgccggccgcatccgtgacattgaatggtacggacgctgccaaaccgaccaccgtgctgctcatcggtgtgaagaacatcgaccaggtcaagcatgtgatgcgcgtcgacctcggcgacaccagcctcagcgcggacgacgtgctcatgccctcatacaatgcgcagaccggcaagaaactcgccttcgccaacggcaaagccgagttcgacaccaccaggaataagaacggcgacatgacgcgtccgctgaccttgcatgtcacgcaacgcgactatcggcgcattttcgacagttacggcgccgtcggattcgtcgacgaacggcacttcgccaacggcgacctcgacaccacaacgcacatgctgctggtgaaagccgacaccgaccaatccggaacgtccgtgaacgacctgtacgacggcatccagtcggcattgtcgaagagcgcggacgcggcggtgtccggtccgatcgccgaacgtgtcacctgggcgcagatgatcgactccatgatgatgctcatggtggggctgatcgccgtggcggtgctggtcgccttgatcggcgtggcgaacacgctgtccctgtcggtgatcgaacgcacccgcgaatcggccaccctgcgcgccatcggcatgacccgcggccagctcagggcatcgctcgccatcgaagcgctgctcatctcgctcgtctccggcatcgccggcatcctgctcggcacattgttcggctggctgggcgcatacgtggtgttcagcctgtacggcaccgtggtgttccccttcgaatggggcgtcaacggcatcgtgctcgccgtggccgccgtggctgcgttgctcgccagcatcgcacctgcccgcagagcggtcaaagtaccgcctgttgaggcgctcgcagaagcttaggcgataaacggaatgctccttcgaaagaaggagcatttttgttgccgaatacgttttatgaagattttatacgagatggttttcgtaggcgaacacgacggcttggacgcggtcgcgcgcattgattttcgacaggatatgcgcgacatgcgttttcacggtaggcaggctgatgaacagcttgtccgcgatctcctgattcgacaggccatgcgcgatttcgatgagcacctcgcgctcgcggtcggtcagttcgtccaattccggatcggtgtacatagttgccgtcgaagcggaagcggacgttgcggaaacgggcgctgcggcggccgttcctgcgaaatcgccatccatcatcttctctataagccgtttcgtggcggatggcgcgatgatcgcgttgccttggtacacggtgcgaatcgaattgagcagcgtctccggttccgtgtccttcagcaggaagccggacgcgccggcgttgatcgcggccatcacgtattcgtccaaatcgaatgtcgtcagaatgatcacacgggtatgcgcatcgtcaagcgcgctgccatcgggtgcgaaacgatgctgcaacgcgctgatccgacgtgtcgcctcaatgccgtccataccgggcatacgcacatccatcagcaccacgtcgggatgcagcgtctccgccaaagccaccgcttccgcgccatcgcgcgcctggccgacaaccgccatatccggttgcgagccgatcaccatcgcgaaaccggcacgtaccaattcctgatcatcggcgatgaccacacgaatcttctgttcttcactcatactctccaccttatcggcatcgttccgctcacagcgcgaaacaaccccttaaatctccctgaaaaacttgaaccggctatcgagacgcgcgctgcagctgctcctccagcggtgctgcgggcctcaactgcagttcgctcgcgctaccggcatgagcgtcatcgctgaaaccagtctcacgaagcactccgagcagttcgcgcatacgcttaagcgcggcgcgcccctgttctccgatggctttgaacgctgcggaaatctcgtcggcagtaggctctttgccttgtgcttcggcagcgtccaacatgcggataccatcgacggcttgactaatcacgctgttcagcgtggcggtgacttcagcctgaatgctggcactgatacggtcgcgttccatattcgccgcgagaatacgctgcttctcctgctcggccaccagcgcttcctctcgcgcctgcaacaccagtgcgtttgaatcactggagcgagtccaacgcgcccatgccataatgccggcgcacagtatcaacaccgcaaccgtatacataacgccggtaaaaaacgccgcagtactgcttgacgtggctgaaaccggttttgtcaagcccacggaagcggcgatagcgtcgaacaaggtagcatatccatgttggtcggctgcgattttcaagcccatcagagctgaacaggtgacagcggcaagaccggtccaacgccatgcgtgttcacgcccatacaatacggctgaatacagtgcgcacagcgacgctacgatgtgcccgacctcaatcgatcccaaaaacaccaattgcacaaccgacaatacgaacacaataagcgcgcaagtctcggggaacctgcgtcgaagagccagcgccagcaagcagcatgcggcgatcgcatttgagagctgcgcatgaggtgaactatcaaaaaagaacgtaaccgacatgcgattcagcagcatgaccaatgccacggcaccaacggaatccatgagcgcataatggtgctgcgtccacgcggaaacgcgttccacccaattcagccctcgcgaattggatgtatttgcaagttctacggatttcagtttcaacgatttgagcaaatcatgcagattgggtgcggtgatgcgcaaatgttgcagggcattcgaacgatgatcgcgaccggtcggttggttggtttcctgcgtctgctccgatggctgatctgggattcgcgccgatatgttgacgactgtgtgaggtgcgattgcttcgtcggatagtttcgctttgctggatatggcagttgtgttgcaagattcggactgttccgaggcatactgttcgccggtttcttctgtcacctgttctttaccgccgtaaggcagggtggccatgacttcgaagcctccgccgagttgagggccagcctgcaacgagcctccggccgattcgatgcgttctttcatgcccagcaggccgtaacctggcgtatgcccgtcgatattggccgccgcgccatgaccattgtcggtgatggtcaaagtgagcaaaccgttgttccatgactctttaatatgtacatcgacgtgcggccccgcatacttgcggatattcgtcagcgcctcctgcactacatggtaggaagctatcgaggcttgttcgccgagttgttctgggctggcggtgccggtgatattccgtcggattcgaatgtcgggggagacgttttgcgcttgttccacaagattgccgatatcgttataatcggcgtgcggtgaacccccgaatactcccagaagacgttgcatgtcatgcagtgcgcgttccgattcgtgtcgaatcgtctccatggtgtttctggccaccgcgggatcatgcgtgcctgcatagcgaccgccatcagactgcacgatgatgattgacagggtgtgcgccaccacatcgtgcatgtcacgtgcgatgcgtgcgcgttccgctaacgcggcgatatcgcgttcattctggtctcgcgcggcgattgcctcattgcgttcccgcatcatgcaaacggttgccagacgggcacgctgccagaacgctacaatgacggtggaaataatgcatacttcgaaaatcggcgtcagtaccagcatgtattgcgccatcatgtcggcgacttccgacatggatgttcctgtgtagatggaaccgagagtgtctttcgtgaccataacgccatttggatttgggtcattccagctgctccatgtatgcactttgcctccggtgagcaatggtccattggtcatggtccatgccaccagcgccgaagccagaagaccgatgatcaacgccagaataatgaaggctttcgtgtttttgggattgccgtagatgatcaccgaatacagcatgaacaatgccagaatatcggcgcccaacaggcaagggccgaatatgagatgcgccaaggtcaatgccacgcagagcaacgctccggtctgcggccgccatcgacggatcagcagtggaataagcattgccgcttcccatgccatctgcgtggaaggcttaaggtcaaacagcaatcccggattataggtgatgccgccggtcacgccgaacagcagaacacctataacaagcgtgatgatgagatcgccggcgaaaacatggccatgcatccatgacaagagacgctgtttgaaattcgacatacgttccaccctagcgccagatatgctgtgacgccatcatgcgcaggaatgaaatagcggtaagataaagccgcttttgtgaggtaaggttgtctccgcatgtgggtgagatggaagccatcaaaaagtcactacccgaattgaacatgccgatgatgccaaagggaaggtgaatgcatgacgttgctgagcgaatactacgtgcccggattgcatattgaggatcgttccatcaaggtgccgttggattggacgggccacgagcctggtcatgggttcgatggcgaatcgatcagcctgttctaccgtgtggtcaccgctcccgaacatgtgcatgatgatcttccgctgctcgtgttcctgcagggtggtcccggtggttccggtccgcgtccgctcggtccaagttccgatggttggattgaggaggccatcaagcatttccgcgtggtgttgccggatcaacgtggtacggggcgttcgtcccgcgtcgatacgcatgtgattgagggcatggacggcgacggcaaggccggtgccgcgtttttgaagcgcttcctcgccgattcgatcgttcgtgacttcgagcatctgcgtcgtaccgaattcgggagcgcacgttgggtcacgcttggtcaaagctatggcggattcctgacgctgacgtatctttcgctgttcccgcaaggagtcatcgccagtttcaccacgggcggcattccgcatgttcccgccgatgcgaccgacgtgtaccgtcatacgttcccgcgcatggcggcaaagacgaagcagttctacgagcgttacccgatcgatatcgaacgcgccgcggccgtcgccgacattctgcagtcgcgcaaggtcgcattgccgaacggcgatccgctcacggtggaacgcttccaatgcttgggatccgatttcggcatgaagccaagtttcgaacgcgtgcattggattcttgaccaggcattcctcgacggcgacggttcggcctcaacctcggcggaactgtctgacgaattcctgtcttccgtgatgaatgcgacctcgtctcgcccgctgtattggccgttgcaggagttcatctacgccaacggtgagctggaaacgccgatttgctgggccgcccagcgcgtgcgctgcgagcatccggaattcgcgggtgacattcgtccgcttaatttcaccggcgaggccatgttcccgtggatgttcgagcaggaacgtgcgttgcgtccgttcaaaccagccatggacgtgcttatggaagacacgcatttcggcacgatctacgatgccgaccagttggcgcgcaatgaggttccgctgcaggctgccgtctatttcgacgacatgtacgtagattctggattgcagctcgacacgctgtcccgcgtcggtcgttcacattattggaccaccaacgaattcgagcatgacggcgtgcatggttccgtggtcttcaaacgcctgttcaacgaagcactgaacaggggagatctggaagaactgttctgacacagacaatccatccatatatcgatatcaaataggaaccgggaacaacaaggagaaaccatgtccaacccaaccatcggattcatcggatacggcaacatggcacaggccattgccgaaggacttgtcgcggcaggtgcaatcgacggtactgacatcgtggcgtgcgccgcgcattacgacaaactggagaaaaccacggcgaaggttggtgccacaccgctgcgcaccgctgccgaagtcgcagacgcggccgacgttgtcatcatcgccatcaaaccgtaccagatcgaaagcgtcatcaaaccaatcgccggcgcgctcgccaacgaaagcacattcgtcgtatccattgcggcaggctgggatctcgccaaataccgtgaactgttcggcgccgatttcggcgcgatgcacatccagtgcaccattccgaacacgccgatggccgtcggcaaaggcgtgctcgtcacggaaaccgacaacacgctgaccgacgcgcaaaacgagacgttcgaaaagctgttctcatcgatcagcctcatcgaacgcgtcgactccgcgcatatgggcatcggcatgtgcatcgccggctgcgcgcccgcattcaccgacatgtacatcgaggcgctcggcgacgcgggcgtgaaatacggtctgcaacgcgccaccgcctaccgtctggccgcaaagatggtggaaggcgtcggcgcactgtacctggccaacgaaacgcatccgggtgccatgaaggacgccgtctgctcgccgggaggcaccaccatcaagggcgtggcctcgttggaggaaagcgcgttccgtggtgccgtgatcaaagccgtcgacgccatcgaagcctaatactaaactaaggaaccatgtctcttactatcggaatcgtcggactgccgaacgtcggcaagtccaccatgttcaacgcattgacccgtaacaacgtactggcggaaaactatccgttcgccaccatcgaaccgaacaccggcatcgtgccattgccggatgaccgtctgccggtgcttgccaagctcgtgcacacggagaagatcgtgccggccaccgtcaccttcgtcgacatcgcaggcatcgtcaagggcgcttcggaaggcgaaggcttgggcaacaagttcctcgccaacattcgcgaagccgacgcgatctgcgaggttgtgcgtgccttcgaagacgatgatatcgtgcacgtcaacggcaaggtcgatccgtccgacgacattgaaaccatcaacaccgagctgatcctcgccgatctgcagaccatcgagaacgcgctgccgaagctggagaaggatctgcgcggcaagaagatcgagccggcctacatggacgccgtcaagcaggccaaggagatcctcgaagccggtgagaccatcgacaaggccgcccgcgaaggccgcttcgacaaggactccgtctacgacctgcacctgatgagcgccaagccgttcatctacgtgttcaacgtggacgattccgaactgcagaaccaggatctcaagaccaagctcgccgcctccgtggctccggctccggccatcttcctcaacgcgcaattcgaagccgacctgaccgaactcgacgaggacgacgcgcgcgaaatgctcgccgacgccggccttgaggaatccggcctcgaccagctggcacgcgtcggctacgacacgctcggcctgtccaccttcctcaccgcaggcgagaaggaagtgcgcgcatggcagatccacaagggctacaccgccccgcaggccgccggcgtgatccacaccgacttcgaaaagggcttcatcaaggccgatatcgtctcctatgacgatttcgttgccgccgaaggctccatgacgaagatcaaggaggaaggcaagctccgtcaggaaggccgcgactacgtcatgcaggacggcgacatcgtcgaattcaagttcaatgtatccaagggcaagtaaggttttcgtacttgtcgtatagtgcgtcaggcgctcggaccggtcggttcgggcgcttttcgcgtaaaagacttgtatatcgccgtttttcctgctaagggtggaaccatgagtacttcacgcgcggttcgtgacgcggccaacccgactatgacattgcatgactgtccgctgaacgcgcgcgttgtcgtggacggcatcgatttggacgatcggcatcggttccgcctgtgcgagatcggactggcgccgggcaccggtctgcgggtcgtgcagcggggcgcgttcggcggaagggtcatcgccttcggcaacgaacgcgtagcggtggatggtggtaccgcgcgcgccgtccgcgtacggtttgcgcaggactgggcagtacaggatagtgccgcgcaagacaagaccgcacggcatgaagagaacggaaacacgcacgaatgctgagtctacgaagcctaagaggtggtgattgctgccgtccacaggacgattgttgccggcattgcgattgccgtatgggaatgtccgcgaatgacggcacgcacggcaacgcccgcaatgatggaatcggcaacgacgaaatgaccagacgcgtcgtattcgtcggcaatccgaacgtcggcaaatcctccatgttcaacgcactgctcggcgcgagaacccgcacgatgaacgcgcccggcaccacggtgtccatcacctgcgggcaataccattacgaaaaaccgaaaacagcgggaaacgcgcaaaactggcagtttgtggacacccccggcacatattctctggcgccgatgagtcccgatgagcaggtcgccgtcaacgcgctgaccggcatgtcaggcatgcccgttcccgaccttgccgtcgtggtgctggacgccaccgcgctgtcccgatcgctgtacctgctgtcgatggtggtggagctcgggctgcccaccgtcgtggcactcaccatgaacgacctcgccgtccgcaacggctgcggcgtcgatgcggaacgactgtcccatttgctggacggcatgccggtcgtcgcgattgacggacgtaccggagacggcggcaaggctttggccgacgcgatcgccgcaagtttcgagggaacgcccgttccgcacgggctgaccgcactgccaaccgtgacagccgacgccgacatgaaaaccgccgacggcctgagcgtctgggccgaattgcgggccgacgcacgactcgattggaccgccggcatattgcgcggtctcgacatgcatgcggtcgaccacgtcaccttgtccgaccgcatcgaccgcgtgctgctgcaccccgtgattggcgtcctcgtcttccttgcggtgctgttcgtcgtgttccaggccaccaccacgctcgccagccccatgcaggattggatcgacgtgaccttccgcggatggtgcacagatggactcgacctgctgctcggcctgttcggaccatccgtgagcggcggctggctgcgttcgctgctggtggacggactgcttgacggcgtggtcaccgtgctgacgttcattccggtgatgggcatcatgttcctgctgctgtcaatcttggaggattccggctacatggcccgcgccgcgttcgtgatggaccgtgccatgcgcgccttgggattggacggtcgcgcgttcctgccgatcatcgtcggcttcggctgcaatctgccggctttggccgccacacgaaccctatccgattcccggcaacgggtgcttaccggcatgctggtgccgttcgcggcatgttccgcacgactatcggtgtttttggtgctcgcccacgcgttcttcccgaaatacgccggtctcgtggtcttcctcatgtacgtggcttcggtcatggtcatcctgctggtcggcgtgctgctgcgccacaccatgttccgcggcctcgaacccgaaccgttgatgctggcgcttcccgcataccaatgcccgcgcgcgttgcagctggcgcgttcggtactgctgcgtctatggggcttcatccgtggagccagcgtgatcatcatttcaatgatcacggcgctgtggctgctgcagggcattccggtaaccgccaacgcaggcggtttcgctcatgtcgacgacgtgcatgattccgcgtatggcgtgctcgccgacgcggtcgctcccgtgttcgcgccggccggtttcgacgactggcatgcctcggccgcgctgatcacgggattcgtggccaaagaggtcgtggtcggttcgatgtcgcagtcctaccatgcggacgaaccggatgatgcggcttcccaacaagccggggagggaacgctgggacagaagctgcgcgcctcgttcgaccagtcatcgcacggccacggcaaggcggcggccatcgccttcctgctgttcacgctcgcctacacgccatgtcttgcgacggtcgccgaaatgcgacggcagttcggcacgaaagtcgcggcgcgatccgtcctgctgagcttggccgtggcatacgtcatcgccatcatcgccttccaaacattgcggttgatatggtgagcggtatggaacggtccggcgcttccgcgcacggatggcggcgcacgccacgtacggctgatacatacggcgacggccggaacggtatcgtcgcacgcatcgccggcgacatcgccgcaggattgacggtgcggcaaatcgccgacaaacggcatctgccggtcgatttcgtggacatggctgtcgaacgcgcggacaaacgggggctgctggccgtgatggacatgcggcacgcctgcggagagacgatatgccagcccgatcctgcgtcattggtgtgcgcaggatgcccattcaggatattcccatcttcaagcccgtacaataggcaaggttaacaagacgaagaacgatgacagttatcggttcgcaaggggtgacacgtatggattatcagtaccagaccactgaacagccttccagcccccgcaaggcatggccgatcgtccttgccgtggtcgtggccctcatcgtggcatgcggtgccggcgtgtgcgtttaccgcaacaagcagcaggaagcattggccacatgccggcaatcgctcgcggaattcagctcggcccgcaaagccgtgctcgacacttccgaaaacggcagcgaactgcagaagctgattcgaggcgcgctcggcgtgaacgacatcatcgacgcgttcgcggacgcggccaccagcgccgagaacacagtcgatacggaaggctgcaaggcggaagccaccatcacgcagctcaatctcgtagccaaaacgttggacggcgccaccgattccctgaacgccagtctgaaaagcatccaagagaaaaacgccgaaaccgcgttgcaggatccgaaggccgattcggatggcgcggcagccggacaatcgtccaataacccatccgggcaatcgaacggagcctcttcgaacagcacttcttcgaacggcacctccgacacgaaatcgtcggatgaatccaaaaaggaactgcaacagtcgatcgacaaggcagacaaactggtcgacaaactcagcaaggacgattccctgaccctgaccggacgcaaactgctgtccgcgctgtccaaggccgcggactccggacagaagctcgtcgaaagcggcaacatcaaggattccaagtattacaaggcggccaaggtcacgcttgacgaagccattgacatggctgacaactgggtgaacagccaggcggccaaagcgcagtggcatgctcccgcgtgttgcttccgcagccacgtctaaagtttccttcggaaagcatgacgtgaatacgacgtcggatgtgtggaagcgtgtaaggggggggcggatggcagacgcggggcaggaatcatcggaaggcattagcgtatcgaagccggtcgcccgcgtgatgatgctggtcaacgcggcggtatggggatccggctacaccatgctcaagcatgtgcaggagaacatgccgacacagtggatgatgttcttccgcatggcttcggcggtactgcttatggccatcgtgtttttcccacgtcttcgcaggattcgcctgcgccgctatatcgttcccggtctgatactcgcgttgacttactggctgggattcatcttccagctcaaaggacttgaaaccacgtctcccggacgcaacagcttcttcaccgacacctattgcgtgatggtgccgttcgtggtgtgggcgttcacgcgcaaacgccccagctggcagcatctggtggccgcgttcgtctgcgcgttcggcattggtctggtgtcgctgagcggcggcggtggcgcggaactcatgcatatgagcttcggtgacgccatgactatcatcggcgcgtttttcttcgcgttgaatctggttttggttggtttcatcggcaaggatttcgacgcgatcgcgctgatgcttgccgaattcgtgtggtgcgccctgctgttcggcgctggcgcggtgcttaccgaaggcggaccgtccatggcttgggcgcggtgggacatcgtgctgtgcatcgcctacctggtggtcggctccacggtgatcgcccaagtgtttcaaaccatcgccatacagaatctgcccacttccgaggcgtccgtgatcttaagcacggaatgcatcttcgccatgctggtatccgtgattttcaccggcgaaacgctgaccgtgccgtcgttatgcggtttcgcgctgattttcggtgcgattctgctgtccgaaatccaactgccctccgcaaaacgacagcgtggcacaacggaaggcgattagaagaacagcgccgcgattcccgccgcgaagcacatgagcagcacggacgtgaggaagctcgccaggaacgccttctgtcccttcttcgcgatggcgctgaaattcacattgatgccgagcgccgccatggccatgccgagcacgatgtaggcgaagtccaccagattcggtgcgatggcgtcgatgaacggcacgaacgtgccgatgatggaagcgccgatgaaaccgagcatgaaccacgggaacgacactttgcgtttgccgtcggccggcatttcggaatggtttctgtcccaccagatggcgatgatgatggccgcgaacaccagcatcagcacgcgggaaagcttcatgatggtggcgatgcccaccgcgccgaacgcgtcgccggcggccacggcatgggcgatttcgtgcagggacgcgccagcggtgatgcccaactgcgtcttgctcaggcccgtcaacggcccaagggcgatttccagcaatgcgaagatggtgcccatgatggcgatgatggccacggccatcacctcattgttggccttctcatcctctttttccggcggcaccttgatggagccggacaatcccatgacggctgccgcgccacagatgccggtaccgcccgccacgagaatggcgagctgcggatcgacgccaagcttgcgtgcgatgttgtagcacaccacgatggtgagcgtcaccaccactgccgcgatcggcagacacttgataccctgcgtgaacagcaccgtcagattgagcttgaagccaagcaggatgatgcccaggcgaagcagcttgttcgaaatgagcccggccgcatccttcacaccggccttatgttcggcggaacggctcgaataccatttgcggatcgggaactgcgcgaccatgccgatgagcagagcgatgatcaacgcgccgaacaggctgaatcccggaaactgcttgagccacgaagccaccagagaggccgccaacgtgacgatgccaatgaacgccatttccttggtggctatgcgagtccaccatttcttgcaaaaatcaatcacgagcgtcaagtgttccggttcatgcggacaagccggccggatggggagacgcgcgcgggaatccatattttgcaacatatctcgaacgggtttgaggtctgtttgcttcaagtcgggtttaagttggtacgctggagatgcaagccaaaaacacaggcagaatcaaggagggtcaagatgcaattcgaagcctcgcgactggaaggactggaacaccgcaccgacgcgcagtccgcaccggaagtgttcttcacgccgatcatcacaccggaaagcctcgtcgccgcctaccatgcgctcggacgcaagccggaaggcaaaacggccatcaaagtccattccggcgaatcggaaaaatccaataatctcaatccttcgctcgtcaaggacctcgtgcaggagatcggcggcacgctcgtggaatgctctaccgcatacgacggcaatcgtgaaacccccgaaaaaagccttgccacgttcaaaaagcacggatacgccgatcttgcgccaatccagatcatggacatgggcggtgaaatcgagatcccggtggccaagcaccgccacatcgcctacgacatcgtcggcaagcatatcgacgactacgattccattttcgtgctgtcgcatttcaaaggccatccgatgggaggcttcggcggcgcgctcaaaaacgtgtccatcggcatagcctcgtcgaacggcaaacgctggatccattccgccggcgtcaccaaggacaagtgggtggaaactcctcaggatgcattcctcgaatcgatggccgaagccgatgaggccgtgatcagccacatgcatggcaagatgatgtatctgaacgtcatgaaccgcctgtcggtggattgcgactgcctgccctccccgacggaaccggacatgcatgacatcggcgtgctgtcctcgctcgacccggtggcactcgaccaggtatgcgtcgacctcatccacaccgaccccgacggagcgtccgtcaccgaacgcatcgcctcgctccacggcgaacacatcctcgaatacgccgaggaacttggcatcggttcgcgcgcgtaccgtctgaccgtactcgactgacggcgaacgcaatggtcacgaaacccgcgaagcctacggaagccagcatcgcaatcgcacgtatcgaaacgttgcttgccgaacgcgattgtgtgttcgtcgcaatcgacgggccatgcgcatccggcaaaaccacgtttgccgcgatgctcaacaggcgtttcggcggcaacgtgctgcacatggacgatttcttcctccgtcccgaacagcgcacgccggaacgtttcgccgaacccggcggcaacgtggaccgtgaacggttcgaaacggaagtgttggcaccgctcgccgccggacaagccgcgcaataccggccatgggattgccatacaggcgatttcgccgtcgcgtacgccgtcgaaccggcccagctgaccattgtggaaggcagctacagcatgcaccccgccttgcgggggtattacgattgcatgatctgtcttgcggtcgatcctgccgaacagttgcgtcggctcgaacgacgcaatccacgcatgttgcaacgattcgtcgacgagtggattccgttggaaaaccgctatttcgaagcgaccaatatccaagccgtcgccgatttgctggtcgacaccgcgctgtcggacggtgggtcggtcgtcgagccggccaatacgtgacatatccgcatatccggaagaaaagaacaaaaatcaaggagaatacaaaatgtctgattccgcaaccatgcccgcggccgccctgcgccgcaccgacctgccgaaactgagtctcggcaccaagacagcagccaccctgctcgccatcgtcgcagcggtcgtgctgccgcaactgttccacgtcatcggcgccgtctccggacagggaaccatgttgggcgtcgcgttcctgccgatgcatctgccgatcatcttcgtcggcctgatcgcgggccccgccgtcggcgcgatcgccggcgccgccgctccgctcgtgagcttcctgctgtccggcatgccgatgctggcgatgctgccgctcatgatggtcgaactgtgcgcatacggcctggtggccggtctgctgcgcggcatcaagctgccgagcctggcgaaggtggtcatcgcacagctcgccggacgtgtggtgctgaccgcagccaccgcgatcgccgtgttcgcgttcggttccagcaaggccatcgccgccacatggacgagcgacctggccgccggcctgcccggtctcgcgctgcagtgggccctgattccgctcgccgcctactggaccgagtcgctgatcgccaagcgcaaccactgatatgacgtttgcccggccacgttctgggcaaacgcgtgatatgcgggagccgagccgttaagcttggctcccgttacttataggaggactacgtaggagttttacgaaggggaagcagtcatgatcgcaggagtgtccatcaccactttgctgctggtgctcgcagccggcatcggggcgggattcgtcggatacgcggtaggcgcgtcctcgctgatctcctatcctgcgctgctggcgttcggcattccgcccgtgctgtccaacaccacgaacacggtgggcgtatgtggcaccggcattggcggcctgctctccgcccgcaaggagctcaaaggccaaggcagacgcgtggccgtctacgcctgcatcggcctggtcggcggcatcatcggcggcctgctgctgctcgaactgccggcgaaggtcttcgaattcgccgtgccgccgctcatcctgttcagcgcgcttatcatcgcgctcaacccacgtaagaaagccgccgcgcgcgacgccgtggcgcaggcgctgccgcaatcgcatcaaggtgagcgggccgcacgaatcgccagcaaaacggcggacggcacattgcgcaacgatccatggtggctgtgggcgggcgtgagtttcgtcggcgtgtattccggctatttcggcgccgccgccggcacgctcgccctggccatcctcgacttgggcaaaatcggcccgttccaccagatcaacgcgttgaaaaccgtggtcggtttcggcgcgaacatctccgccgcgatcatgttcatcatccgcggttccgtcgattggccgttcgccatcatgatgtgcctcggctgcaccatcggcagcgcgatcgcaccgcccgtcacccggcatattccggagaacatcatgcgtgccgccgccgtgctgaccggcatcatcctcgccgcgaaactcggctggagcacctacttctaaattttctaaaataagatgtgcggattgccggaatctaagcgacagggggagaaacatggcggttgttgacgaggcgaaactgcggtatctcgactttctttcgcgtgaggaccgagtacgccaccaccggtacgtcgaggaaatgaagcaatacgacatgatgcgttccggcgacatcaacgccatcgccgaaagcacacgtctgtggaactccggactgtacggctacctgtcggacgatccgctcaaaaacgcgaaataccggttcgtcaccaccatcacgctcgccacacgtttcgccatcgaaggcggtatggacgaggaggacgcctacaacgcctccgacctgtacatccagaacctggaaaactgcaaaacgcccgacgacgtgcgccgcctgcacaccgacatgatgacattcttcacatgggccatggccgacatgcagaaggcggaaacacattccaaagccgtcaacgaatgcctggactacatccactaccatctgcatgagaaaatcaccgtgcccatcctcgccgagcatgtgcatctgaatcccacgtatctgtcggagctgttcaaacgcgaaacgggcacggccatatcgcaatacatcaccgacaagcgtatggaagcggccgagaacatgctcaaatactcggaatacagcttcgacgagatcgcccagatcctcgcataccggtcgcaaagccacttctcgaaggtgttcaaaaaacattccggcatgacgccgggggagtaccgcaccaagtacgcgcagaacggcatctggccggagtgattgcgatcacggcgtctaccacgccggttgcggtgaaccgccggtgacggcaccgcgaaattcgggtgtgccaatcgtgaaatcgacgtgtccgcgcgtgcgaaacacgcgcgaatcagctacggtggaagcattcaatgatgatgcgcgccaccggccgaatgaacggcggaacaaggaacgtgcgcgcaggatgtggatgaaagcgaaggaataaacggatatgggaatgccccttgatttgtatgtgattcgacatggcgaatccgaagcgaacgtgattatcagtgccggtgaacagggtgacaactcgctgtatacgcaggacaacgtcaccgtgcccgaccgttcgtggaggcttacggccaccggccgcaagcaggcggactgcatcggccgctggctggtctcacagcagccgttgttcgaccgctacctcgtttcgccgtacgtgcgcacgcgtgagacggctgccacgatggccctgcctaaggcgaaatgggaggagacacgcgtgctgcgcgaacgctcctggggtgagatcaataccatcacgaaagacgatttcaaaaccaattacgcgcgcaactggatgttcaagaacactgatccactgtattggcgtccgccggcgggcgaatcgatcgccgatgtggccgaaaaccgcgtgcataatctgctcacatccctgaaccgcaagtcggacgcagaatccgtggtgatggtcagtcacggcgacctcatgctggcgcttatgctcactttggaggacttgtccgacgaggaattcatgcaccgtgcggcgtccgacgaatggaagatcactaattgtacgtgcttccattattcgcgccgtgatccggcgaccgggcgtacgcataagcggttctgttgggagcagaccgcccgcccggtgttcgacgatgcggaaggtcgttgggcggtgaaagtggacgattggcgtgaattcaagcgtccagtgctgtcgaatggcgatttggtggacgttgttcatgcggttgaccgtcacttgtgatgtgtgttggtctgttgattgcatgatcggattggctgatatcgacgattgatgcccccatctcgcgtgcgcaacgcgcccgtgtccacgccccactacaatggctgtgacacgcggcgcgtttttgcttgccgcgcaagagagttaaggagacaatcgtatgtccaatctgttcacgtggaagctccacggcgacggcaaaacgctgaagcccggcgaggtcgtcgaacctgacgagaggctgacctggccgcgcaccgcggaaatcggcgcgcagcacgtcatcgccatgttcggcgccacgttcctggtgccgattctgaccggtttcgacccatccaccaccctgttcttcacggccatgtcgaccgcgctgttcctgctgatcaacaagaacatgctgccgagctacctgggctcgtccttcggcttcatcgccccgatcgcggccgtcgccagcgcccacaagggcctcgccgtcgcatccttcggcatcatggtcaccggcatcctgctggccctgatcggtgtgctcgtccattacgcgggcgccaagtggatcgacatcatcatgccgccggtcgtcaacggcgccatcgtggccatcatcggcttcaacctggctccgagcgtgtggaacaacttcaaagtcgctcccgacaccgccatcgtcaccctcgtcgcggtgctgctcgtcgcagtgctgttcaagggtctgctcggccgactcaacatcctcatcggcgtgatcatcggctacgcgtacgcctgcttccgtggccaggtcgacttctcagccatcggcaaggccgcatgggtcggtctgccggaattccgtctgccgcaggtcgacttcaccatcctgccgatgttcatcccggtcgtgctcgtactcgttgccgaaaacgtcggccacgtcaagtccgtctcccagatgaccggccgcgactatgacgaccagatcggcaccgcgctgttcgccgacggtctcggcaccaccatcgccggtttcggcggcggctccggcaccaccacctacggcgagaacatcggcgtgatggccgccaccaaggtctactcgaccgccgcatactggtgcgccgccgcgttcgcgctgatcctgagcctgtgcccgaagttcggcgccatcatcaacaccatccccgccggcgtgctcggcggcgtgaccaccctgctgtacggcatgatcggcatggtcggcatccgcatctgggttgagaacaaggtcaacttcgacaagccggtcaacgtcatggtggccgccatcaccatgatcatcgccgtcggccagttcgagttcgccttcaacggcatctccttcaacggcatcgccatcggcaccgtcgtcatcctcgtcgcctaccacggcctgaaggccatcggcaaggcgaccggcaccatcgccaaggacgatccggacatcctgtaacggatcgcatctcacgctggctagttcaacgcccgtcggccaaaaaggtcggcgggcgtttttcattgccgttttcgtcaatcgattgacgtgttgcgtcgcatacgttttatgatggtatctgtaagcgattgcgcaatgtggcaaaggaggcaacatgagcactgcggcaggaaagaaaatcgcgattgtgaccggttccgcgcttggcttgggatatgagctggcacgtcagctgatcggcaaaggctggttcgtggccggcatcgatttcaacacggcccgtcaggaggaactgtcccgcacgttcggcgcggacgaataccgcgccttcgtcggcgacatcagcgacgaggcgttcgtgaaggactccgtcgcggccatcaaggagatcggccacatcgacctgctcatcaacaacgcgggacagccgtcgttcaaaaagccggtcgactacgaggccgccgacgtggacaagtgccttaaggggctcaaaggcatgattctgtggagcgtcgaaacattgaaggccgacggcgagcaggacctcaaaatcgccaatgtcatgtccaccgccgccacacgcggcaacgccaacgaatccgtctactgcgccaccaagtggggtgagaaggggtatacgacaagcctcaaggcggcctacaagggaaccagtgtgaaggttgtgggcgtgtatccgggaggcatcgacaccgacttctaccatgacagccacgattacgtgtcgttggacaagcagcattccttcatgagcgccgcggaactggccgaagtagtgctattcaacctcgtcaacgacgcgaatctgacggtttccgacatcctcatcgaacgcaactaccggtagcgtcggccaccagtcacagccaaggcaaaagtatcgggcatgggctactgttaacaggtttgcgcaacgtgcgcaatgtttgacatgaaaggccattgtgcccgataccgctgtgattgaaaatgaagatgccctcgccgccgatttcgatgaggcgggcgaggaggaggaacgcccccagacgttcgccgaactcggcgttcccggcccgttggtacgcgtgctcgcggccgatggcaagaaaaccgctttcccgatccaggccgacacccttcccgattccctggccggtcgtgacattctcggccgaggccgtaccggctccggcaagaccctggcgttctcgattccgctggtcgcgcgactgggtgaggtcgacgccgacgagtacgagaacatgagccagttccgccatgaggtggaacaggtgcgcaaggggcatgccgaggagcggcgcgccgacgatttcctgccgcacccgcgcggcctggtgctcgctccgacccgtgagctggccaaccagatcaacgacgtgctgatgccgctcgcgcagatgtacggcatgaccaccaccaccgtgtatggcggtgtgcgctacgcccgccagattcgcgatctaagggctggcgccgatatcgtcgtcgcatgcccgggccgtcttgaggacctgctcgaacagcatgcgctgaccttggagaaggtcgaagtggccgtgatcgacgaagccgacgaaatggccgacatgggcttcctgccgccggtcaagcgcctgctcggccaagtgtcgttcgacgcgcaggtcatgctgttctccgccaccctcgaccatggcgtcgacgaggtggtgaacacgttcctcaccgatccgaagatccacagcgtcgactccgccaccgcggccgtcgacgaaatgacacaccacgtgttcgaaaccacgcagggcgaccgtcatgagctggtccgcaccctcgcttccggcaagggacgccgcatcctgttcacccgcaccaaattccagacccagaagctcgccaaggacctgacgaagaacggcattccggcggccgagctgcacggcaacctgagccagaaccagcgtgaccgcaatctcgcagccttcgaatccggcgacgtgaacgtcatggtcgccaccgatgtggccgcccgcggcatcgacgtgtccggcgtggagctcgtggtgcaggtggagcctccggaggacccgaaatcgttccttcaccgctccggacgtaccgcgcgagccggccattccggtgatgtggtgaccatcgttctgccgaaccagcgccgccgcacccgccgcatgctgcatgaggccggactgaaggtcaagccgatcgaagtgacccacgattccccggaagtgttggaattggtgggcgagtcggccgaaccgcgtttcggttggacgcttgagcagtcccagccggcgggcaatccgcgtcgcaggcatggcaagggcggcgacggtttcgcggaaaacggtggacgctccggacgcaaccgttccggtggacgcaacaaggaccggggcaaggacaagggcggcaagccgttcaagtccgaacgcaaggaccgcgcgaatcgcaagggacgtgaagagcgcgccgaagtcgccgaacgcgagcagcgtttcgaaccgaaacagaatcgcgccgaacgtcgcgccgccaagttcgaaggccgcgacaaccgcgaatacgaggcacgcgagcatcgttgggaacatcctgaaatccaagaggagaagcgcgagaagcacgaggagaagcgcaacaacaagcgtcgcgaaaagtacgcgcggctgcatgagcagcagcgtgccgaagccggcgaacagcgtggaaccgacaatcgcaagcggcgctccgtcgagcgttccgatcagcgtggccaatccgataggaagcccggcaaaaagcagtatgcgaaaaagcagggcgcgccgaccaagaagcagcgcaaggccgaagcccgtgccgaacgccgttacgaggacgatcgccaataccgcaggaaccgcgacgaacgcgacgaccgccgtcagggcggcaaacgcatccatcgcaaggaaatccgcgtgattcatgacgagcgtggcgaggacgcgaagcgttatgaccgtcgcatggaagccaagtatggcgattccggtcgtcgtggcggtcacggagaacgccacgacaagcatgcgggcgaaaggcagggcaagccgtaccgcaagcatgcgaagatccgcaaggcgccgttccgctcccgctgacgtacgtcaacggtcaagcaaaaagccgttcattccagcaatcgcaaggaatgaacggctttttctatacgggatatcgcagtatcagccgttgaccggctgatactggtcgagcgcggtgaagcaacgtttatagaccatcagcatgatgatgctgtccgccagcagcgtaagcgccgcgatggtggcgagaatcatgaactggtatttcgccgcgtcgatggggttgccgccggcgatgatctgaccggccatcatgcccggcaccgccacaatgccggcggaggcgagcgacgcggtggtgggcagcaatcccagacggatcgacgagacgatacttggacgtgccgcctcccacgtggtggcacccaacgccagcagcgtgtccacttcgtcacgacgttccttcatgctttcaaagaaccggctcaaccccaccgccaacgccgaaacggtgttgcccagcagcatgccggtcaacggcaccaccaattgcggcgcataccacggttgcggacggatgatgagttcggtgaccaacgagatcatgatgagcatggtcacgaccagactcaggaacaccggtccagccaagcccttcggcacacctttcgcacgcgaaagagtgatctgcacggccgcgatgagcatgaacgccacaagcagcagcaccagccacggattgttcgaacggatgacgtactccatgatgaagcccatcgcgcacaattgcagcagcgcacggcaagccgaccacagaagcgtgcgccccacgcccatacgcatggtttcggagatgccggcggcgatggccaccatcaccagcgcggcgatgagaccccagatgtcgatcgcatagtagttgccgttcatgcgacgctcccttctaccgtgttacccgtcgaagtactacccgtcgcagtaccgtccgcttcggcgttgccggactgcgtgagcgtgccatcggcaagacgcatgacacgtgtggcacggccatccggcggccggtgccggatacgaacgatcgccatgccgtccgccgccgctttggcgaggatgcgcgccactttctcggcgttgtcgtcatccaatccggcgtccacttcgtcggcgagcagcaccttcggacaggtcagcaacgtacgcgcaaggctcacgcgcgccgcctgaccgccggacaagtcgtgcggcggacggttcagatcgatgtcggcacagcccatattgtccaaggtttcacggattctgccgtccggcaacgcatcggtgggggagattctgcgcggcccctgcttcgttctcgccgactggcgtatggcaagcgtgaacggcagacgaatcgcctgcgccaccgtctcgcccaacagcaccggcttctgcggcaggtacgcgacctgcgcgcgccactgctgcggggtgaaatcgtcggcggaacggccatccaaccgtaaatcgcctgacgcgcgcggattgagccgtgcgaaagcggtcagcagcgagctcttgcctgcgccggacggtccgaccaagtccacgatttcgccaggctcgatggcgaaggacaatccggagaatatggtgcggcgttcgccgtcgaccataatcgaacagcgcacgttcgatgcttcgaatacgtatgtcatagccaaaaccatacgccaatagcgaacggttcacggcggtttcagggttttccctgagttttgaggcgaaatcagccataaggatgacgcgtgcccgttattttgcgtactacaactgtcaagttgaaggaaaacctatatgttggggatgggaaagatgcgtcagtggcttatgaacataagcctggtcggaggctggtttccggcggcggcgttcgccgtcgtcgcagtgctgtccgtaaccctgctggttagcgcggccgtttcgaaacgggacggacgcatactggctaccgtgctgccgatcggcgttgcggccgtgtccggaatgatcggctatgtggtagcttggctgctgtccgacgtgttcgtggtgttcggcgtcggattgggatcccgtgtgatggcttgggtggcggctggtttcgccatcgctggtttcgccatcgcgcatatcgtgttgagcaggggcatgatgcgcgtggccgcggccatcttgaccgtattcgcgatactggccgcggcgatcggtatcgaccaatcgtacggcgaatacgccaccatcggctcgctgttcggcgaggattcctacagccaagccgatctgaccggactggccaaacgcaaggacctcatcaccgtcgcacagtggcgcaaacaggccgccaacggcacaatccgcaatattccggcgaacggaaccgtcaacaaaatcgacattccggccacgaaatcgcagtttgaagcacgcaaagccctcgtctacctgcctccggcggcattggccgactcgaaacgcaagccggccctgccggtcgtcctcatgctgagcgggcagccgggcagtccgggacgcgtcttccaagccggcggcatccaaaccatgatggacggatatgcgaaaacccacgacggactcgccccaatcgtcatcgcagccgatcagcttggcgccgattcgcacaacacgctatgcgtggattcgaaggtgtacggcaatgcgctgacctacctgacgcaggacgtggtcgactgggtgaaaaccaacctgcccgccgcacaggatgccaaggattgggccatcgccggattctcgcaaggcgccacatgttcgctgcagatcggcgtgaaccatcccgacctgtttggcaccatgattcccaccgacagcgaaatcaaaccgaccaacggcagccgacaggaaatgatcgaccggttcttcgacggcgacaccacagcctatgagaaccaagtgccggtcaacgccatccgcaaccacgcgcccacccatcagatgctcatcataggcgcgggggagaaggacaccacctcaatacgcaacgtcaaaacaatcgcgccggtcgcggcgaaagccggcatgcgcgtcgccgccgtcgaatcgtccggcaacgcacacgactggcacgccgtgcaggacgtgctgcgttacgggctcgccgtattcggccacgacaccggactggatggtgcgaacccgaacctatccgactatccgaatctcaaacgcatcacgatatgacgattctgaacacaaacccgcaagcctgagaatcccagaaaaggaaagaaatgactcaaacgcaaaccgcacctgctaaaccagccgaggcatcacccgcgaaaccactgttcggcttccgcgcgctgctcgccgatctggccggatggatcagacgacacctgctcaccgtctgcctcgtgctgttcgtcatcctcatcaacgtgggcacgcagatcgtgtgcgcgctcatacgtcagccgttcccgccgagcctggccaaagtaagtttcgaagcgctcgcacgcggccgctggtacaccgcgccgatatccatgctgtacgtgccgaatctgggccgtctgctcatcgacgttccgctcatgctggttgcgttcggcctggccgaatcggtgatcggcaaaatcaaaaccgcatgggtgtccgtcatcaccacactgggtggcgtggccttgggcatgggactgtgctccctatccgacgggcgcagcccccaatggcatgcgatctcgcatgatggcgccatccttggtccgctgattctcgtcgccggcacccttatgtgcgccagcgcgttcacaaccatgctgtggcgccgccgtatccgcgtgatcggctatgcggtcgtgctcatcatgttcctctaccgaggcgaggtgagcgactactgcctgcttgccgcttcggtgattggccacgtgctcggctatctgatggcctcccgcacacatggcgacgaataccggcatggcgccatctacgaaacgcgtcggcttatcggcatcgtcgcgggcgtgcaggccatcggctcgctcgtcgccgtctcgtcacgccaatcgttcggcctgctgtccatgttcggactgttgaccggctccaccgacttcgacaccggacgtgtggtcgactgcctcagcggcgcctcgcatacggactgcttcacgcaataccgcatgatgcgtttcaccatgcccggcaactggctggtatccatcacgccgacgctgatgctgctgctcatcgcctggggtctgtatcgaggccgtcatctcgcagccacgctcagcatcgtgttcaacgcatgcaccattgccctatcgacggtgttctatgtggctattccgctgtcctacgtggacggctccgacgccggtgcatacatggatgcgatatccgcattgcaacggcacggcgcattccacgcgatgctggccacgatggcgttgccgctgctgtgcatcgtcatcatcatcctgttccgcgcatgtttcaccattcgcacgaaaagcgagaccgtgctgcgcggtatcgccatcacgttcgccgcattcgtattactgggattgctgtacgtcggctacggcctgtccatgccgtccggcttcaacgaaacgccgctgctggtcgatctgatcgcagactacgtgcagcgtttgctgccgattggcctgctaagtggcgtggaaccggcgttcgtgccggtcggactgctttccgaaatcgtctaccagtgcgtcggaccgatgttttggctggtcgcgctgtgctgcacatgggatggcctgcgtgaccgttccatgatcaacgacgcgtaccgccaccgcgtggacgagatcatcggactcggcggcgaatccatgtcgttcatggccacttggaaaggcaacgattactggttctccgccaccggccgttccgccatcgcctaccgcgtgtcgtatggcatcgcattgaccgtcaccggacctttcggcgaccccgacgaatatgaggacgatctgcgtgcgttcgccggcttctgtacccaacgttccctgacgccggtgttctacagcgtgcacgccgaacaacgtgacgagttggtctccgccggttggaacgcgctcgacgtcggcaccgaaatggtgatcgacccggccgcatggcagacgcgcggcaagaaatggcaggacgtgcgcaccgccatcaacaaagccaagcgcgacggcatcaccgacgtgctcgccacattcaaggaatcgccgttctccgtgcagacgcagatccgtgagatctccacgcaatgggccggtgagaaggccctgcctgaaatgggcttcaccctgggtggcgtggacgagctggtcgatccacgcgtcaaactgctgtacgcggtggacacggacggtaaggtgctgggcgtcaccagctggctgccgacctatgagaacggcaaagtggtcggatggacgctcgacttcatgcgtcaccgtaccgacagcgtcaacggcatcatggaattcctcatcgcccgcatggccgaacggctgcgcgacgaaggcgaagtgcgattcatgagcctgtccgcggcgccacttgccggcatgagcggcgaaggccacgaacagggggagagcgccgtactcgaccacgtgctgcagatggtggccgacatcatggaaccggcttacggattccactccctgttccgcttcaaactcaagttccatccggatgaagccaaagtgtacatctgctatccggatccggcgaaactgccgcagatctcgcttgccgtcgcgcaggcctacgtgccgtcgctcaccccagccgaagccatgcgattcgtacgcaccatcgtgcctacgaaaacgaactgaaaccatgtgattggttgacggcccgtcatccctgagatgggccgtcgctttgggtgcgctcggggctacactggggaaggttcataaaaagtactacgtttctccatgaaagggaacagtatgtcagctgaagcaaacgtcggcgtcgtcggtctggctgccatgggcggcagcctcgcacgcaatctcgctcaccacggcaacaaggtggccgtgttcaaccgcacctacgcccgtaccgaaaagctcatgaacgagcatggcggcgaaggcgagttctatccggcgaagacgcttgaggaattcgtggacagcctcgtcaagccgcgcaccgccatcatcatggtcaaggccggtgagccgaccgacgccatgatcaacgcgctcgccgacctgatggagccgggtgacatcatcgtcgacgccggcaacgcctacttcccggacatcatccgccgcgagaaggaaatcagcgcccgcggcctgcacttcgtcggctgcggcgtgtccggtggcgaggaaggcgccctgcttggtccgtccatgatgccgggtggttccgaggaatcctggaagaccctgaagccgattttcgaatccatcgcggccaaggccgaaggcgaaccgtgcgtcacccacatcggactcaacggtgccggccacttcgtcaagatggtgcacaacggcatcgaatactccgacatgcagctcatcgccgaaagctacgacctcatgcgccgcggcctgggcatgaccccggccgagatcggcgacgtgttcgaggagtggaacaagaccgaactcgactcctacctcattgaaatcaccgccgaagtgctgcaccaggtcgacaagaagaccggcaagccgctcgtcgacctcatcgtcgaccacgccggcatgaagggcaccggcacctggaccgtgcagaccgcactgtccctcgccgtgccggtcaccggcatcgccgaagccgtgttcgcccgcggcctgtcctccgaagccgacctgcgtgaggaagcccagaagcagggcttcgccggccccgacggcaagctcaacctgaacgacgacgagaagaaggccttcatcgaagacatccgccaggccctctacgcttccaagatcgtcgcctacgcacagggcttcaacgagatcaccaccgccgccaaggaatacggctgggacatcgacctcgccgccgtggcacgcatctggcgtggcggctgcatcatccgcgcgaagttcctcaaccgcatttccgaagcgttcgaatccggcgaggccaacgtgtcactgctgttcgccccgtacttcaagaacgccatcgaaaacgccgagaagtcctggcgcaacgtggtcgcccaggccgccatcaacggtctgccgaccccggcgttcgcctcgtcgctgtcctacttcgacggcctgcgttccaagcgtctgccggccgccctcatccagggccagcgcgactacttcggcgcccacacctaccagcgcgtggaccagccgggcgcgttccacaccctgtgggccgagccgggccgcgaagagatcgaagcctgatcttttccttgcctccgtgtcagggcggatatgccagaggtcttgcgatgtgttccattgcaagacctctggcatatgcatattactgagctgcgatattgccgtaccgttgcattgacggagcatagtgtcgctccgtaagcagaacgaatggtacttgtggttgtgatgcatcccatttgcgtttctaggggagtctaatgccatcgtctaacctcctttcgagaggttttcggaagctatggggcgaaataggcggcggattgggattccgtaggtggtttttgcgttccataggtggttggtcttgggagcctgctgcggaaaaggccggaaaccggccttttccatgaccccgatacttggggcaaccgcctacggaaacgcgaaaccgcctacgaagctgcagtccagcgggaacctgcgtcaaaacgacactcaacaatcaatcaacactcaaaaaaaaggggtgtctcacggcatgagtcgcgggacacccctgttacctgtttcggatgaacctcacaacttggaagcggcaccctcgtcaatgagccagagcagttcctcgccatcggcgtaggagcttggggcatgcgggttgttgcgctgggcgaaggcggccttgaccgcgctggccttacgctcttcggaggtgaacacccacgtatgcttcgaccgggcgatcatcggcacggtcaatgtcaggcgcagcggcggcggtttcggcgaatcgcgcacgcctgcgaccagcacgtgcgggtcgtcgatctcggcctcgccgtggtcggggaacagggacgcgaaatgcgcgtccggccccatgccgaacatcgcgatatccaatgccggattctcgcccaactgctcgatgagctcgcgctggtactccgcggcggcctcggccagcaccgcatcggtctgttcgggggaggcggcggcgatctcctcggcgccgcgggtatcggccggcatcgcatggatattcgccgccggcatgcgcccgctttccacaagcgcaccgtaccaggcctcgcgagcctgcttcgcgttgcggtcgtcgtcatcggccgccacgaagcgctcgtcgccccaccacatgtgcacacggctccagtccacggcatcgttcagcgggctggcgttcatcgcggcgaacacacggttgccgtcggtgccgccggtcacggcgatatccacacgtttacgattcggctcggccagcagatcgatgatggtcagcagcgtgcgcgcggccacagcctccgccagtacctgcggattggggtatacgacggttttacgttctgtcacgttcactccttgtattatggttcgacgcttggtggctactgcctgggcttgacgagatccagtccttgcgagacgacctcgctgtagatctcatcggggtagaggcggccaagctcctcgctcaggcattcctcaagcgtgcgcgcgggcacgctgatggtctgcggcgactggccgggcacactgatcacggcgaacccgtcgtcggtggaggggcgctccaggctcagcacgccgtcgccgcgcgtcaggtacacgccggtgacggccgtggcgttcggatcctcctcgatcatcaccggcacgttcaggcgcagtcgcagccatgcggccagcagatccaacggcagataatccttctgcccggtcacgcgcacattgctcaccggcaggtgcggcggctggtcgagcatcgaggcgatcatcgcacgccatacggtcaggcgtgtccacgacatgtccacgtccttggcggagcggttgcggcgcagatcgtccatcgtgcgccgcgggttcgaggagtgcatcgcgtcggtgatgcggctgctggccatggagccgagcaggtccttcgacagattcgcgggcgcctcgttcggccaccatgccaccacgggggcgtcgggcacgagcagcgggatcaccagggtgtcggcgtgacggaccagaccgccgcgcggacgaagcacgatgatctcgcccgcaccggcgtcggagccgaagcggatctcggcgtcaaggaaggtgggatgctcctcttccgggctgatcttgcggctgctcggggcgaccgcgatcacacggcagggatgctcgcggctcgcattgttggcgacttcgagatcatgctcgagctcggcctcgttggtggagatgagcagggtgagcacacggcccagggccgcctcgccgcgctcctcgtgcagttcgtcgattttcgccgagatctcgcgggtctcggtgtcttgcagggtaatgatcacggcatcctccaacggtgtccatcgcgggcgagcatttcaacggcctcctccggcccccacgtgccggaacgatacggctgcggctggccgagcgtcgaccagaactcctcgatcgggtcgaggatcttccacgaaaggttgacctcctcggtggtggggaacagcggcgggtcgcccagcagcacgtcgaggatcaggcgttcgtatgcctcaggggaggattcggtgaacgagcgaccgtagccgaagtccatcgacacgtcgcgcacctccatcgacgtgccgcccggcaccttcgcgccgaagcgcatggtcacgccctcgtcgggctgcacgcggatcacgacggcgttcttgccgagctccttggtggcggtcgattcgaacggcagatgcggggcgcgtttgaacaccacggcgatctccgtgacacgcttgcccaggcgcttgccggtacgcagatagaacggcacgccggcccaacggcgggtgtcgacgtccaggcggatcgcggcataggtctcggtggtggattcgggatcgatgcccttctcgtccaagtagccgaccacctcgtgcgatccctgccatccggcggcgtactggcctcgcgcggtgtgcgcggccagatccttgggcaggcgcacggcggagagcaccttggtcttctcggcggtcagatcggcggcggagaaggagaccggctcttccatggcggtcaatgccataagctgcagaagatggttctggatgatgtcgcgtgcggcgccgataccgtcgtaatagccggcacgaccagccacgccgatgtcctcggccatggtgatctgcacatggtcgacgtaattgttgttccagatcggctcgtacatggcgttcgcgaaacgcaacgccagcatgttctgcacggtctccttgccaagataatggtcgatgcggaacacgctcgacgggtcgaacacttcggagaccacgcgatcgagctccttggcgctggccagatcatgaccgaacggcttttcgatgatcacacgacgccaagcgcccttgtcgcttttcgccagaccacagtcggccagctgacgggacacctgcgggaacgcgcgcggcggcaccgacatgtagaacgcgtgattgccgcgcgtgccacggtcgcggtcaagctcggcgaccgtgtcggacagacgctcgaacgctttcggatcatcgaacgtgccttgtacgaaacggataccggccgcaagctgcttccaagtcgattccttgaacggcgtacggcaatgcgcctgcacgttctccttgacgaagtccttgaaatggtcctcggtccagtcgcggcgtgcgaagcctgtcagaccgaagcttggcggcaacaagccacggttggccagatcgtagatggcggggagcagcttcttacgggacagatcgccggtcacgccgaaaatcacgatgctgcatgggcctgcgatgcggggaagtctcagatcgcgcgggtcgcgcagcggattcgtccatgcgtcggccgcgttggatgcggttgaaacggtttcactcatgcctttcatactaacgcgcgggctccactcgccaccaaagggaattcgaaaacgtcatggcccttttttagagcatcctacaaaacggcatggcgattccctcgtttggtgccgccactacaatgcctccggaagagaacgacgagccggctgcggctggcggagacaaaaacatggtgcacaacaagcagggcatagacatgctgcacgggcgcatatggacgaaagtcctgcgattcgcgctccccgtggcggcgaccggcattctggaacaactcttcaacgcatccggcatcatgatcgtcggcaacttctcccaatccgacggcaccgccgcggtcgcggccgtcggctccaacgcgcccgtcaccggactcatcctcaacctgttcatcggcatcgctctcggcgcgaacgtcgtcatcgccaacgccatcggacgaggcagccgcgaagcggtgcgcaacgccgtgcacacgtccatcgtcaccgccctgatcggcggcgtgatcgtcgccatcatcggagaattgctcgccggcccgcttctcggcatgctcaacgtgaccgccgacgtgttccccctggcgctcgcatacctgcgcatctacctcatcggcatgcccgtcatcctgctatacaatttcgaaacagccatcttccgcagcatcggcgacacccaggctccgctcgccgtactcgccatttccggcgtgctcaacgtgaccatgggactgattttcgtcgtattgttccattggggtgtttcgggcgtcgcgacggccaccgtcatcgcgaacgtcgtcagctccatgattctgctgtatcgactggttcatactgacgcagccatccatgttgatttgcgcgagttcggcatcgactggttcaccctgcgtcagattctgcgcatcggactgcccgccggcgtgcaaagcgcggtgttcgccgtggccaacatcatcatccaagccgccatcaacagtctcggcaccgttgtcatggccgcctccagcgccgcgttcaacatcgaaatcatcgcctactacgtgctcaactcgtttagccaggcctgcgccaccttcaccgggcaaaactatggagccaaacggattggacgctgcaagcgcgtgcttggcatctgcattctggaggatttcatcgtcaccgcggccaccatcgccgtcgtgctgttcttcggccatagtctgctggcgttgttcgatgcgacaccggaggtcatttccgtcggctacaccagactcgtcatggtgttctccgcctacacgttcagcatgctatacgaggtcatgtccggatatctgcgcggcttcggcatctcactggtgccggcgctgctcaccgtaatcggcgtggtcggcgtgcgcatcacttggatcgcgttcgcgttccccgcgcatcgcacgttcgaggccattatgatcgtctacccgattagcctcgccgcaaccgccgtactcatcggcattgctctgctctgctaccgtccgtccaagcgattcgccgttaaaccttgagcgtgtgcggcttgccgccgtccatgaacgcggcgattcgccgggtcaaagcgcggggaagaacccgttccgcgagcgcgcccgccttggtgagcggaccatggtaggcgagggttgagccgcgcatcatcctgcggtaggcgtacgtggcaagctgacgtgcggtggccggtttggtcatggtgaagaagttgcggccactcatattcgcagccttctgaaagccggtcgtggtcggaccgggacatacgcaggtcaccgtcacgcccgtgccgcgcaattcgtgggccactgcctcggatagcgaacgcacgaatgccttcgacgcgaaatacatcgccatgtatgggcctgccatcatcgaggcgacggacgaaatattcaaaatcctgccatgcccgttggcgcgcatgtctcggccataccgatacgtcaactcagcgagcgcatgcatgttgagctgcatcatctcattttgccggttccagtcggcgtcgagaaaatccgtccagtcagcgaagcctgcgttattaacgagatggtcgaccgcaataccttgtgatgtggtgaaatcatggagtttcttcggcgcatttgcttcgctcagatctatggcgaacgtcaccacatgcacgccaaaacgctgctcgagcttggtttttaccatgtcaagccgttcctggctgcgggcggtgatcaccaggtcatgtccgtccgctgcgaacagcgccgccagttcgcgtccgatgccgccggacgctcccgtgatgagtgcgtatcccatgccaactccttcgttttggtcctatctcgcctatgaatggcggattcgcgggtctgcctgatgctatctccactatagatggcggatgtttttcgacttataccccctgagatagtgtatgggggtaaaaagcgcggcttttcactttgccgtccgccatctataagcgagataacatgtgtcgaaagacgaaatccgccatccataggcgagataggtgttttgtggaggggtggaggacagtggtgaaaacaaagtcgcattacgattcgccgcttggcggcatcacgctgatcgccgacgaaacggcattgctcggcctgtggttcgattggcagccaggctatgcggacgatgattccgcggttttgggtgattcgccgacgattggcgccgcgaaacgatggctggacgaatactttgcaggttgcatacctcggaccgaagtgccgttgctgctggaaggcacgccattccgcaaggaagcatgggcattgctgcggaaagtgccatacggcgaaacggtttcatacggcggactcgcacgtcgattggagttgaaacgtgcggacgggcgtagggtatccgcacgcgccatcggaggagcggtgcaccgcaatccgatcgcgcttatcgtgccctgccatcgggtcgtcggcgctgacggcagtctcaccggttatgcgggaggcattgaaaccaaaatccgtctgctccaactcgaaggcgtgctgaagcagacggaacggatggatgtggattgcgaatctatagaccggatttggcgatccacccgctgacggcttcggcggttttacttgcgttgttctgtgcgtcggtccccatgaccgcaagccccggcttcaccgtcgtcttggtgattgcggcgatacgttccggagtccgtccaagcccgctgccgccgtgcgtgcagaacggataaatggtctttccggaccagtcgcggctttccagaaaagcgtacacgagcatcggcatatcgccgcaccaaatcggatagccgaggaacacggtatcggacgagtcgagcgcatcggtatcgccgctgagcgtgaacggcagacgcacgttgacacgctgctcctcctgcaccatttctgaggtcgcggcgtaccgttccggataaggctcggtacgtgcgatttcaatcatcggcgaatcggtccgccgggccacctcttgggcaagcttcgcggtattgccgaccgtcacctcgcccacttcgtagttttcgccggcgcgggagaaaaacaccaccaccatgttgcgtcctttcatggtccttgaagaggccgttgccgcatccgtcatgcgtcagtccaagggtttatcagtccatctttggaaacgattgtgctcgatacgcgagcagaccgtcgatgaaccgtgcaagaccctcgatcatgcgtgcacgcggacaggccacgttgatacgcacgaaatcatgaccgttgccaccatattcggaaccctcggagaacatcaccttatgctcgcgtttgagataatcgcacaacgcatccgtgtcatgcgtgatggccgaacagtcgacccacaacaggtaggtggcatgtccttcgaccatgatgatgcgccggtcggccggcaccgaagcgttgtatttgtcgaacatcgcacgcgcggtcgccttgttgccggccagataagcgcgcagttcgttcagccacggttcgccctcgttgaacgcggccagggtggcgtccatggcgaaggcgttcggctccgccacctcatcggtgttcaaagctcgccacaccttatgacgcagcaccggattcggaatcatcacggccgcggaattcagtcctgcgatgttgaacgttttggtcggagccatgcaggtcaccgaattcatcgcgcaatgctcgcccaccgaggcgaacggcacgtaatcgaaacccggatcggtcagatcgcagtggatctcatcgctgaccaccgtcacatgatgcttccagcacagttcgccgatacgttccaaagtctcacaatcccaaatacggtcgatcggattatgcgggttgcacagaatcatcagcgtggtctgcgggtcggcgagtttcgtttcgaaatcagcccaatcgatctcgtaatgtccttcgccgtcataggcgagcggcgattcaagcacacggcagccattgttgagaatcgaattgaagaagatgttgtagaccggcgtcatgatcacgacgttctcgttcggcgtggtgagtttcctgaccatgctggagatcgccggcaccacaccggtgcagaacaccagcgagtccgggtcgatggcaagcccatgacggcgtccccaccaatccacgtacgcctgattccattctggcggcacgatcgaatagccgaaaacgccatgctcgacgcgccgacgcaacgcctcgcggattacgggcgcggtctggaaatccatatccgccacccacatgggcagcgcgtcgccagcctcctcccatttgagcgagtacgtgccggaacggtcgatcggagtatcgaaatcgtaagtcataccgccaatcctacctactgttatgcggcgtcggctgtcacgatcgtcgtggccgtcggatcgattttcgccggatcgagcgtcagctcgttgatatggtcggcgcgaatcgtgccggacgaaggattgaacacgctgtcgatcgtgccgcgcacgtcggcatcgacggaggaatattcgaacgcgagcgtcgtattgacgagccggcagtcacgcaacaccagatggtccacgtagcacaggccctgcaggctttcgatcgtgcaatgctcgaacgtcacgttacgcgagttccacgccagatactcgccggaaatgaacgaatcgcgcaccgtcacgttctcacagttccagaaacaatccttcgaaatcagacgggaattggaaatctccacgttccttgcgccatcgaacggataattgcccaccaaacgtaggttgtcggctttcacatccgcgcaattcatcgccagatagtcgccatgcgcgctcacattgtccaacgtcacgccggaacaggcccacaatgtctcctcggcgttgacaaaatccacgttgcgtaacgtcacgtcatggcagcggcggaaattcttcggcgcctcgatcgttgaatcctccaccgtgatatggtccgtgtaccatacgcccgcacgtgccatctcaaaccacgtgcagtccttcgcatcgatatccgagcaataccacagcggatacttccatttgaacgagctcgacctcagttcgatgtcatgggcatgcttcaacggcgattcgccatcgtcgaaaatcgtatcgacgtaccggcggtcatgcgcgaagaactccgcgcgctcgccggtgaggaacgcctggcgggtttcggacatgtcctgctccgcagcggatgtaaatgtatctggagtgttattcaccgtatgctccttcatgctctgttggaagagaataggaacttcaagtacttgaagtcaaacagggagccacgttcgtctggagcgaacacggctccctgcggaaaatcgggaaatgcgcgccgaaacaggcagaggaatcagccgatcagcgctgccggatacttcgccgcggcggcgtcgatctgctcatcggtggacgtggcgacgccttggatgaggaacggcttcagatatgtggcatgcgtatgacggaacgtggtctcgaacggggaaagcagctcctccatggtgcgcacatggctgccttcacgcgtgtaggagtccgccggagagccggtggacacggccaacatgaactccttgccttcgagcgcccgcccgccgccgtaggcccagccggccttgatcacgtcatcctcccactgcttgagcagcgcgggggagctgtaccagtagaacgggaactgcagcacgatgcggtcatgcgtttcgatgagctcctgctcatgttcgacgttgattttgaagtcgggatatgcggcgtactcgtccatcacggtcacgtcgccggtctcgttggccgcgtccatgagcttgcggttgacctgcgacttctccagatgcgggtggaacaccagaaccagtgtcttcattcatgctccttgtccaaaggttttttgttacgttccagtatgcagcatgataatctcgccgcgcttgctttgtacgtaatccgtcgatgtccacgcgccgatacggttgcgcatgttttgtcggggtcggcgatagtatgttggccgtcgttgtggcgcgtcggggtatatcagggcgcggcaagagaaggcatgagaagagaagcatgggaacggacggaagaagggctgatatttaatggtgcggacgcagaacaggaatgctgtcatgggcaaggcgttcagaacggcgttgccgcggacgtcgccggtctgcatcagcttcttccttctggcgttgtcgtacggcgtgctgatgggcacgcgcggcttttcgttcctgtggcccatgtgcatgagcgcgttcatcttcaccggttccatggaattcgtcaccgtgaatctgctggtgtccgcgttcaacccgttcgtcacgttcatgctggccgtcatgctcggcacccgtcatctgttctacggcatctccatgctcggccggttcaagaacatgggcgccaagaagccgtatctcattttctcgttgtgcgacgagaccttcgccatcgacaacggcaccatcattgcggccgacgtcgatcgcggatggttctacttcttcgtcggcctgctcaaccagtcatcatgggtggccggcgccacgcttggcggccttctcggagaacgcatcaccttcaacacctccggtctcgacttcatcatgaccgccatgttcgccgtcattttcgtggatcaatggctgaccacgaaacgcaaaagccacatggccgcgcttaccggcatagcggtgcccgcgatctgtctgggggtgttcggcgccgacaatttcatgatcccatccctggtcgccatgctcgtcatgttcattctgctgcggccatacctggacgacctgaagatcgacaagacggacggggagaacgaaacgaacaacgcggacaaggagacgaacgcatgatgatcatgaccacgtggcaaggcgtcatcaccatcatcatggcgatgctcggcaccatgctgacacgtttcctgccgttcctgctgttccccgaatcgaaggaaccgccgcgtttcatcacctacctgggcaccgtcctgccgtatgccatgacaggcctgctcgtcgtgtactcgctcaaaggagtgcacctgacgtcaggcagccacggcattcccgaattgttggcgattatcgcaatcgccctgctgcacatatggaaaaggaacatgctgctgtcgatcgccggcggcaccgccgtctatatgctgctggtacagctggttttctcgtaagacggcttccgcctgtgcttggcattgcgattacctggcgagccccatctcgtatttgagcgtcatcacacgaatggcggattgctgcaccttccgcgcgaacgtcgcatcgccggccgctttggcgttcaatccgtccaacaccggctgcacgtaggaagaggcgccgatacatgccaaatcgccgccggcttcgaccagccgcacacccaaatcactcggctgcacgccactcaaagccgttgcggacagggaatcggaagtgacgacgccttggaagccgattttcccgcgcagatagccggtgaccagcgttgatgagaacacggccggattattcggatcgatcgcctgatatgtggccaaagacatcatcaccatcgaagggcttgcctccaacgtgccgttgaacgcgctgatttccggaccatccaacgtggtggtggtgtcgaggatgccgttcgcggtgaaatcggtattgccggtcaccgatcccaaacccggataatgtttgatggcgctgcctacccccgaatcggacatgccctgtatgaacgccttcgcatggtccgcattgccggccggatcaagaccgaaatcacggtacagcgcgccaatcggggcgttcgacgaacggtccacggtcaccgtgccgacgacgggcgccagatcgacattgatgcccgcagccttgagctgcgtgccccatgcggatgccgattgcctcaactggctgacatccattgcgccctgctgggtggccgaaggcatggtatcaaacccggcccccttgagatgctggaccagaccaccctcctgatcggtggacatcaacagctggttgtcgcccggagcatacgattgcagcgtggatgtggcggccgcgaccccggcgatccccgaagtccagttgccgatgatcaaaaccgaaccaacatgcctgttcgcaatgaggtcatacaacgatgacggatcggaaccagcgaacaatggtgccataaccagctgcccgacccgttcctcgacactcatggactccacggcccgcaccgccttggcatgcggcgaatcgtcgcggacggacggcacttgcgccttgtcgagggaatcatgcgtgaccgtcggccggcgagtggaaaaagctgcggtggcggcgtccgatggggaagcgtcgccggaacatgcggccaacgtgaccggcagcatcgccacgcagcaggcagccaccaatcgtgtgaaaaacccatgagccttcttcataccgccattatggcatgccggcattccccatatgttcccttcatacgaacatgccacggaacagccgattcagcccacggccagatccgttcggctggcggcttaacggcgttcctcgcctgtcgctaggctattagcatgtctttctttgatatgtttggtcccatgttcgatcccgaaggcggctcgaaccgtgccggcaggcagaatccgcgcaaacccagcaacgacgatccgatcatcctcaacgtcgaaaccgacggaggggacggtccgcaaccatcgtcgaacgttcccccgaaacgaccttcgggcccccgcatcaccagcaagccgaaccgtccgcgcaaaccgtcgaacggcagcaagatcttcatcggcgtggtgctggcgctcgccatcgtcatcggactgttcttcgcgctcgcgcagttcgtcaccgatgtcatgtggtacagccagctcggcttccaaagcgtgatttggacgcagctgggcaccagggtcggcctctggctggcgtacgcggtgcttatcgccgcagtcggcttcatctccgccacgctggcgatatgggcgcgtcccgacgctgcggacggctccaccatccgcgtgaacggcgacaccatcgaaatcggcaagagcgtgagctccaagagcgctcgacgcatcgccgtggtcatctccctgattgtcggactggtgttcggctcccagttcaacgcgaactggtccgaaatcctgctcatgttcaactcgcaaagcttcggcaccaaggatccgcagttcggcatcgacaacggcttctacgtgttcgtgctgcccggactgaaactcatcatgtccgctgtctcgctgttgctgctcgctggcatcatcttctccatcgtcacccacgtgcttatgggcggcatccgcatcaccatgccggtgaacggccatggcctgttccgcatcaccaaacgcgcccgccgccagatcggcatctggctgatgctcaacatgttcgcctgggccgccaatcaggttctgggagtgttctcgcacctgaccgaggaaggcagcagaatcaccggtgccacctacaccacggtgaacgccaccatccccgtcacgttcatcatggccgccatcaccgccatccttggcgtgatactgggcctgtggattatgaaatcccatacgttggaaggttccgcacccatcgcggcacgtgcttccgaagcgctcaaggcgtggaaggtgccgaccgtggccatcgcctccgccatcgtggtgagcctggtgcttaccgtggcctggccggtgctgctgcagcgcttccgcgtcaatccgaacgcgcaggaaatggaatccacctatatccagcgcaacatcgacgccacccgcgccgcgtacggcttggacaaggtgaaggccgaacagtacaaggccaccaccgaaggcgaggaaggcgcattggctgattccgcggaatccaccgctcagatccgcctgctcgacccgcagattatctccccgacgttcaaacagctgcagcagtccaagcagtactacacgttcgccgacaccgtcgcggtcgacaaatacgacgtcgacggcgtcagccaggacacggtgatcgccgcgcgcgaactcgatctggacggtctcgacaaccgcaactgggtcaacgaccacaccgtgtacacgcacggctatggcgttgtggccgcctacggcaacaaggtgaccgccgacggccagccgaagttcttcgaagcgggcatccccacccaaggcaagctcaccgattccgaaaagtacgagccgcgcatctacttctctccgaacgccaccgaatattcgatcgtaggcgctccggaaggcaccaaatcctgggaattcgactatccgaccggttcggaaggcgccaccaacaccttcaagggcgatggcggtccgaagatcggcaacatcttctccagactgctgtacgccatccgcttcggctccgaccagatcctgttctccaaccgtgtgaactccaattcgcagattctctacgaccgttccccgaaggaacgtgtggccaaagtcgcgccgtatctgacgcttgacggccgcgtatacccggccgtggtggacggacgggtcaagtggatcgtggacggctacaccacttcggacgcctacccatactctcagatgaccgacttgggcgaggccaccaaggactccaccacggaatcctccgacacggtaagcagcctgaactcgaagaacgccaactacatccgcaattccgtgaaagccaccgtggacgcatacgacggttccgtggacctgtatgtatgggaccagtccgacccggtcgtcaaagcctgggagaagatcttccccggccagtaccaccagctgtcggaaatctccggcgacctgatgagccacatgcgttatccggaaagcctgttcaaggtgcagcgcgaactgctggccaaataccacgtgtccagcgccaaccagttcttctccggagaggatttctggcagacccccgtcgacccgaccgaatcgcagcaggcgcaacagcgagacatcctgcagccgccgtactatctgacgctgcagaccggcggctccagcgaaccggtgttctcgctgacctcgtcgtacattcccgcaggctcgtccaccagggaaatcctgaccggcttcctgtcggtcgattccgacgcgggccacgagaaaggcaaaatcggctcgagctacggcaccatacgattgcaggaactgccgaaggattccaacgtgccgggccccggccaggcgcagaacaacttcaacgcgtccgccgacgtgtcgaaggaactcaacctgctcgaatccggctcgaccaatgtgcagcgcggcaacctgctcaccctgcctctcggcggaggcctggtctacgtgcagccggtgtacgtcaaatcgtccggctccaccagcttcccgctgctgaagaaggtgctcgtcgcattcggcgaccaggtcggcttcgccgacacgctggacgaggctctcgaccaggtgttcggcggcgattccggcgcgtccgcaggcgacgccgaaaacgtgggcgacaccaccgatgacaagcaggatgctaagaacgacgattccgccgatggcaagaccaacactgacggcaagcaggacacgccatccaataccgacggtaagaccggcggcaataatggcgattcgtccggcacgatgagcgccgacctgaagaaggcactcgacgatgccgcacaggccatgaaggattccgatgccgccatgaagaagggcgattggtccgcctacggcgacgctcagaagcagcttcaggaagcactgaacaaggccatcgaactcgaacagtgattcccgtccgattcccttcatgaaatacgcaggggccggctccttccaaaggaaccggcccctgttgtcgttcgccgccgggtatgctgggcgcatggccgactattctttccgcatcgcgacgcaagacgatatccaagcgatcaccgacatctacaacgcggcagtcatccgcggcggctcgtccgccgacaccacgccacgtacctacgcgcaacgcaaggcatgggtggaatcgcaccacgatccatatgcggtgttcgtcaccaccgtgcctgccacggatgcagccacggaaggcggcgaacggatcatcggcttctccgcgctgtccgtgttctacgaccgcgccggctacgacggcgtcaccgacctcgcctactacatcgcccccgaatggcagggcaggggagcgggcaccttcacactggccagactgcttgacgaatgccgaaaccgccacatgcgcaaagcctgcggcatcatcttcgccgacaaccgcggatccatcgcactgatgaaacatttcggattcacccaattcggactcatgccccaagccgccaccgactccaccggaaccatgcgcgacatgagctactggcatctcgacctgtaagcacctgacagtagaatctgtgcggttaaacaagacgagagcacgcaagaacacagaggaatggacgattattatggcatctgatttctggctgatcgcaggactgggcaaccccggctccaaatatgagggcacccgccacaacatgggcttcatgaccgccgacgtgctggccgaacgctggtccgtcaacttctccgaccacaagggactcgccatgctcggcaaaggcgtgatgaacctatccggccgcaacgtcaaattcttcctcgccaagccactcacctacatgaacgaatccggcaacgcggtcgcctccatcagcgcctactaccagatcgaaccggaccatatcgtggttatccacgacgacatggacctcgacttcggcagaatcaaagtcaaagccggcggctccgcaggcgggcacaacggcatcaaatccatcgaccgttcgctcggcaccccgaaatacgcgcgcgtgcgcatgggcgtcggccacgcccaacgcggagcccacgcgcacgacaacaccgtgaactgggtgctgggcggcttcggaccggaccaacgcaagcagctccccgaattcctcgccgacggtgccgacgcggccgaaaccatcatcttcgacggtctcgccaaagcccaggagcgattcaatggccgctgaaccgacgtctccggcgcaaccaccgcaactgccgaccgcaggctcgcttgccggcatcctcgacgtgctggaaaccgatgacgatttccgcgcgctcatcgccggggaaatcgaagaaccggaatcagacatcgaccccagcatcaccgtcggtgtgccggacggcctacgcccggcgctcgcagccggcgctgcgggcaaacagccggtcgtgctcgtcgtcgcctccagccgcgaagctgaggaaaccgtggagtccatccgttcctggtatgacggagacccaaacgatgtggcgcagcttgaagcatgggagacccttccccatgaacggctttcaccacgcgcggacactgtggcaagccgcatggcggtgttccgcaggctgaagcatcccgaagagggcagcacgctgttcggccccatccgcattctggtcatgccggtgcgctccctcatccaaccggtggtcgcaggcttgggggacgtcgaaccactcgtgttctcccaaggcgaggaactgcttcttgacgaagcatcccgcaaactggtggaaaacgcgtacacgcgcgtcgacttggtgatggaccgtggcgaattcgccgtccgcggtggcatcatcgacgtttttccgcccactctgccgcatccggtgcgtatcgaattcttcggcgacgagatcgacaccatacgtgaattccacgcatccgaccagcgcacctacggtaaggatatttccaccgtatgggccacgccatgccgtgaactgcagttgaccgaccagattcgccaacgtgcgaaatcgctgatcggctccattcccaacgccgaggacatgctcggatccatcgccaacgccatcccggtggaaggcatggaatcgctgctgcccgcgctggtcgacgatatggaaccggtgcagggcatgctgcccaagcatgcgctggtcatgctgtccgacccggaaaaacttcgtcgcgccgccgacgatctggcgaaaaccgccaacgaattccttgccgcaagctggcacgtcgccgcatccggacatggcgccggagcgccgatcaccttcgaccaggcgaatttctacgatttcgaggaaaccatctccgcactcgtcttctccaaacatgacgtgtggaaactcaccagcttcggcgtcgacgccacccgggaaggccacatccaacttgatgccaccaaacccggtgaataccgcggtgacgaaaacaaagcggcctccggcatcgaaggactgctcgacgccggctatgcggtgacgatcacggccgcggcccaaggcacactcacccgactgaagcgtgcgatcaacgaaaccggcatcgcgaatttcgattgcgtccgatcgcacgccatcgacggtttcgtggacgacgccgcgaaaatcgccctgctcaccgaacgcgacctgaccggccgcacatccgccgcaggacaggcgaaaacgccgaaacgccgacgcaaggccatcgacctgatggaactcaaaacgggcgattacgtcgtgcacgaacagcatggcatcggccggttcgtcgagatgcgccaacgtaccatcggcaaaggcgagaaccagaccacccgagaatacctggtcatcgaatacgctcccagcaaacgaggcgcgccggcggacaaactgttcatccccaccgaccagctcgaccaggtcagcaaatacatcggcgccgaaacgccgaaactcaacaagctgggcggttccgactgggccgccaccaaagccaaggcgcgcaagcatgtgcatgagatcgccgaggatctggtcaagctctactcggcacgccagcgtacgaaaggctatgccttcagcaaggacacgccgtggcagaaggagctggaggacgctttcccctatcaggagacggccgaccagctcaccaccatcgacgaggtcaagtcggatatggagaaacccattccgatggaccgtctgatctgcggcgatgtgggctttggcaaaaccgaaatcgcggtgcgcgccgcgttcaaggcggtgcaggattccaagcaggtggccgtgctcgtgccgaccacactgctcgtgcaacagcatttcgagactttcaccgaacgtttcgaaggcttccccgtgaacgtggctgccatgagccgattccagaccgccaaggagatcaacgagaccatcaaggggcttgaagacggttccgtggatgtggtcatcggcacgcacaagctgctcaatccgaagatcaagttcaaggatctgggactcgtcatcatcgacgaggaacagcgtttcggcgtcgagcacaaggagacgctcaaggcgttgcgcaccaatgtggacgtgctgagcctgtcggcaacgcctatcccgcgcacgttggaaatggctgtcaccggtatccgcgaaatgtccacgctggccacgccgccggaggatcgcctgccggtgctcacctacgtcggcgcttacgaggacgcgcaggtcaccgccgccatccggcgcgagctgttgcgtggtgggcaggtgttctacgtgcacaatcgtgtgcaggacatctcctccgtcgcggcgaaaatccacgagctcgtgcccgaatcgcatgtcggcatagcccacggcaagatgggggagaaacagcttgacggtgtgatccgcgacttctggcatcgcgacatcgacgtgctggtatgcaccaccatcatcgaaaccggccttgatatctccaacgccaacacgctgatcgtcgaccatgccgaccgcttcggcttgagccaattgcatcagctgcgtggccgcgtcggtcgtggacgtgagcgcgcgtatgcgtacttcctgtacgatccgaccaagccgatgacccagcaatcgcatgacaggctcgccaccatcgcgcagaacaccgcgctcggctctggcttcgacgtagccatgaaggatctcgaattgcgcggcaccggcaatttgctgggcgatgagcagagcggccatatcgaaggcgtcggcttcgacctgtacgtgcgtatggtgtccgaagcggtcgaacagtacaaggagccggaacgcaaggaatcggttgccgtcaccatcgacctgccgatcgaggcgtccattcccgtcgactacatcgattcggacaaactgcgattggaagcgtaccagaaactcgcctccgcacgcaccgaagacgatctcgacgagctgcgcgacgaactcaccgaccgttacggcaagccgcccgtcgatttcgaggcgctgttcgacgtggcgcggttgcggttcaaggctcgcaagctcggcatttccgagatcatcgcgcaaggacgcaacgtgcgcgtgtcgaagttcgagccgcgtgaatccgtgcagatgcgcatggccagaatctacaaaggcatccagtaccggccgttgaccaagacgtatctggtaccggctccattcgcaggctcgcttggttccaagccgatgagctcggacgaagtggtcggatggaccagtcaattgcttgacgatttggactggaaaccgacaccgcgtcaatgacagtgggatgcaaaaaagagtgtgagcgttcacatggaacatgcgggcaaagtttggcatacgtccataaatcgcactattcttggcattgtcatcacaacctaacgtttataaggagtagttgtggcagtaattgaaagcgtttacgcgcgtcagattctcgattcccgcggcaacccgaccgtcgaggtcgttcttgacaccgatgacggtgctcagggcctgggcctcgttccgtccggtgcttccaccggcgaagccgaggcttgggagcgtcgcgatggcgacaagtctgtttaccagggcaagggtgtgctcaacgccgtcaaggccgtgaacgaggagatcgctccgaaggtcatcggcatggacgcttccgatcagcgcgctctcgatgagaccatgatcgagctcgacggcaccccgaacaagggccgtctgggcgccaacgccatcctcggcgtgtccctggccgctctgtacgcttccgccgagtccgcggatcagccgctgtaccgctacatcggcggcaccaacggccacatcctgccggtcccgaacatgaacatcatgaacggtggcgcccacgctgacttcgccaccgacatccaggagtacatgatctccccgtacggcttcaacacctacagcgaggctctgcaggctggcgtcgaggtctaccacaccctgaagaacgtcctgaagaagcagggcctgaacaccggcctcggcgacgagggcggcttcgctccgaagatgaagtccaacaaggactccctgaactacatcatggacgccatctccgccgccggctacgagccgggcaagcagatcggcatctccctcgatgtggcttcctccgagttctacaacaaggagaccggcaagtaccacttcgaaggcgacgaccgtgaggccggctacatgctcgacttctacgagaacctcatcaacgagtacccgatcgtctccatcgaggatccgttccaggaagaaggctgggacgactgggcggccatcaccgccaagctcggcgatcgcctgcagttcgtcggcgacgacctgctggtcaccaacccggcacgtctggccaagggcatcaagctcggcgccgccaactccctgctggtcaagctcaaccagatcggcaccgtcaccgagaccctcgacgccatcgagctggccaccaagaacggcttcacctccatggtttcccaccgttccggcgagaccccggacaccaccatctccgacctggctgtggcaaagaacaccggccagatcaagaccggtgccccggctcgtggcgagcgtatcgccaagtacaaccgcctgctcgagattgaggaggagctcggctccaccgctcagtacgccggctacagcgctttcaaggcctgcaagaagtacatcgccgagtgagcgtagccagcgcatcatgaatgcgttgacatagaaatacccgtcgtgttccaagtcgaacgcgacgggtattttcgttgctatgagttcgaaggcacgaaaaaaaccatcacaacgcggcggcgccggcccggtcgcgttcttcgtggcattgttcatcgtggctttgggaaccatccagttggcatcgacattccatacctatgcgttgaatctggcagagcttaacggactgaaaaaacaggaagcggcgttggtcgcgcagaaacgcgagctggagaacgatatcgcaagatgggatgacaaggcgtatgtcaccgcccaggccagggatcgtttgggattcgtcttccccggcgaacaggcgattcgtgtcgagcatcccgaagcggtgaccggcaagagcgagccgaaaaaagggatgacatacgacgaatcaccgaaaaccgccctgccgtggtataaggagcttgcatattccttcaagcaggcggatcggtcggatcccgtgaaggccgactcgacgaaacagtcgcagcatgccggcgaagaagacaaacaggacagtcaacaacagactggccaatcgcaacaggacggtcagcagccgtcagaagacggacaggagtgacatggacatgacgattatcgaacaggccaagggtttggcggacaaagtgcttgcccaacccgccaccgaacatgatatcgccgtggtggagcgtcagcttggacgttacccgcgcggcatggtcgccgtcggagcccgttgcgtatgcggccggcctttggctgtggtcacccggccgttgcttccaggcggtgtcccgttcccgacgacctgctatctgaccgggcccgaagcggtgaaggccatctcccacatcgaagccgaaggcaagatgaaggaatacaacgatatgctggccgaaaacgaggatctgcgtgccggatacgaacgtgcccacgaactgtacctcgcgttccgccatgaaatcgctttggccttggaagacagcgaggaacacatcgaaggcaccagtgccggcggcatgccggtgcgtgtcaaatgcctgcatgcgttgttggcccagacgctggtgatgggtgagggcgccaaccccatcggtgatatggccctgtccgccatcaaacatgagttcgatccggccgtatgccgttgcgcagtggaaaacgaagagtagaaggtgggagtaatgaagtcggtaaccgttgccggtattgattgcggcacgaattcgattcgtctgaaagtctcgcgtgtgagcgaggacggtgtggaagacatcgttccgcgcatcctgcgggtgattcgtctcggtcaggatgtggacaaaacccatcgcttcgccgacgaggcgttggcgcgcgcctatgaggccgcccgagaattcgccggcgtgcttgccgaacatcccgtggacggcatccgcttcgtggccacatcggccacccgtgatgccgagaaccgtgaggaattcgaagacaacatcgagaagatcttgggcgtgcgtcccgaagtcattccaggcacggaggaagcggatttaagcttccttggtgccaccagcatcgtccatcgcgaggtcgaggccccctatctggtggtcgatttgggcggaggttccaccgaactggtgctgggaggcgacggcgtcacccatccgagcacgcaggtgcaggccgcgttctccatgaatatcgggtctgtccgtatgacggagcgtcatctgaaaaacgacccgccgaccgaggggcagatcgccgaggcggtcgcggatatcgacgcgcatatcgacgaggcgttcaagaccgttcccgccggcaagacccacaccatcatcggcgtgtccggaacggtcaccaccatgaccgcattggctatgggattgacggaatacgaccacaccgccgtggacggcgcacgctgcacgctggaagatgcctatgccgttgacaaccggttcctgcacatgcctcgtgaggagcgtctgacctacaagaccattcatcccggacgcgtcgatgtggtcggcggcggcgcattggtgtggaaccgtgtgcttgccaaggtgtctgaagccgcatatgaggatcatggccagcgcatcgactccttcatggccagcgagcatggtctgttggacggcatcgtgctggattacggcaagagattgcttgctgcgcgctgacgtggcataatagcttggcgtcggctttttcttctggccggcgcaaagcctccatggcgaaatcggtatacgcagtcgacttaaaatcgacctcttcggattgtgggttcgagtcccgctggaggcacttttggaaaccgccagagatggcggttttcctttattctccaacggttttggcatcatcgcgattcactgcgattcaacccttttccacggtgggttatggaaaaatgtgggcaatgtgtaggcaaaatgtggcatatcgttcccgaaacattccgtaggtacactgtcggacattacaaaccgtatgacaccgactgaaacggatgacgcatgacttcgaaagacatcaagcctgtaatcgaacagcccgccactgaaatccccctgatgcttgcgcaggcgattatcgttgccggcgtgctcgctatcggcgaaatcgcatgttctccgctgtactttaccttgatggaccattcgttggcactcgttccgtgggcattggaagccgcattccttgccgtggcgttcaccttcgtcgtgggcttcgcattgttgtggtgcgccgaatcgttcactttcaaactcaaggaacgattccgcccgttcggctatgcggcggtaggattgattggatacggcgtatggagcctgctggtgttcaccgccaccatcaattcgatactcgccaaagtcggggaaagcgttcttaccaacggccagatcggcgcgatcgcgctgaacggagcagccttgggcttcgtcgctttccttttcgcaaaactgctcgacgtcaaactcggcaatcgcaaaaccgttgcgataattctgcttatcgcggaaatcgtcattgccatcatcggcctactcatcatgattcgcatgttcagcgtgctttacgcggcgtgacggcgaagacgcggaaaagagagcgcaatatacatgttcagcattctggagatgttcaccatcggcgtcggccccagctcgtcgcacaccgtaggaccgatggtcgcggccagcagattcgctgcctcccttgaacgtgacggcatactgaaccgggtcggccgcgtgcgaacggtactgtatggttcgctcgccctgaccggtcttgggcacggtaccgatcgcgccacggtggcgggcttggaaggcaacgtaccgaaaaccgtcgataccgatcacatgagcaatatccgtatggaatgcgaggcaggcggcgagctgatgctcaacggcacgcatcgcatcgatttcgattacggacgcgatgtggtgatggatgtatggcaccgcatggcggcccatcccaacggcatgcgattccaagccttcgaccggcagaacaatctcatcgacgaacaggtctggtattccattggcggtggattcgtcagacaaggcgacgccgacgacctgatgatcggcatccatgagaaaccccctgcgggaacggccttcgccgatcagaccgacgattcctcaaccgatatcgatatggatatgccctatccgttcaccacatgcgacgaactgatctcgctgtgcgatgaacatcacatgagtgtggccgatgtggtgtgggccaatgagacggccatgcggtccgccgtgcaggtgcgcagcgatttggacactgtatggcatgtgatgcgccgctgcgtgcagcacggttgcaataccaaccaaaccgttctgcctggcggccttgacgtgccccgcagggcgccaaaaatgtatgcaaggctcgcatccaacagcgacgtgctcaaacgggacggcaggcgctccgacgctgtactcgaatcatcggacgccgcatgggtcgacctgttcgcattggcggtttccgaggagaacgcggcaggcggacgcatcgtcaccgcgcctaccaacggtgcggctggcgtcattccggcggtgctccactattattggcatttcgtggatcatgcggatgaggatggtgtggtgacgttcctgctgaccgcaggggcgattggatacttgttcaaacgcaacgcgtccatttccggtgccgaagtcggatgtcaaggcgaggtcggcacagcctgttccatggccgcggcggggctgtgcgccgtgatgggcggcacgcctcaccaagtggagaatgccgcggaaatcggtatcgagcacaatctgggactgacctgcgatccggtcggtggtctggtgcagattccctgcatcgaacgcaacgccatggcggccaataccgccatcaacgcggtccgtatggccatgctgggcgacggcacgcatatcgtgagtcttgaccaagccatcaaaaccatgaaggacaccggcgaggacatgatggccaagtacaaggagacgtcgaaaggcggtcttgcggtcaatgttgttgaatgctagcgatggatggtgctaatcttggtgacactgtgttttttcaaggaggttcaccatggcatctgaaatgcctgttgtcaatgccgaattcggcgatcgcccgaccatcgaattcccgactgagatcgctcccgccggcctgaaggtcgtggagctctttgaaggcaatggcccgatggtccgccgtggagacaccgtcaccgtcaactaccatggtgtggtctggggcaaggacaccccgttcgactccagcttcgaccgtcaccagccggccacgttcggcatcggtgtgggacaggtcatcaagggctgggatcagaccgttccgggacacaacgtcggttcccgcctggtggtgtccattccgccggagtacggttatggctcccgtggcgttccgcaggccggcatcggcggcgaggacacgctggtgttcgtgatcgacatcatctccacccgctgattgacgggtatcattcttccaaggtcaaggaggataacatggccgaagaaaagacgatcctgctgacgcaggaggcgtacgacaagatgaaagaagaactcgcctggcgtgagggcgagtaccgtgacgagattctgtccaaggtctccgcggcgcgtgccgaaggcgatttgagcgagaacggcggctatcaggctgcccgtgaggcgcagcgcgtgaatcagggacgtatcgacgaactgaccgtcaaactgcgcaatgcgaagattctgactgcgcccaaggccggtgaggtcggtgacggatccttagtgacccttgaagtcaacggacgtgaaatggtgtacgtgcttggcacgcgagacctgtccatcgccacggattacagcatcatcagtcctgaatcgccgattggcgccgccatcaatggcgctcatgccggagatacggtgacctataccgctccgaacggccgtgagatttccgtgaccatcaaggaagccaagccgctcgcctgacatacgtgtgacgaaaacaacagcccgttcctccatcgcattcgtacgatgaggggacgggcttattttgttttgtccatgtggggttgattacgccttagggccacaattgcacgatcaccatgtagatggccaccatgtggcaggcgtatcccgccacggttccggtatggaagatctcatggaagccgaacaccttcggccaggggtcgggcttgcgcagcgcatacacgatggctccggcgatatagcaggcgccgccggcacacagcagtatcaccacggtaggtccggcatagggggacatccagaacaatcccatgaacgcgacgccggacacaccgaaaataatatagacaagaacataaagccagcgaggcgcgctgatccagatgacatggatgatgagcgccaccgtggtgcagatccacatgcccgcgatgatggaatcacgccagaatggcgtgagcgcgaaggaaacgggcgtataagtgccggcgatcagcaaaaagatgttcatatggtcgatgcgacggagcacatcggtaacccgtggtgaccaatctcccagatgataacaggcggaattgccgaacagtaccagcgagcaggtcatgaacacggcgcacgcccatttgagcccggtgccatgagcgaggcagatcagcacgatgcccgcggcaagagccaggggagtggcgatggcgtggatccagccacgcaggagcggctttggcctgccatgcacgtcgagtctgattttgcgttcgatttcggcggggacgatgccttcgatttttgcggcatgggcttcgcctttggcgatggcacgtttggcttttgcatccgccttgcgtcgaatgttctcggccttattgtgcgccttcacgcgaatggtctcagctttcgcctgcagggcctgctcgcgtgcttcggcgatgaccgcgcgtttcgcctcgatttctgcgtttgtaggtttcgccatcggatgcctccactataagttacggaaccgtaacctacgttagcgtaaccgtcggatatgtcaatcggcgtttccgcattatacgtgggcatatggtatgcaacctcgccattgatgcgtattatggttgcatggctgatttctcacatatcctgatgacccgtccggatttcggtgacgacgatcgtgaatggttgcaccagttggtggccgattggcaggtgattgccgatttgagtttcgccgacttgctgctaatcctgcagaacggcgagggcaagtacatcattgccgagcaatgccgtccgtccacggtgatgagtctgagagccgaggatgtggtcggcaacgtcgtcccggaatccctgtgcgccgagcttgacgcggccatggactccgaatcggtgttccgctcctcgaaactgcgtacggtcggcaaggccaaggtctgcaacgtgtacgccccggtgcgtcataatggcaagacgcttggcttggtggtccgcgagaccaacatggccacacgcgaatcgaacggccgttatgagtccgaaagcatcagcgccggcaaacagctgtatgagatgattccgcgcggccagttcccgtaccgtaacccggttatgaaccagcgccataacgcacgtgtggcggatggcttcatcgtgctcaccgtcgacggcatcgtccgatacgcgtctccgaacgccatcagctgtttccgtcgtttgggatcggtcagcaccatgcagggggagtatctgagcgagatcggcaccaaactgctgcatgagaacgatccggtgctggaaacgctgccattggtactgagcggcaaagccgcggtagattccgaattggacgccaacaaagccgcggtgtccatgcgctctctgccgttgatggacgccaatggtcgcgtgggtggtatcgtgctgtgccgtgacgtcagcgaattgcgccgccgcgagaaggaattgcagaccaaggacgccaccatttccgagattcaccatcgtgtgaagaacaatcttcaggcggtatccgcgttgctgcgcttgcaggcgcgcaagaccaagtccgaagaggtcaaaaaggagctcaaggaagcacagcgccgcgtgcagaccatcgccatggtgcatgagggattgagccagaccgccgatgagatcgtcgactatgacaaggtcatttccaacctgcttaagatggccgtcgatttggctacgatgcgcgaccagcacatcgatgtcgatttcgtaggcaaattcggcatgatgccggcacaggatgccacgccgctatcgttggtgcttaccgaactgatcaccaattcggtggaacacggtttcgaaggacgtaaggaaggacatatcacgatttccgtgggccgcggtggcaataacctcaacgtggtggtggaggatgatggcaccggcttggcggatgaggagcatgatggcatggctcgctcttccggatcagggcttggaacacagatcatcaacacgttcgtcaccaatgattttggcggaacggtgcattgggagccacgtcgcggtggtggtacccgtgtggtgctcgacatgaaactgcgtgccgcgcaagataactgacctctagaactggaatggcatatggaagggccggtcggattccatcgaatccgaccggcccttccatatgccctgaaaagaatcagacctgcatctgcatggcctgcgagcgacgtgcacgcatcgcgcgccgcttgagcgcgcgccgctcgtcttcgctcagaccgccccaaacgccgtagtcctgattggtgtcgagcgcgcatttcaggcacgcgtcaatcaccttgcaggtacggcaaacggccttggcttcttcgatttgctgataggcggcaccggtgttgccgaccgggaaaaacagttccggatccttatcccggcacgcggccttggctcgccaatcgaaagcactgctcatgtaatcgccttcctcttgccataagtggcgttctatccgttatttagataaccacgaatcggatgatttttcaagactttttcgcaaaagaaaccaagtttttttagaatccttggaattccgcgcattgcacgggacatgcccgtgcttgttggatgaagaccccacgcccggcaatggcatagtcatcgacgccgaaaccgtcgagaaccgcgctgggaatccccatcatcacatcggtggctctctctccgcaaggaaacgcaacacgtgtgaggcaacgttcaagtagggtgctttgcggcttttccacagctgcgattaccgtgacggacggatcggcgagtgcggtcttgagcttatcggcttcgggcatggctgcgaaaggggagagcaattcgtcggcgtcatccacgaaccatatggtgcgttcgtgctgcggcgatgttctgccgtcgtcggtggtccattcgctgttcgtcttgcgtgtgaaccggatggtgcagcgaccggattcatagagacggctggcgcagcagagcagcagattggttttgccgcttccgcatgcgccaatcacggcgatgttgccgtgtcctacgtcaaggaatgcggtggagatgagtacaccgtcgtcgctcaaagcaaaaggcacatggtgccatgcctctcgctgtggcgccgtcaaatcgtctttgcctgcatgtggtgcgagcggcgcggagaacaaaggggagggattggtggtgccgctgaatgccgatgcggtgttgatggcatgcaccaaggaatcaatgtcatggaccgcgctgcagcggaaaggaacagtgcgttgaccgtcatgacagtaagcggcaccggggaaggccggtggaatcaaagctgcatccttggtgccgatcagttcattcgattgcatttggtcggtgacgcgtaggcagatgctcagcgatatgttggccttcatatcggcatggacctgacccatgggattttgcgtgcatacgatgagatgcatacccaaagagcgtccgagcgacgccaatcgattgagtcgctgcatatagtcgggtagacggtcgcgcaatgcatggaattcgtcaatgaccaccacgagccgtgcagggggatgggaaagctggtcgaatctggaaacgcgttcggcacttaccaaggcctccctgcgtgccaattcttgttctatggcgttcagcgcacggacggcatgggcgaggtcaagatcgcagacgttgcccacggtatgcggcagacgctccaaagcgttgaaggtcgatcctcctttgaaatccagaaagacgaaatggagggtttgaggactatgccgaatcgccaatgccatgcaccaactgatcagcagttcggatttccccgagcctgtggtccccgcgaccatggcatgtggtccggatgatgccagatctatatggaatatgccatgttctgacatgccgatgccgttcgttggggaacggacaagccaattacgcacgatggtgcgccatatgagcgggtcgttgtccaggccatgcagatgctcaaaacttatggacggcatgtcggcgaaaagctgagcatggtcgatttcgtttccgttatgatgcgttggaaccggcgaatcgcttccagtaatggtgttgctgttcgtttcttcatgcctgacgcgcatgatcatggtgatgagcatcaatgcgctgccgagcagactcggagcgagcatcgccgcatagagccaatgacgttgcatgcacatgacaatcagcatgatgagctgcgccagcaaaggcgcgctccaactcaatacagtgagatgttgttcgcttatacggtgaggggcctttttgttcatacggccagcatgggcaagagcggcggcatgccgcaagccaatatgagggttgtggtcggagaatgtgggttatccacatcctccggcgtgtcgtcagttttgctgttcggccagcgtgcccacggttcctgcggaatgcgtgccgtgtgagagttcggagaaaagctggatgttcttcgcgtcatccagcagaacgcacgatccgaccccatcgacgtaatagtccggatcggtccaatacacgcttcccgaaatgccatccttgcctgaggcgcttttgaaagccaacgccatccgaagcagagaggaagtcgatgctttctcatccacggttacggagctcaacgccgctgcggcgacctttttggtcttgttgaaattcgtgagcgtctgtttggaagcgcccttcttgacgatggcgttgatcacctggcgctgacgtgcggcacggccgaaatcgccttgcacatcggcatatcgcatacgggagaacgccaaagcggtgttgccgtccacggtgtggcatccggcggtccagttcatacccgaataagggtcattcacattctggtcgtagcataggtccacgcctcccaaggcatcgaccactttgacgagtccgccgaagcggaccattgccacatggttgattttctggccggtgatgtcctccacctcattgaccaactgtttgcggctgtacagctgcgccacggcgttgatcttcatatagctcccatcgatttccaccagggaatcgcgaggaatggaaatcagcgaggacgatcctgttttcggcttggtgagtacaagaatggtgtcggttctgaaaccttcgacgtcaccggcatctccgatggtgccctcacgttcgtcggagccaagaataagccagctttcgccggcggtgtccgctttggatgtcagccaggtctgtttgttgagctggtcatcgacccagttccaagcggagaatacccctattcccagtgcgagaatcagtacaaggaaaatggaaaggacgatacgtccgacgcgaggtcttctttttggcacggaagccgtcgctggagaggatggaacagatcggagcgccgtggagacggaggatgacccccggaactgctgcgttggattggccgtgcgggtatgttctggagcgaaggacaccggagatgatgaagggtttcttcttgtctcgctcgttgcccgtgccgcaggctggaagctttgcggaaccgaggaagaaggacgcgccgtgcgtttggccggttttacggatgatgcatggtcggaacgtttcgccggtgcgaaactcgctggctggctcggtgcgctttgcgagcgggaggaatccgtggacggcatggtttttttgcgtcctgatgacggaatgaaacttggtggcacgctcgtaggctcttttgctcctttgccttcactcatggttcctccaaaaagattcgtccctgtgtcatacgttgaaaggggacgtgattgcgtggtctacgtcagttctttgccggaacggcacatacggtcgcattaaggtatcgatccgcaagcccgatgtactggcccgtggtcgcgtcatgaatggagccgtcatccgggtcgacggtgccgccagtgctcggatcgaccaacgtgccgtcggatttggtgatcagtcccgtgacgggatcgggagtctcggcagtggtgtccgactggttgctgtcggtcgtgccggaatcgtcggagctggctgaattatctgaactggtgtcggaggagccgcccgagtttgaatcggcggtatcgaaaatcggcttgcccgctcgcatcttctcccagagattgtcggcttcgtcggtccagacggaacggttggggtcggacggtgctgggaccacggggacggtctgggtctgcaggttggtcatggtgaaattcttcaggctcatggcaagtcccgccaaagccgcggtatcagccatgccttgggatatgttgagcgatttcagcgcggatttcgccagctggtacagctgcgcggtatcagtgaacagattcttgctgagcgcctcgctcatcagctgcttgatgagatactgctgacgtgtggtacgcgaggtgtcggatccgtctcctatgccgtgacggatccgggcgtactgcgtcgccgcaacgccgtcaagatggtgcatgcccttgtcgagattgagtccggtgtacgggtcgttgacgttctgcggaatgcacaggtccacgccgccgactgaatcaatcatcttgaccaggccggcgaagtccacgacgatgaagttctgaatattcaacccggtgagactgttcacggcgttcagcgtgcagctggccgccgaggagagatctccgccggttttgtaggcacctgcgaagatggaattgaacatgacgttatactgtgcgggaatcgtgcccttcgacgtttcgcactgaggcacgtccaccagggaatctcgtggaatggagaccaggttgatttccttgcggtcggcggagatctgcacaatcatggcggtgtcggcctgatggttgccgatgacgtcatcgaaactgcctccgatggcttggttctccgcgccgtcacgggaatcctgtccgatcagcacgaactcgatcggcttgccggagttcggatcgatgatggatgcgtccgtattcagggaaccctggccgatcacgccgaccgaattgttcttgatgatgccattgacgtccatccaagtagcggcagctgcagtgccgacgaacaccagagtcgcggcgattgccgcggcgactgcggtcctgacgtgatgctgcacgcgatatcccaggctgtgacgtggtttcgcatcctgaagaccattgatgttaggaagcttattgccggttgatgacgttgccacggtgttgccttcctgattgagatgcgcgtttgacgcaatgcttttagaacctaccactatccaaatgggcaattatagggttaatggccgattttcaccgattctgcgactgtagaccccagattgggctgaactttagcatggattttctgaaatataggcattgacacggggaaacttgacaaaattacattgcgtgtgtgtaatttgaagcggtgtgaaagtatgcgcataaaaggtgcgcacacaattatgggaggactcatgtggggcgtgactgatgagtcttctgagaatccgcttgctgaactgtggggtttgttcaagcgggatgatgacgtgtcttggcagcacaaagcgctgtgctcgcagaccgatcccgaagcattcttcccggaaaaaggcggttccaccagggatgcgaagagggtttgcgcccagtgtgaagtccgtgaacagtgcctggaatgggccatcgaccatgatgagcgtttcggtatctggggcggtatgagcgagcgtgagcgtcgtcgctacaaaaaagagcacaaggaacgggcttgaaggcatggtgcgtcccgtgcgtacacttaaattatgaattctaacgccagcagcgatatccagacaatcgtgaccgatgtgctgaacagcagaccgtatacgcatcggcaggacgtcgatatgtccgtggctgcggtgatcaccgcgcagcatgaccttcgattcctcgcttctaccgttggagcggtgcttgcgcagcgcatgcttccaggaatgatcgttatcgccgattgcacggggcagatcgagcagcccatgcagatgaccttcgatgtcattcactcatcacaggatgtgcttacggaagtgccggaagccaaaacggtgagggtcattctggtgggagtgaagcaggcggcgtccttcatggacgctgtaacgcgtgcgatggatcagatcggcattgatgccggcatccgcgcgttgtggaccttgcatgacgattcgcggccggcggatgaccggtgcttcgagacgttgctggatgcgtggagaaacacgccgacagccgcgctgctcggtgccaagcagttggattggcaggcgaagaacctgcacaatgtgggtttgtatgccgggcaccatgatgtcgtttccttggtggtcgacggcgagcctgaccaggagcaatatgacgggcgtcaggatgtgctgtcggtctccctatcgggcgcgttggtgccgttggctacgttgcgtgcgttcgaaggggctgacccctggttcggcaccttcgcggaatccacggacctgtgccgccgcatatgtcttggcggtgggcgtgtcgtagtggttccccaggctcgcatcgcccacagaagagcccgattcgaaggaatccgttccaagaacgggcgccctgtggaagacgaggacggtcgcatcgatccgtatcttgccgtacgcgaggcgaatgccaaatacgcgtacactgacatgcaccgttcatggtggccgttgctttggctgtggtccatcatccagtcgttgggattggccgtgctttgcttggcgcgcaaacagccgtatcatgcatgctgcgagctggcgatgccgtggcgtgcgctgctgcgtctgcggggtgcttggcgcgcccgtgcgcggttacgcaggcaaagcaaggtcacgcttaaatcgctatccacgctgtctgcgaatcatcggcaggtcagggaatggctcgaccgtcgccgtgcgttgcgcgaccagagggatgtcgtgctgctcagtcctcttgagaaggaccatctgcgtaaacggttgctgcgtagatggggattggccttcggcgcggcgctgattgccggcatatggatagtcgtgctgtattgggacgtgcttcgttccgtatgttcgggtgcgtcgatgtattccgcacagctgttgcccacgggcgcgagcttcacccagttgcttcataccgcgaccacgtcatggtcgtatgcctcaggcacgggcatcagtgcgcctaacgcgccatggctgttggtgcttgcgctggcgtcggtgctcactggtggacatgttgccggagctgtcggactgatgttcttccttgcagccccgctcatggtgttttccttctgggcgctggccggcatcttcacccgctcggatgcggtgcgctgcgtggtcgcgttggcgtggttcgcgttggcgttgtccatgggactttatgatgacgcggatgtcacgatgctgacggtcatggtgtttcttccggccgctttcgccttctcgttccgtgcggtcggcatgtatcggacggaggatctggtcaatccccacgcgtcggtccaggcggcggcggttgcggcgctgtgtttcattccggtcgtcgccgcgcagccgcagttgttgctgccgctgatgctcaccttcctgggattcctgctgttcgtccgctcccataagcccgcgttgcttctgattccgcttccggcggcgttcgtatgcgcgccgacgttggtcaatgccgttcgtttcacttccgacggtacatggcgtcagctgttcggcagcgtcatgctgccctcctccgcgtatgatggcaaaccggtcgtcgcgaatctgtccgatctgttgctgcgggtgttcggcatcggcgccgacggtggtgcatggcggtatgtggcggtttccatactggcgttgatcgtattgctggccgcggtgtcattggtgttgcctttcgtgctgcgcgtgtcccgtatgatgtgggtcgccgtgttcgcgggattggcgacggccttgctgtccgcggcgattgcggtggccgtcgatgtggatggtccggtctccggttccatgcttccgggaaccacatatgcgatgatgggcttgctcgcctgcatctgcatgatgtcgggcggcgcggttcgacgtttcgtcatgctgagacagcatgagaagaccggcgccgtcgaaatcgaaggacgcggctcgaaggcagtgtcgattgcctcgcatgtgggtcgtgccgtattggtttgcctgctggccgtctccgtcgtggcctgtgcgggattcaactatgtcgaatgcgatcacagccaggtaaagaccagcgatgctggactgccgatggtggcgaccgatttccttgggcaggatgatgcacgtcgcgtgcttgccttgcgtgccgatagcgccgagtcggtcagctacagtgtgatgcgtaccggtcgtggcgacttgattgacagctctcccgcgcaacgcgtcgaagtggtttcgggacgttccgacgggtccagcagaaccattgcgcaggattgcgcccagttgctggccaatgccgattccgatgccatcaacgagcttggcaagttgggtttcggcggcatttacgttatcaagcagaacggcgacaaagcgcagcgagaggcctcgaaccagctcaattcgaacattggagcctccgacgggacacagaatgtcgtcagtctggataatggcacgtattatcgtttgacggttcaggatctatccaagcagcatatcgatcgaagcgggcttgataaggccggctcaagtgtgtggcgtcgttcatggctgtggtgcatgggcgtcgttcttgtagcgtattgcctggtggcgcttccgcgcattcgtcgtcagggtctggaggaagcatgagcagacattctcgtcccaatacgcctttgcgtattgcgcttgccgtaatctcagtgttgctcatcgtggtcctgatggccgtgacgctcatataccggccatcatggctgcatgcggacacgcccacggtggaacgctcctcggtgggtcgtaccgtcagcccccggcagcggcagacgtactgcccgtctcgcatgaccattgccgataccgatgcctatggagatagcgaataccaggcatccaacggcaatatcgcgtcttccgcgagatacgccgccttcggttcggtgttccattcatccgtcgcctcgatgggagccgacatgacggcatccgtgtcgatgctggacaaaaaagacgactcgtccgatgacatctttgtggcttccggcaatgtcgatgacggctctcgattgcaagacacgcgtctgctgacggcttcgaacggtaccggcgcggtttcctcagtgatgtcatgggccacggacggtgatttgaagggcgtatcagcagcctcctgcgtcgtgccggcgctgaaacaggcgttcctgctttccggtacgaagaccggcttgacgcaacagcttgttgtggccaatccctccgccaaggacacatcggtgaccatcagaatctggggctccgacaaatccggcgcgctggcgctctccaccggatcgacgctgaccgtggcctcaggcaaggaaacggtactgaatctttccgcagctgcttccggccaagacgcgctgtatgccacggtgactggaactgacactcctgtggccgcaatcgtccgcaccgtctccatggacggattgaccccaaagggatcggattatgcgcttccgaataacgctttcgcgaaatctctggccctctacggcttgaatggcggagaccatgcgacactgtacctgtatacgtcccgcaaaacggatgtcaccgtatcctggattgactccaagggggcgcagcagaccaatcagcaggagctgaaggcgaaccgcgcgtccgccatcgatcttggagacgttccaaaatccgctaccggcatcgccatagccgcttccgaaccggtgtctgccacggcgaagatttcagacgatggccccgatggacaatccgatttcgccctagtcaatgcgtccgctccggcgaagatctccgccatcgcggttcctgaccaatccaccgcgacggtaggcttcgtcaacaccgcggatgaggatcggacagcgatcatgacggcttacgacacggacggcaaacaagtggacaggcgtgaaatcgccatccgtccctcggcttcgacgtcggtgcgcatcgccgatattaatgatggcgatgtcgccgccatccgtttgaaggatcccgcccaagccgtggtctggaatcttcgtgtcggacagaaagatgtgtccggtgcgaaactcgccggacttgccatcatcggcgccgtcgatttgaaggaggccagagagcagatctgggcgaatcaggatatgactgttgtccgttgaaagtcacatgccccaatcaggatctatttcttccggacggcgtccgtagatttccgccagacgtgagaccacctcgtccctgattgcgaattgcaggtccatacggttacgggcatgcgattgcagcggcatgcggtacagcacgatacggggtggaatgccgtgtccggcggggaatgactgcgatccaagatgcggaacgtcctcccaaggcgcgggatcggatggcggaacatcctccacagcgaattggaccggagctatgagttcaggccatgccccgttgagtctgcggatttgcgccaccagcatatcgtcgaacataccgcttctggtacggtaccggggcagtctggtaccaaacatgggcgtacgcgtgccacgtccatggcggttgcggtatatcggggtctcccaaggcatctgttgcatggtttctaccttatcagggcttattcgaaacatgcgataccatggtatgggctgctcgacaaggggagaaatgatcatggcggatatttccgtaccttattggaacatcgttgatgtcaacatgttgtgcgaaggcgcgcggctgattgggtttgacctcgacaacacgttggcgcggtccaagaaacctatgaaagcggacatggccgaatgcttctctgcattgacatcattgattgacgtcgcggtgatcaccggcggcaaatactcgttgctgcaaagtcaggtggtggacaggctgtccgaccatgccgacaagtcgaaacttcacctcatgccgaccagcggaacccgctactaccggtgggacgggcaacggtgggggaaagtgttctcccacgatctaagcgacgaggaccgtgccaaggcgaaggaatcgctggaacggaatgctcgtgagcagggcatttgggccactcatgtctggggcgagcgcatcgaggacagaggcagtcagatcaccttttccgcattggggcagcttgcccccgtcgaggccaaggaggcatgggaccccaccaacgagaagaagaaccgattggcctgtgcggttgctgccgaactaccgaatcttgaagtaagacctggaggctccagcagtgttgatatctcacagcgtggcgtcgataagtcgttcgccgtccgtgaactcgcggatattctcgatatcgaggtcggtcagatcgtgttcatcggagaccggatggaacccaacggcaatgattatcccgcggcgaaggccggcacaagggctgtcaaagtgaacggtcccgcggataccgtgaaattatgcggcgagattatcgccagattgtcccgatggcggagccggtgtgaatctgatggcgggctcattcgcgcatatggcgaatctgttgttcccacgaggctgtgcgggatgcgacaagcctgatgacgtgttgtgcgatgcctgtcttgcgtcattcgactgcgaactgtcccagccattggaaacggctgagatgggtcgatggttcgcgtgcggatggtatcggggtgccgccagacagtcgattctggcatggaaagaccacggagacgaggaatgcgaccgtccgttctcggatgcgttgtgcaggcttgcggaacgcgccggtgtgattgatgccatggatggcgttcgtgagatctgcgataccatactggtcgttcccgcgccgtcgtcgattgcttccatgcgtcagcgcggacgacggcacatgatgccgctggcaaaacggttgtcggcgtttctacggtgccggacaggtttccgcgtacaggtatgcgatgcgttgacgaacaaaggaatcaaaggcaaatccgtcgagaccaagggcacggaacagagggcgcaacgccttaaggggcatgtcatggttcgtccgggcgtcacccttcaaaacaaggcggtgattctggtggatgacatcgtcacctctggagccaccatgcgtcgttgtgttgacgctctaacttcacagggagctttggtcattaccgtgctggcgttggcacacactccggccggcagacctttggcggcgtaaatcgtcactcgtcatcggaaatgtgatatttcggcaaagtgatttcgaaatcggcgccgcgcggatcatccaccactcgtaccgtgccgccatgcaattgcgccgcccatcgggcgattgacagtccaagaccggttcctcccgattcggtacccggtcccgtcttgcctttgacgaatcgacggaagatatcggaccgcgcttcttggggaatctgcgagccgaagttgacgacattcgtcacaatcgtgccgaaatccttgttttcatgcgcttcgatgagcaccgcggtattgtctgcggagtgtttgagcgcattggcgatgatattggtgaacaactggcgcagacgatcctgatcgccttccatttcgatgtcgtcgggcacgtggatttcgatattgtgggcatgcccggcatcggcgatttccaacggttccacggtttcgtcgatgaaatccgcgaaattgaatttatcgatctgcaggctcgccgcaccggcttccatgcgggacaaatcaagcagaaacgcgatcagatccgacaaacggtgcgtttggttgagaatgctttccagattcgatggggtcggttccacaacgccgtcggccatgttctcgaccatggcctgcaacgcggatacaggcgtacgtagctcgtggctcacattggccaccatgtcccgtctcatctggtcggcatgctgcagttcctccgccatctcattgaaagacaaagccagctgtccgacctcgtcgcggctgttggcatcgacatgcacccggacggtgtagtcgccgtccgccatagcctccgcggcatcccgcatctcgcgcaggggagaggtgagtcccctagagaagaaataggtgatgcccaaagccacggcaagggtgatcggcatggctatccacaggctcaatccgactttgagcaggaaccaagccatgatgaacgcgatgatggtggaaatggtgatcagcacgctcaattccattttgagcgaagagaacaaaccaatagggcgttcggtatccaacggattgaccgaacgccctggttttgaatcagtggtacgcataccaccaaatcttagcgcatcatactattcttccggatcttagcgcatcatactattcttccggcggttcgaacgcgtagcctacgccatgcacggttcgaatggtcttcgaacccagcttgtgacgtagcgccttgacatgcgaatccacagtacgggtgccggacgcatccacccaatcccacacttcctcgagcagcttctcgcgagtgagcacggacttcggtttgcgggccaaagtggccagcaaatcaaattccgttggggtcaaatgcacctgctccccattgacggtgacgatacgctgggccggatcgatgaccagagagccgaaatcaagcagtttctcgttttcggagttcttggcgatgaccttcgccctgtccacacgacgaagcagcgccttgcaccgggcgatgagctcgcgcatggagaacggcttggtcatgtaatcgtcggctccggcaccaagaccgatgaccttgtcggcctcgtcgtctcgcgccgtcagaatcagcacaggcacaggacgttcagccacgatgcgcttggtggcctcaagaccatccatcacgggcagcatgatatccatgatgaccagatccggacggagcgtggaagcggcctggacggcgctggcgccgtcggaagccacgcgcgcggtccaaccctccgcagtgatgcgctgcgcgatggcggtggccaaggtcggttcatcctcgaccaccagaacggtacgtggaattactgtggattgtgctgatgaattgagcatagcgttccgcctttctcagagttccggcttcaagaatactgctcccagtgccggaacggtgattttcgcggaccaatcacgggaatgatactcacccttgaccgccttgaaggtgccgttgtgaatatcggaaccgccgtacttcttatcgtccgtggtcagcacttcggtccacttgccacccttggtgagcggaacctggtaatcctcccatgcctcgcccgagaagttcacgacaacgaccatctgctcgccatccttgccgatacgcacgaagctgagcgtgttatggtcggcgtcatcgctggtcagccattggaatccggcaggatcgaagtcctggctccacaatgcgggagacgccttgtacagggtgttcaggtcggcgacgagcttctgcacgccacggtggtcaggccaattgagcacatcccaatccaccgaaccgtcatgatcccattcgccgtactgcgccacctcattgcccatgaaggagagcttcttgcccggatgggcccactgataggcgaacagcgcgcgcacgccggcatagcgctgccagtcatcgcccggcatcttgccgaacagcgagcccttgccgtacacgacctcgtcgtggctgatcggcagcacataatgctccgagtatgcgtacaccatggagaaggtgatctcgttgtggtgccacttacggttgatcggctcctcgtgcagatactgcagggtgtcgtgcatccaacccatgttccacttgaggccgaagcccaaaccgccggcatcggtcggtgcggtgatgccgggatacgcggtggattcctcggcgatcatcatgatgcccggattgttcttgtacgcggtcgccgtggcttccttgaggaagtcgatggcctcgaggttttctcgtccaccgtagatgttcggatgccactggcccggcttgcggctgtaatccaagtacagcatcgaggagaccgcgtccacgcgcagcgcgtcgatatggtactcgtccagccagaagcaggcgttggccaccaggaagttgcgcacttcgcggcgtccgaaattgaacacgtaggtgccccaatccggatgctcgccacgggtcgggtccggatcctcgtacagaggcgtgccatcgaatctgccaagggcgaacgcgtccttcgggaaatgcgccggaacccagtccatgatcacgccgatgccggcctcgtgcatcttctcgacgagatacttgaagtcgtcagggccgccaaggcgcgaatcaatcgcgtaatagccggttacctgataaccccacgagccggagaagggatgctcggccagcggcatgaattccacatgggtgaaaccttccttctggacgtaggggaccagcttgtcggccagttcgcgatagttcttcacatccttgcgccagctagaggcatggacctcgtagatgctgaccggaccgttgtgcgggtcggtcttggctcgctggtccatccagttctcgtcatgccacgcatggacggagtcgacgacgatggaaccggtgcgcggcggaatctcatgcgaacgctccatcggatcggccttcatgacccattcgttgttggcgttgaggatctcgtacttgtaaatcgttcccgttccgacaccaggaatgaacagctcccagactccagaggagcccagttcacgcatggcgtgggtgcgtccgttccagccgttgaaatctcccaccacacgtaccgcatgggcattcggagcccacacggtgaatgcggtgcccgccagctgttcgcccttgacgccgtcattggagcccaacggatcgtcatagcgcagcacgcgcgctcccaaagcctcccaaaggcgctcatggcgtccctcgccaaacaggtacatgtccaaatcgccgatggtgggcagataacggtacgggtcgtcggacaccacggtggaaccgtcttcatattcggtgctgatgcgataatcgggcacgccgaagccgtcatcggtcttgatggccggaatgagtgccatgaaaacgccattgtgttcatgcaccgcctgggttcgggcattttcggtgatgatcgtcacggatttcgccaacggacgaagcacgcggatcgtgacgacatcctcatgctcgtcgggaccgagatgcccgccgagcacctcgtgtggattgtagaacgtaccgttgcttactgcatccaggtcgccctgtgcaacaggaacggcaacgctatcttctttgatcttggattctgtagccatgggaaaagtgtaagcatgaaatgcttgaaaattggcccgtgtcgcgtctttttttggttttttggcggatttttaggcaagtccaaccctgatggcacaataattcgggttttgtgtaagcttttcacggaggattcatgggttacaaggtcggcgacatggtcgtctatccgcgtcacggcgcagcgaaggtggaggccatcaccgagcgaacggtcaagggtgtgacccgagaatatctgcagctgtcggtgctgtcgtccgacgggctggtcatcaatgttccggtggagaacgccaagaaagtgggtgtccgagacatcgtcggcgccaaggaggtcgcgaaggtcttcgagattctgcgtactccgatcatcgaaaaggaaatgaactggtcccgccggtacaagctgaacgtcgagaagatcgccaccggcgatgtgaataaaatcgccgaagtcgtgcgagacctcgcccagcgtgatgtcgacgagcatgggctgtccgccggtgagaagcgcatgctcaccaaggctcgcagcatcctgacttccgagatcgcgttgtcggagcatcttgatgagaatgaggcccagcgtctgcttgacgtgaaccttggttatgaaccgccgcgccctggcgacgaggatcatcacaccgaagctcctgaagaggcggccatggacactttggcgcgcgtcgaggcggagaacaagaagtccaagaagaagtaagggaatttccatgcgtatcggtcagggatttgacgcccatcgattcgcgtcccatgatgcaggcaagccgttatggcttgcctgtttgcgttgggatggtgacggcatcgaaggcgattcggacggtgatgtcgcagcccatgcgttgattgacgcgttgctttccgcagccggattgggtgatataggcatgcttttcggagtcggttccgattccgccggtgccggcaaacacggcgacgagatgctccgcgcgacggttgcgtatttgcgtgcgcatggcatgaggccggtgagcgcaagcgtggtcgtcgtggccaatcgtccgaaaatcggcaagcgccgtgacgaggcgcaacaggcgttgagccatgccatcggctgtgaagtgtcgctgacggccaccactaccgacggcatgggattcaccggttcgggcgagggcatcgcggccatcgccagcgccttggtggaaccgatcggctgatactttcgctacctgcggcgtgccgattcgattattttggcgacaatccagaacagtgtggaaatcgtcacgatgatgaagctcgggggagcggggaacatggcggaaaccaacagtccaccccaaatggagatcaaacagatcacggtggagacgaccatcgcggcgaatggggaccgtgagatgatgttcgcagtcgcggcgggcgtgaccacaagagcgaatatcagcaacgtgcccacggcgggcaccgcgatggtgatcacaccggccataatggccatgaagcagatgttcatgagattcaccggcacgccttttgcctgcgccacctgttcatcaagcgagctgaacagcagcggtcgatagataacggccaaaacggccagcaacaacacgtcgaaaaccgcaaacccgacgatctgcccgtccgtgattgtcaggatggagccgaaaagaatcgattgcatctgctgcgaggcggaactggacaagcgtgcgaaaaacagacccatgcctgtggcgaacgccaatacggttcctgtggcgatttcgcgttgcgatgcctttttgcccaatgcgccgatcaccaatgctccgccgagagcgaacacgccgagaccggcactgaccggcagactcaacagcacggctccggtcgctcctggcagcccgatgtgcgccagcgcatgcgcggcgaacgtggaatgacgggcgatggtgaagtaacccatcactccagcggccaaggcgatgcacaggccggcgaggaaagcgtttgtcatgaatggcgcggtcagcgtgcccatccaatccggatcgaaggagaaagcggtttcgttcatgatcatgcctcctgcgaaatgcggttgtgtcggtggaatcttgcgatttcctccggcgcgtgggcgtcgacgtcaatgtcatcaggctcatcctcgcttggagtgacgaacatatctccttggggagtggtgaccacctgcaccgtggtgccatatagatgggtgagcagcttcgaatccagcacctcgttcatcttcgcataatgcggatgcccgtcgagcagatatacggcaccggtgagaatcggcagaagcatgttcaaatcgtgcgccactacttgaatggacatgccgagttctcggttgagtttggcgagcacgtgcaccgtggcacgttggctggccagatcaagattggcgagcggttcatccaacatgagcagttgggggtccgacaccagcgcctgcgcgatggcgacgcgttgccgcaggcctcccgagagctccgacagccggtatctcgccttgtcctgcatgtcgacgaattccagcgcattgcgtactttgtctttttgcaggcgggtgatgggatgaatgccgaaccttgccccggtcaggccaagcagcaccgactgttcggcggtgatgttcgattcgatgtcggatgcgtagctctgcggcacataccctatacggtgattcatggcgccggccggcttgccgagtacggttatgccgccgtgggcgatgggaatcaatccgagttcggctttcatcatggtggttttcccggttccgttggtgccgacgatggctgtcaccgagccttgcgggatacggaaggtgccatgctgccagatgatgtgtccgccgcgtgagacccctgcgtcgtcgaattcgatacagaatgatgccttgtcgtgcatggctcgctcccttgataagtcaacgatagtattctcacaaacggtgttgacaatcattctcaataagaagcatgcatggacgatgaaaagtctcatgatgaatccgcctggatcgtaactgttgctgggaaaaagaattcgccgatgtcggggaattgctcgacatcggcgaatcggggggagggaggatggccgtggctttatttaccaggatccgtctgccctgtgttgtccggcgttgcggcgtcggaatcggagtcgggattgtcgctcgacggctgctcgccattcgattcagagggagagacgtccgaatctgatgatgtcgcatcatctttggaggaaaccgcctcattcatttgcttgatgagctgcgcgatccatgagatcaggcttttgctgtcggccggcatctgttccgtgacgtcgatgaccggcacatcggatttgtgtgcggtgccggtcagaatatttgtggcatcctccgccttctgaacattgttgatcagcatatccacttgatgaccctccagaatcttctggaagtcctggagttccttggacgagggctgagagccttccgagatggactgcgtgtagctttcgggagtcttatcggataggcccatgtcgctgagcagataatatgcgaccggctcggtggctgcgtaggagacgttcttatgcgtatcggagaactctttcatgcttctctcgattaccgtctcgcgtctgttccacgccttgagtttgtttgtgaaatatttcctttgcttgggcatgatgcggctgtaggtgtcggcaagctccttcgccatggcgttgcgtgcgtcgctggagaaccagagatggggattgtctccctcaacggctccgaccatttgcgcggccgaaacggaaacggtgtctctttccaggttttttgtggcccaggagtcgtatcccgctccgttggacacgacgacctgtgccttctgcagggtgtcgacagcagtggtcttcggttcgaacgtgtgggcgtcctctgttgtggaggacagaatcgaggtgactttgacgtgcgcgccgccgatctgctccgccagagccccccactggttgaccgacgccaccacgttgatcggggtggtctgctcctttggtgcgtcgggtgccgttggttgattgggctccgaagaagcgccaaagcaggaagcggtgcccagcacagtgcacaatgtgattcccgcggcaaggatgcggaaaaatggacgctggtgagagcgcatgtcgattgccttcctcttgggtcgtccgtcgtttcggtcgtgtccatctcatatagcacatgcgcgacttacgactgaaaccaagatagcctacgatacttgcaaatgccaatacgacaagcgacttagcgaggaagtggaccacatgggaacaaggattgatggcaaaaaggtggcggcacggaccaaggcggacctcgccaaacgcgtggaactgctgaaggcgaggggaatccaacctggattgggtaccattttggtcggatcagaccccggctccgtgaaatatgtcgccggcaaacatgccgattgcgccgaaatcggcgtgaattccatcaagcgcgagctgcctgagaatgcgacgttcgatcaggtcgccgatgcggtccgccagctcaatgcggatcccgcctgtaccggatatatcgtgcagctgcccttgccaaggggaatcgacgagaacgccatcatcgatctgatcgatcccaagaaggacgccgacgggatgcatccgtataatctcggcgaacttgtgctgcatgcccgaggagacatcaccacgccgttgccatgcacgcctcgcggcgtgatcgagctgttgcgcgcctacgacatcgatttggacggcaaggaggtgtgcgtgctgggccgtggcatcaccatcggccgcaccatcggtctgttgttgactcgtaaggcggtcaacgccaccgtcacgctgtgccatacgggaaccaaggatgtgcgtgaccacatgcgacgggccgatgtgatcgtcgcagccatgggagtggctggtttcgtcaagccggaagacatcaaggaagggtcgattctcgtcgacgtcggagtatcccgcgtgttcgacgaggaatccggccgatacaaggtcaagggtgatgtcgataaagcctgttacgagaaggcttttgcatacacgccgaatcctggaggcgtagggccgatgacgcgtgccatgctgctgcagaatgttgtggagatggccgaacgtcagttgtgagtttcgcgatagtgctttcgggcgtgtcgtgacatgcgacacgcccgatttttgtgcatggcttcttgtagactttcgccttgtgtgtatttgcgcacacgtataactgaagaacgattttatccatccactattttgtaagaaaccacattaatggcagagaacaataacgaagtcgccaaggtcgccatcaacgacatcggcaccgaagaggacttcatcaaggcagtcgattccaccatcaagaacttcgatgatggtgatctggtcgaaggtaccgtcgtcaaggtcgatcatgacgaggtcctgctcgacatcggctacaagaccgagggcgtcatcccctcccgcgagctttccatcaagaaggacgttgatcctgacgaagtcgtcgaggtcggcgacaccattgaggcccttgtcgtcaccaaggaagacaaggaaggccgtctgattctgtccaagaagcgtgcgcagtacgagcgcgcttggggcgacatcgagaagatcaaggaagccgatggcgttgtcgaaggcactgtcatcgaagctgtcaagggtggcctcatcgtcgacatcggtctgcgtggcttcctgccggcatctctcgtcgagatgcgtcgtgtccgcgatctgtccccgtacatcggccagaagatcaaggccaagatcctcgagctcgacaagaaccgcaacaacgtggtcctctcccgtcgccagtacctcgaggagacccagtccgaagtgcgcgagaccttcctgtcccagcttaagaagggccagatccgtgaaggcgtcgtgtcctccatcgtcaacttcggcgcattcgtcgatctgggcggtgttgacggcctgatccacgtttccgagctgtcttggaagcacatcgatcacccgtccgaggtcgtcaaggtcggagacaaggtcaccgtcgaggtgcttgacgttgatctcgatcgtgagcgcatctccctgtccctcaaggccacccaggaagatccgtggcagcgcttcgcccgcacccacgttcctggccagatcgtcaagggcaaggtcaccaagatcgttcagttcggtgtcttcatctccgtcgaagacggcatcgaaggcctcgtgcatatctccgagctggccaaccgccacgtggagaacccggagaccgtcgtcaagccgggcgaggaagtcttcgtcaaggtgattgacgtcgatctcgaccgtcgccgcatctccctgtccctcaagcaggccaacgactccgttgatccggcttccgaggacttcgatccggctctgtacggcatgccggcagagtacgacgagcagggcaactacaagtatccggaaggcttcgacccggcaaccaacgagtggatcgctggttacgagaagcagcgtgaggagtgggagtcccagtacgccaccgctcacgatctgtgggagcagcacaaggaattcgttgccaaggaactcgagaacgccgaggcttccgcagccgaagacggccaggctccgaaggaagagaaggtcgaagaggtgtccaactactcctccgacaacacctccaacggcaccctcgccgattccgaccagctcgccgctctgcgcgaccagctgctcggcaagtgagtttcgacgaatcaaaataaactgattcgcgtaaaccgctgataaatggccccgcacctgatggtgtggggccatttgcgtatgttgcgagtccgtcaaacattacaatggcggttgtgatgattcgaattgggttgaccggaggcatcgccgccggcaaaagcaccgtcgctacgcatctgcgtgaactgggcgcgacgcttgtcgattatgatgtgctcgcccgaaaagtcgtggaacccggaagcgtgggcctgcaacgaatcgtggaacatttcgggccggatgcgatgaacgcgcaaggtggtcttaatcggcgatggatgtccgaacacgtcttctccgatccgaatgccgaatccgaacgtagaatccttgacgatatcgaacatccgttgatctacgatcttgcattgtcggaggaacggcaggcggtcgaaaagaatccggatgccgtggtcgtacatgatattccgcttttggcggaagtaatcgatgacatacccatgcgtttcgaccatatcgtaacagtcgaagcaccggaacagacgcgtgtggaacgtatgatgcgcacccgtggcatgagtgaggcacaggcgaaggcacgtatcgcgcatcagcccacgcgtgcggcacgagaatccatagccgatgcggtgattgactcatcccaggatgtagaacacatgttcgactgtgttgataggctgatggaacagtggcgtaaggaagcgagacggaaccatgggattcaacattgaacgagtgaacaagccgtttgtggtcaaatctccatataagccttcaggcgaccagccgaaggccatcgaggagctggccacgcgcatcgagaatggcgagaacgacgtggtgctcatgggcgccaccggcaccggcaaaaccgccactacagcgtggctgattgaacgtctgcagcgaccgacgcttatcatcgagccgaacaagacgctcgccgcgcagttgtgcgccgaattccgcgaactcatgccggacaatgcggtgagctacttcgtttcctactacgactactaccagccggaagcgtacattccccagaccgacacctacatcgagaaggattccaacatcaacgacgatgtggagcgattgcgccacgccgccaccgcgaaccttctgacccgtcgcgattgcgtggtcgtggccaccgtctcctgcatctacggtttgggaacgccggaagaatacgctggccgtatgctgttcctccaggaaggccagcagatcgaccgtgacgatttactgcgcaaattcgtggacatgcaatacaagcgcaacgacatcgccttcacgcgaggcacattccgcgtgcgcggcgacaccgttgagatcatccccgtatacgaggaactggccatccgcatcgaattcttcggcgacgaaatcgaccgcatctccactctgcatccgctgaccggcgacgtgatcgcgcacgaatcgcaggtgcacatcttcccggcctcgcattacgttgccggagcggaacgtatggaacgggcgctcaaaaccatccaacaggaacttgacgagcgtaccgccgaattgcataagcaaggcaaggaacttgaagcgcagcgtctcaccatgcgcaccacatacgatctggaaatgctctcgcaggtcggcacatgctccggcgtggagaactattcgcggcatttcgacggacgcgcgccgggcacgcctccgcacacgctgcttgactttttccccgatgatttcctgctcgtcatcgacgaatcacatgtcaccgtgccgcagatcggtgccatgtacgaaggcgacgcgagccgcaaacgcacgctggtcgaacacggtttccgcctgccgtcggcaatggacaatcgaccgctcaaatggccggagttccaggaacgcgtcggtcagacggtgtacctgtcggcaacgcccggcgattacgaactcggtttgagcgacggcgtggtcgaacagatcatacgtccgaccggactagtcgatccgcagatcgacgtgcggccggtggaagggcagatcgatgacctgctcgccgaaatcaaagaccgcgtggcaaggaacgaacgtgcgctggtcaccacgctcactaagaaaatggccgaggatctgaccgactatctgctggaacgcggcatcaaagtcgaatatctgcattccgatgtggacaccttgcgtcgtgtcgaactgctgcgtgaactgcgtgaaggcaagatcgacgtcatcgtcggcatcaacctgctacgagagggcctcgatctgccggaagtgtcattggtcgcaatcctcgacgcggataaggaaggcttcctgcgttcctaccgttcgctcatccagaccatcggccgtgcggcgcgaaacgtgtccggcaccgtcgtcatgtatgcggacgacatcaccgaagccatgcgcaaggccatcgacgagaccaaccgccgccgtgacatccagatcgcctacaataaggaacatggcatcgatccgaagccgctcatcaagaagatctccgatgtcaacgacatgctcgccaaggaggacgtcgacacccagacattgctcggtaccggataccgaaacgcggacaaagccggcaattcgcatctcggcgtgccacataccagcaaggaggaatccggcaggcggcacgaggagattctcaaggccggattgcccgcgcaggatctagctgatcttattcgacaactgtccgagcagatgcataccgccgcagaacaactgcaattcgagcttgcggctcgtctgcgtgacgagatccgtgacctgaaaaaggaacttcggcagatgacggaggcgagcaaatagttctcgaccggtcatacggcatccgtaccatagtggattatggctgaaacaccacttgtttttgaaatcgccacgtttgcggtgcttgccgtcttcttcgtggtggacctgttcatcatcgggcgcaaaccgcatgtgccgtccaccaaggaatgcgtgcagcatatcgcgttcttcgtggtcatggcgttgatcttcggcggactcatgtggttcttcgccggctcgaagcctgccatcgagttctactcaggttggctgaccgaatattcgctgagcatagacaacctgttcgtgtttgtcattatcatgtcgaatttcgcggtgccgaaggaactacagaaattcgtgctgtcagtcggcatcaccgtcgcgctcgtactgcgaggcatgttcattttggtgggcgctgccatcatctcgcgcttcacttgggtgttcttcctattcggcgcgttcctcatcgtcacggccatcaaactcgtcaccgggggagacgaggacgaggaataccatgagaacgcgttgattcacgcgctgcgcaaggtcatcaagatcaccgatgaatacgacggcgaaaagctgcgtactatcaagaacggtgtgaagcattggaccccgatgctcatcgtgttcctgaccatcggcaccaccgacgtgatgttcgctttcgattcgatccccgccattttcggtctgaccaaagatccgttcatcgtgttcacgtccaacgtgttcgcattgctcggtctgcagcagctgtacttcctgctcggagagctgcttgacaagctcgtctatcttccgctgggcctgtccgtggtactgggcttcatcggcgtcaaactcatcatggaggccctgcatggcaattcgctgccgttcctcaatggcggccagccgatttcctgggttccggaagtgcccacatggctgtcgcttgtcgtgatcgttcttgcgattggtggtgcggctttggcaagtgttattaagatgcgcaccatgaaagcgaacgaaaagtgacagtccggcaaacgttgggagaatagagcttttctattctcctacgaaattgtgagcgctcacaacacacctagttctgaggtggaagtgggcgctttttgctagtaagctatgccattggaaacagggtcgtcagatccaaaatcaatatcaacaagaataggcaggcattcatgcgtaaagccaagatcgtagataccatcggtcccgctaccgagtccctggaaggcatcaccagccttgtcgaagcaggtatggacgtcgctcgtctgaaccgctcccacggcactccggaagaccacctcaaggtctacaacaacctccgtgccgccgccaaggccactggccgcaacgtcgcagccctggttgacctgcagggtccgaagatccgctgcggttggttcaagaagaacgccgacggcgaggataaggtccagctgaccgaaggccaggagttcgtcatcaccactgatgacatcgaaggcgacgagcacatcacctccaccaccttcaagggtctcccgggcgactgccatgcaggcgatccgatcctcatcgacgacggcaaggtccgcctcgaggtcaccaaggtcgaaggcaacaacgtgtacaccaaggttgtcgttgccggaccggtctccagccacaagggcatcaaccttccgggcgtcgccgtgtctctgccggctctgaccgagaaggacgaagaggatctgcgctgggccatccgcaccggcgccgacatcattgccatgtccttcgtgcgcttcgccaccgacatcgatcgcgcccatgagatcatggacgaggaaggccgccgtatcccggtcgtcgccaagatcgagaagccgcaggccctcgagaacctcgaggagatcgtcaaggcgttcgacggcatcatggtcgcacgtggcgatatggccgtcgagtgcccgctggaagaggtcccgctggccaccaagcgctgcatcgagctggctcgtcagtacgccaagccggtcatcgtggccaccgaagtcctcggctccatggtcagctccccggtcccgacccgtgcagaggcatccgactgcgccaacgccgtcctcgacggtgccgacgccaccatgacctccaacgagaccgccgtcggcaagtacccggcagtcaccgtgaacaccatgagccgcatctccaccttcgccaccgagcatggtttcgaccgcatcccggagctgaagaacctggatatgtcctccaccggtgccgtctcttccgccgccgtcgacctggccgacaagctcaacgccaaggccatcgtcgcctacacccagaccggttctaccgtgcaccgcgtgtcccgtgaacgtccggccaccccgatctacggcatcaccaacaatgagcacaccttccactggctggccctgtcttggggcaccgagtccttcctggtcgacgaggattaccatgacaagtcccgcaaggacctcatggttttcaccgacaaggtcctcaaggacgccggcaaggtctccgatggcgacaagatcgtcgtgctgagctccgcccagggcgaacaccagccgggtcgcaccgattccatctacgtccacaccgttggtgcctgcgactgagatttgaatcgtcgcgttaaacgctgattccataatcctcccattggttcccgatgggaggattattgtttttacgcgatgtctccgaatgatgacaacgccgagatttggcgcaaatcgcaatcatgtggtattcttccagagttgcgtgcaagccctcgtatcccaattggtagaggaagcagcctcaaaatctgcgcagtgtgggttcgagtcccaccgagggcacgtaagaaatcaatatcaatccaggcccgggttggggcatgttaggccggctttgggtgtgacagtggaaagagaccgacatggctgcagagaagaccacggaaccggacgaagtactcactgatgaggagctccaagctgctgcggctcccgagccggattctgccaataataacgaggcgcacaagcgcaccgtcgtcgttgccgaagacgaatccgtgaaccgcatggatttggtcgccatgcttgaggataacggctatgaggtcgtcggagaggccgccaacggtgaggaagccgttgaactgacccgtaagttccgcccgagcgtggtgtgcatggatgtcaagatgcctcgcatggatggcatcgaggccgctggcatcatctgtgatgagaacatcgctccggtcgtcatgctgacggcattctcccagtctgatttggtcaaaaaggccacgggcgctggcgccatggcgtatgtcaccaagccgtatgaggaatccaagctgttgccggctttggaagtcgccatgggccgtttcgccgaaatcaacgatttgcttgacaatgtcgaacgtagcgagtccaaactgcaggaaaccgaggaacagctgaagaaggccgaagagcagctgaagaaggccgaagaaacgctggaggagcgcaagctcgtcgaccgcgccaagggcctgctgatggacaaggcggacttctccgaacagggcgctttccgttggattcagaagacctccatggaccagcgcattccgaagaagcgtctggccatggccatcatcgccaagtatggcgaacagaagtcggaagcagaggatgcgcgctaacacaccaactgtggaaggcacttcacgcggaacgctattggtcgttgacggccattctttggcgttccgcgctttttttgccttacccgtagagaatttcagtacatcatcaggtcaggccaccaacgcggtctggggattcgccaccatgctttcgcaggtgatcgatgccgaacatccagaccatcttgccgtcgcattcgatgtgaagggcggcacgttccgcaaccagatgctgccgcagtacaaaggaactcgcgacgcggcccccgaggaactgctcagccagctgccattaatccagcagatgctgacggccttgggcgtcacatacatcgaaaaacccggttacgaaggtgacgatgtgatcggcacgctcgccagcatgggcgaccaggcaggctaccgcacattggtgctgtccggcgaccgtgatgctttccagctgatcaacgacgacatcaccgtgctgtatcccggccaccatttcaaagacctcaaacatatgaccccggatgccgtgcaggagaaatatcatgtctctcccgcgcaatacccagatctggccgccttgcgcggagaaaccgctgacaacatccccggcgttcccggagtcggcgacggattcgcggccaaatggatcaaccagtacggcggacttgagcagatcatcgaacacgccgacgagatcagcggcaaaaaaggcgaagccctgcgcgaaaacatcgaacaggtcaaactgaaccgttccgtgaacgctttggttcgtgaccttgatcttggcgtgtcggtatccgacctgacatttggacaagtcgacgctggtcaactcgacgatctattcaccaagctcgaattcggtgttcggaccaagaatcgcgtgctcaaaacgttcaatgcggacaaaccatccggggacgtgcacgaatccagcaagctcgagctgccacatgtcgaagacgtcaacgatccgcatgtggtggagacatgggtccaaaaccatttccccgtggtgcaggaacatctgcacgaacgccatgaacgctcctccaacgacattccggaattcggcttcgaaatcgattcttcgacccgttgcacggacaaggtgaaacagtcctggacgctttacgccgaaggtacgagcaaacccggagaagcctctctttcggcattgatgatcgccgtgcacggcgaagccattcgcatcgacgtattcagtccggatatggtgcaatgcctgcaaaggctgttcgaccgctatcaccattccatggtcgtgcacggttacaaagaacatgcgcatctgctgggcagcatcggcgtggaacttccggaaccattgtttgacaccaagctcgccggatatcttgcccacccggatttccacgcggacacgctggaacaggttgcggcccatttcctggatctgcacatcgaagcacaagccgaagccgcgacacaggggaccttggacttcgacgagcctgaggaaaacgattccaagaacgacgagctgatactcacccgcaccgcaatcgtggggcttttggccgaatatttggccggtgtgctggataagcgcgaacaattcggtctcctcaaatccattgagcttccggtctctcaggtcctgcatggcatggaacaggtcggcgcccaagtggatatggcacgtctggtgcagatgcgcgaccaacttgccgccgacgctgcccaggcacaggaaacggcgtggcagttcgcgggggagcaggtgaacctgcaaagccccaaacagctgcagaagatcctgttcgaagacatgggattgaaaccgacgaaaaaaaccaagtccggttcatacaccaccaatgccgcggcattgcagaccttgcgtgaccgctcgtacgataacgaccgcgcatgccagttccttgacgcgttgctgatgcatcgtgaaaagaacaagctcaagcagatcgtgcagacgttgatcgacgccacaaaccgtcatgacggtcgcatccacaccactttcgaacagacggtggcagccaccggacgattgagctccgtcgatccaaacctgcagaacattccgaaccgggatcccgcaggtcgtgagattcgatccgcgttcgtgccgggagagggcttcgaatcgttgctgagctccgactactcgcaggtcgaactgcgcatcatggccgacctttccggtgatgaggcgttgatagaggccttccgctccggcaaggacttccataagtatgtggccagcttggtctacggcattcccgttgacgacatcacgtccgatcagcgtagccacgtcaaggcgatgagctatggacttgcctacggtctgagcacgtatggacttgcccagcagctcaagatcaagcccaaagaagccgaatcgctgaaaaaccagtatttcgccacttttggcaaagtccatgaataccttgaatcgcttgtctcgtccgcacgcgaaaaaggatataccgaaaccattttcggaaggcgcaggtatttccccggtctcaaatcgccgaaccgtgccgtgagggacgcggccgaacgcgccgcgttgaacgcgcctatccaaggctcggcggcggacatcatgaaaatcgccatgattcgtgcgtatgacgcactgcaggaagcgaaccttggaagtcgcctcatactgcagattcatgatgaacttgtagtggagatcgcgcccggtgaggagaagcaggccaccgcgctggtgaaggatgccatggagcatgccgttaccatggccgttccgttggacgtatcgacgggcatcggttccgattggcaattggcggcccactgatccgttcccgtcggataatcgaaggctgattaaaaaagaaagaaggaagattgtggcaacgctgaagcaggtcgtggatgtgcttgaaacgctgtatccgctgcgttacgcggaacaatgggatgagccgggactcatcgtgggagaccttcgccacgacgtgcgcaacatcgcgttcgcggcggacccatccatggcggtgatcgaccaggctatcgccggaggcatcgacctgctgatctgccaccatccgctgttcttccgttccgtgcatgcggtctccggactaggattccgtggtgagatcgtccggaagctcaacctcgccggttgcgcgctgtgggttgggcacaccaatgccgatgcctcctaccgaggagtcggcatggccgccgccgacgcgttcggcctaatcgaacagcgtccgctggtacccatcgaagatccgaaagccgaacatccggtcggattgggccgtgtcggccggttgcaggagccgatcgcattgcgtgatttcgcccgtcgtgtggccgacgcgctgccatacaccgaacttggcgtgcaggtgtgcggcgaccttgacgcgacgatcggcacggtggcgatattgccgggctcgggcgattccctgttcgatgaagtgcgtgccgcaggcgtcgatgtgtatgtgaccagcgatctgcgccatcatccggtgaccgatgccatcgagcaggcgcgctatgaggcgtccatgcgtgccgcggacatcgaactcggccgaggcgacgccactgttcgtccgatgttcatcaacacgccacacagcgccatcgaatccatatggttccaatacgccatgggcgatgtgcctcgtgccgtatctgaggcgaccggagacatccccaccgtccgctggatttccatgaacaccgatccctggaatctggtactgccgtcctgcgggcaggaacgctgaacgacgatgtccgatacgaccagcatggatatgtcgctgaacgaatccagcgatggcgtggacatgaccagaccggccacagtactcagcagagagcacgtgtatcaaggcgcgattttcggcgtggaggacatgcgtatcgcgttgcagacacgagacggcggacaaaccgtgatccgcagacaggtgatgcggcacgcgccctgtgtggtcatgctggtgcatgactgcgcgcaggatttgtacttggtcgaacgagaataccgtgtcggctgcgacgccttcgcctacggtctgccggcaggactcatcgatgacggggaagacgtcgatgcggccgcattgcgtgagctgcgcgaagagaccggcgtcgagccaatcgacgaaaacagttgcgatatcgaccatgtcgggcaattctattcatccgagggcatgaccgacgaactggccaacatcatggtgatgcacctgcgccactggcaggccgtcgaacggcatttcgacgccgacgagcatgtcgaatctgcttggatcccgtggaagcagctacgagacacgcacatcacggcctccaattcggagatcgccattttgcatgagcaaattcgcagaatgcggcaacaatagcggcctgcaggtttcgaattgtaaaaacaatcgccggaataaacgaaataacgaattcaactcgcaaaacgtgcgatacttgaattatgcaaatcagacctggatcgatgtatccactcggtgcgagctacgacggcgccggcgtgaatttcgccctcttctctcaagtggcccagaaagtcgagctttgtcttttcgatgaggaagatcgtgagacccgagtggaaatgacggagcagaactcctacgtatggcataactatctgccgggaatacaacccgggcaacggtacggctatcgtgtgtacggtccgtatgatccagcaaagggcctgcggtgcaacccgaacaagttgctgctcgacccgtacgccaaagccatcgagggaaacatcgacggtgacgaaagcctctattcgtattggttcaaaagccctgaggacgtcaccagcatgaatacgctggattccgcgccgcataccatgaaatcggccgtggtcaatccgtatttcgactggggcaacgaccaacatccgaacatctcctaccatgattcggtaatctacgaagcccatgtgcgtggcatgaccaatctcaacctggacgtgccgccggacatccgtggaacctacgcgggcctcgcatatccatcggtcatcgaatatctgaggaagctcggcgtcaccgccatcgaacttatgccgatccaccagttcgtcaacgacagcttcctgcaggaaaaaggcctgagcaactactggggctacaacaccatcggcttcttcgcgcctcataacgcgtactcaagctccggacaacgcggcgagcaggtcaacgaattcaaatccatggtcaaggcctaccatcgcgccggcatggaagtgatcctcgacgtggtgtacaaccacaccgccgaaggcaacaacctcggcccgaccctaagcttcaaaggcatcgacaacggtgcctactaccgtctggtcgacaacgaccgacgccactacttcgacacgaccggcaccggcaactccctgctgatgcgctcgccgcacgcgctgcagctcatcacggacagcctgcgctactgggtcaccgaaatgcatgtcgatggtttccgattcgatcttgcggccacgctggcccgccaattccaggaagtcgacaagctgtccgccttcttcgacatcgtcgaacaggatccggtcatctcccgtgtcaagctcatcgccgaaccttgggatttgggttccggcggctatcaggtgggcggcttcccgtccagctggtccgaatggaacggccgctaccgtgattgcgtgcgtgacttctggcgttcgcaaccatcgacgctaccggaattcgccagccgtctgatgggcagctccgacctgtatcagatgaacggccgccgtccggtggcttccgtgaacttcatcaccgcacatgatggcttcaccatgaacgatttggtgagctacaacgagaagcataacgacgccaacggcgaaggcaatagggatggcgaaagcaacaaccgttcctggaactgcggtgtcgaaggcccgaccaccatcaaggacgtcaacgacctgcggcaacagcagatgcgcaacatgttcgcgacgttgctgtgcagtcagggcattccgatgatctgcggcggcgatgaggtggcacgcacgcaacagggcaacaacaatgcctattgccaggacaacgccatttcatggaccaattgggatcttgacgatagtcagaaggatttgcttgagttcgtttcgaagctgattcatctgcgactcgagcacccggtgctccaccgtcgtcgtttcttcaccggccgcgagccaggagacccggacgataagattccgcaggtcgaatggatggaccacaccggttccatcatggacatggaagattggtccaatacccacgcgttctcggtgatgatctatctgaacggttccgatattccggaagccgactggtatggcaaccagatggtggacaataacttcatcctgattttcaacgcgcattacgagccgattatgttcaccttgccggacgagcggtatggcaagaaatggcgtctggtcgttgacacgcataatccgaagggtccggaactcaactatgaggccggcttcgcgatcacggcgcagtcgagaagcttcctgttgctgatgagcgatagaaagcccaccacaaagaactacgatttctgatagccatgagaacaggcgaggtaccatccgtacgggtgacacacctcgccgtattgtttgtggactgtgctcgtgaaccgttacgagaattagacttccgacgagagtcgggaaacggttccagaaacggtttcgctgacctccgcaagatcctcgacggattctggccgcttggtttgcgccagaataagctgcgtctgcacacgatcggattcgatggccgcaatctgccgtgaaaagatgatgaaccagcccagaaacatcatgccggcaagagcctcgacgttcgtcaacgtgttacgccccgccagccactggaacccggcaagagccccgatcacgatagctaggtctgaaatcacatatactacttttgaaagctgcggggccagccaaggcagcgcgatcatcagcacgctcatcaggcagggaagaccgcgggcgaatacgttgtgcagaatcggatgcggcgtgtaacggaacatgccgatgccgatgaaggcgatgcctgcgagcgtcagcatggtcgatagcagaagaatccgcgccttgaagtgtttgggagcttctttttcatcgcttgcagacagatactgcatctgcagacggtgcgtggtgatgagctccgaaatcgcgaaatagctgatgatgacgatgcagacgccggccaacatcaatgtcgaattgaacatacgagcagcaaaagtggttcgatcgcccaattgggagaaattgttgttgtaccagtatggatcatcggacgtcaatcctgcgatgctgacaccggaaaccacgaagaacggcaacaaggatgcgatggtcttggcattcatgagttccgcctgtacgaacgtgacatagcctacgacccccgagatcgcggcgcagagtgcagtcagatagccttttaacgtgcgcaaccccatcatgttgctggcaatggaaagcagcatgaacgccgtgacgaaaatggtcgacgcgtagaccacggacaaagcgagtatctcgaagatacggcgaataggaatggtccagccatgtttcaacgtcatcgacctggagttgcgcgcataccccaaggtgaacgagatgactccacatcccgcggtgattccggcacacacggtgaacaggcgttgggtgacacgccagatggcgggagcgaattgcagatataggtccatggcgatccatgcaagagtggcgcatgccatgaaggaaatgatgcctgaagcctcggcttgctgatgacgtcccatgcgcgttccctccagtatttgccattctagcctgtcgttgtcctaccatacgctacaatagaaactcgtgttcacctgccacgtgcgggagtgcatgaacgggctgtagcgcagtttggtagcgcgtctgctttgggagcagaatgtcgcaggttcaaatcctgtcagcccgacaaaaagcccggagttccaatggttttgccacttggaattccgggcttcaatgattgtgcgcacaaaagaaactcagatgccacacatgttgtagtcggcgctcagatcattcatggcatgcaggatcttgtatgtgtagaccaacggcccgacgatgatcaacgtgccgagaacgctccatagccagtatgtcgcggccgtcacggtcaccggcaaatgccgggcggcctgttcggtgccgattcgagcgctgagacgatggttccagacaagccagccgatgccgaaagtcagccagccgacaatgaagaacatgaggcaatagtgcatggtgcgcttgccgtcgcgacgcgtggcgatcaggttcaaggtttccccaacctcactcatctgccaaatgtcgtagatgccgaaagtgatgagaccaagcagcacgaatttgagcaggccgcgtttggtacgcaacgccgttcccgccggaacgggaaccggagccattggctgaggctgttgagcggcaggcggataatattgctgtgatgcggacgcgtagagctgcggctgcggcacggccgcattcggttgttggggttgcggcacaggcacatatggctgtggttgctgtggcgatgtcatattctcttctttcttctatgcgctcgtttcttctatgcgctcgctcttctccacattgaggtgaaaaagaacggacgtcgtcaaaggacgcctacacgcaatgatgggcagatggggaaggagttgtatagtttgcatcccatatggataccagcatgtcgctgacgagatggacacgtctttttccgcaggttttggttaccatgggtcgcatggaagcacttcaagagaacctatggccggcaccgtatgccggcaaaccgctcaacgccactgtggtggtgccgggtagcaaatccctgtcgaaccggtatctcattctcgcggctctcggatcggagccggtgcgtttggtagggctgctgcgctcgcgtgacaccgagctgatgatggaggcgttacgtgcgcttggcgtccgctgtgaggttgatgtcgaaactgatacgacggtaacggtgacgccgccagcggatggccacttccatggcaatgcgaaaatttactgcggacttgccggcacggtgatgcgtttcgtgccgggacttgcgatgttcgccgatggtcccgtcgatttcgatggcgatgagcaggcatatgcccgcccgatgaaaccggtgttggatggcttgcggcagttgggtgcgaccattgaataccacggtgaagaaggccgtctgccgttcacaatcactccgcccgcatttgattcggccgtgcgcgaaacgccgaatgtggtctccatcgattcgtccggctcttcgcagttcatttccggcctgttgctgatcggctcgcgtgtgccaggcggccttgagctgcaccatacggggaaaaagactccaagcctgccgcatatccgaatgacggtggccgatcttaaaagtgctggtgtggatgcgattgcagatgaagacgttcatgtctggggagtcgctccgggaacggttcaactacccggacaggtgacggtcgaaccggatttgtcgaatgccgctccgttcctgggcgccgcgttgatcgccggcggaaccgtgcgtgtgccgcattggccggaaaccaccacgcaacctggtggtttgctgccggggtatcttgaacgcatgggagcgcaagtgtctttcccggaaaagaacggcatccgttattgcgaagtcacaggtggacatgccatcaacggtttgggtgatttcgatctgaccgctgccggtgaaatcgcgccatcgcttgctgcgattctggctttcgccgacaaaccgaccaatatgatcggcatcggccatttacgcggacacgagacgaaccgtcttgaggcgttggtcaatgaaatcacgcgtattgggggagaagctcgtgaattgccggatggattgaagataacgcccgtatccgcgggctgccttcgaccggccgtgatggagacttatgccgatcatcgcatggccacgttcgctgcgatgcttggtttgcgcatcaaaggcatccaagtggagaacatcgccgccacggcaaaaaccttgccgaatttcgtgaatatgtggaacgacatgctttcctgacggatgtatgaaagagatgttgtgaaggagattgttcgattctaacgagagtggactcttttcgccgcataatgggaggggctttccgcgagtagttccgcgggaagcccctcccattacgtgtctaagcctgcgggctcactcccattcgatggttgccggcggcttggaagtgcagtcaagcaccacgcggttgatctgacggcattcgttggtaatacgcgtcgagatggtggcgagcacgtcgtacgggatacgcgaccagtcggcggtcatggcgtcttcggacgacaccggacgcaacacgattggcgagccgtaggtgcgttcgtcaccctgcacgcccacggaatgcacgtcggcaagcagcacgaccgggcactgccagatgtcgcggtcgaggccggccttggaaagctcctcacgtgcgatggcatcagcttcgcgcagcaagtcaagacgttccttggtgatttcgccgatgatgcggatgccgagacccggacccgggaatggctgacgccagacaatctcatccggcagaccgagttcggtgccaatggcgcgcacctcatccttgaacagggtgcgcagtggctcgatgagctggaatttgatgtccttcggcaggccgcccacattgtggtgcgatttgatgttggccgcgccatcgccgccgccggactctacgacgtccggatacagcgtgccctgcacgaggaatttgacttccttgccggaggcaccggcctcttcgatgacctgacgctgggccttctcgaacgtgcggatgaacttctctccgatgatcttgcgcttcttctccggctcgctcacacccttcagggcggtgaggaagtcttcggaggcgtccacggcgatgagcttgatgccggtggcctcgacgaaatcatgtttgacctgctcggcctcgcccttgcgcagcagaccgtggtccacgaacacgcaggtgagctgctcgccgatggccttatgcaccagagccgccgcgacggcggagtcgacgccgccggacaggccgcaaatcacctgggcgtcgccgaccttctcgcggattttcttgacctggtcctcgatgatgttggacgcgttccagttatcgccgaggccggcgcacttgtgcaggaagttctcgatgagcttctggcccatcggagtgtgcttgacttccggatgccactgcacgccgtacagtttgcgggactcgtcctgcatggcggcgaccggtgcgccttcggtgtgggcgagcacttcgaagccttccggcgcggtcttgacggccacgccatggctcatccacgtgctttgctctgcgggagagccgtcgagcagaccctccgccttgtcgatggtggtttccgttttgccgtattcgcccagggcggccttgtcgacatccgcgcccaacgcgtatgccatggcttggaagccgtagcagatgccgagcaccggaacgcccgcgtcgaacagcttcttgtcgacgcgcggagcgcccggttcgaacacggaagcggggccaccggacaggatgatggcctgcggatccttggccagcatctcatcgaccggcatggaatgcggcacgagctccgaataaacattggcctcacgcacgcgacgtgcgatcagctgggcgtactgggctccgaaatcgacaacgagcacaggacctgcagccataacactctccctttaatatgaggtatcaagaaacgaacaatactaactgctctattgtgacgttgcaaggagacattggaaacacgtgaacggagaatgaacgaatctcacaattgcttactcccacctactcaacacgccgcgtgtgtatctagggaaacgaacgtgggaaacatgtgttaaccgactaaaaacgttgattttgagccgtttttcaatctttttgatagagtgtgaagtacgcacaaaaatctcgataaaagcacacatttgcgtacagaaaaataacaattgaacacacagtcgcaaaaaaacagcaaaaagtcgaaccgcgctcgtaatatgtgcaagtgactggaaatgaggcataccgcgtaaccgcaaggttttaggcatggctcatgacctaaggaaataaacaatcgcacatcacagtgcaggagtacaggagtacacatgacgagtcctgttattggcaccccttggaagaagctgaacgctccggtttccgaggaagctatcgaaggcgtggataagtactggcgcgcagccaactacctctccatcggccagatctatctgcgtagcaacccgctgatgaaggagcctttcacccgcgaagacgtcaagcaccgtctggtcggtcactggggcaccaccccgggcctgaacttcctcatcggccacatcaaccgtctcattgctgatcaccagcagaacactgtgatcatcatgggcccgggccacggcggcccggctggtaccgctcagtcctacctggacggcacctacaccgagtacttcccgaacatcaccaaggatgaggctggcctgcagaagttcttccgccagttctcctacccgggtggcatcccgtcccactacgctccggagaccccgggctccatccacgaaggcggcgagctgggttacgccctgtcccacgcctacggcgctgtgatgaacaacccgagcctgttcgtcccggccatcgtcggcgacggtgaagctgagaccggcccgctggccaccggctggcagtccaacaagctcatcaacccgcgcaccgacggtatcgtgctgccgatcctgcacctcaacggctacaagatcgccaacccgaccatcctgtcccgcatctccgacgaagagctccacgagttcttccacggcatgggctatgagccgtacgagttcgtcgctggcttcgacaacgaggatcacctgtcgatccaccgtcgtttcgccgagctgttcgagaccgtcttcgacgagatctgcgacatcaaggccgccgctcagaccgacgacatgactcgtccgttctacccgatgatcatcttccgtaccccgaagggctggacctgcccgaagttcatcgacggcaagaagaccgagggctcctggcgttcccaccaggtgccgctggcttccgcccgcgataccgaggcccacttcgaggtcctcaagaactggctcgagtcctacaagccggaagagctgttcgacgagaacggcgccgtgaagccggaagtcaccgccttcatgccgaccggcgaactgcgcatcggtgagaacccgaacgccaacggtggccgcatccgcgaagagctgaagctgccgaagctggaagactacgaggtcaaggaagtcgccgagtacggccacggctggggccagctcgaggccacccgtcgtctgggcgtctacacccgcgacatcatcaagaacaacccggactccttccgtatcttcggaccggatgagaccgcttccaaccgtctgcaggccgcttacgacgtcaccaacaagcagtgggacgccggctacctgtccgctcaggtcgacgagcacatggctgtcaccggccaggtcaccgagcagctttccgagcaccagatggaaggcttcctcgagggctacctgctgaccggccgtcacggcatctggagctcctatgagtccttcgtgcacgtgatcgactccatgctgaaccagcacgccaagtggctcgaggctaccgtccgcgagattccgtggcgcaagccgatctcctccatgaacctgctcgtctcctcccacgtgtggcgtcaggatcacaacggcttctcccaccaggatccgggtgtcacctccgtcctgctgaacaagtgcttcaacaacgatcacgtgatcggcatctacttcccggtggattccaacatgctgctcgctgtggctgagaagtgctacaagtccaccaacaagatcaacgccatcatcgccggcaagcagccggccgccacctggctgaccctggacgaagctcgcgccgagctcgagaagggtgctgccgagtggaagtgggcttccaacgtgaagtccaacgatgaggctcagatcgtgctcgccgccaccggtgatgttccgactcaggaaatcatggccgctgccgacaagctggacgccatgggcatcaagttcaaggtcgtcaacgtggttgacctggtcaagctgcagtccgccaaggagaacaacgaggccctctccgatgaggagttcgctgagctgttcaccgaggacaagccggtcctgttcgcttaccactcctatgcccgcgatgtgcgtggtctgatctacgatcgcccgaaccacgacaacttcaacgttcacggctacgaggagcagggctccaccaccaccccgtacgacatggttcgcgtgaacaacatcgatcgctacgagctccaggctgaagctctgcgcatgattgacgctgacaagtacgccgacaagatcaacgagctcgaggccttccgtcaggaagccttccagttcgctgtcgacaacggctacgatcacccggattacaccgactgggtctactccggtgtcaacaccaacaagcagggtgctatctccgctaccgccgcaaccgctggcgataacgagtgagcctaggctatttggcctgattgcttgataaaagccccaagggattgttcccttggggctttttcgtattacggtgcgatatgcttggcttaaaacagcaaaaccgctagcgcgtgtcagttaccgtttgcacattacaattgctcattgtgcgaacgatgcggtatcgcacccgaataatgcgaagtacataggagacaccgtgagttttaccagcgtcaccatcatcagtcccgaagcggctaacggccgtaatgttgtcgcccttggagtcaccaagacacttgccgcagccggcaagaccggagtgttccgtccggcggtctgcagaaaagacaccttcacggacgtgctgatcgaagcttccaatgccggtttgagccgggaacagtccgtcggcgtgtgccccaagcgcgctcgtaacgataaggaaggttcgcgggcggatatcgttgcggcctacacccaagccgtagaaacagcccgaccggatgccatggtgattgtcggcaccgacaggtcagcagtcaatgatcccgcgatgttctctttcaacgctgacgtcgcggcagacctccaatcgccggtcctgctggccgtatgcactatcgaacgcacaccggaacaagtcaaaagcacggttgaggcatccaccaaggtcatcgaagacgccgggagcaaagtcgtcggcgtgttcattactgggtgtgacgacacgcagccgaatccactcaaagcatgcttcgtcgactacccggtgccggtgtggacgctacctgccgtcgatttcaacgacgatgacgccatcagcaaggcagacgaagcgttcgcgacgaacgtcgacgccgtggaactgaccgtggcactcgaatcgccattcgacgccccgaccacaccctatgctttccaatacggtctgctgggcaaggcgaaggcggacaagaagaccatcgtgctgccggagggcaacgaggatcgcatcatcaaagccgccgattatctgctggagcgcgacatcgtcgatctgatcatcgtcggagacgaaaacgccattctcgcccgcggccaggaattgggattgaaatcgcttggcaaggcgaaattccaagccaaggatgatgaaacggtgctggaacccatggtggcgaagctgtgcgagctgcgcgccaagaaaggcatgaccgaagagcaggcgcgcaaacagctggccgatgacagctatttcggcaccatgcttgtggtgatgggcatggcggacggtctcgtgtccggttccgtcaactccacggccaataccgtgcgtccggccctgcaggtcatcaagaccaagccaggaacgtcgctggtctccggagcgttcctgatgtgtttcaaggaccatgccgccgtgttcgccgactgtgccatcaaccttaaccccaatgccgagcagctcgccgaaatagcaatccaatccgccgaaacggccaaggcgttcggccttgaaccgaaggtgggcatgctgtcctattccacgctgggctccggaaaaggacccgacgtcgacctcgtcgaggaagccaccaccatcgtcaaagacaaggctcccgaccttgcggtggtcggatcgatccagttcgacgcggcatggtctccgaccgtggccgcgaccaaagccaagggcgatccggtggcgggccatgtcaatgtgttcgtattcccggatctgtgcgcgggcaacatcgcatacaaggcggtacagcgttcctcgggagcggccgccgtcgggccggtgctgcagggtctcaaccgcccggtgaacgatctgagccgtggcgccacggtccaggacatcatcaacaccatcgccctgaccgccatcgaggcccagtaatcgggcattttgtagcaagcaacgagtaatctaaggttttggaaagtcgcgtaagcggcacatcgattaacacatggaggatgcccacaatggcgaaaaccgtccttgtcatcaattccggttccagctctatcaagtatcagctggttgatcttgaaaccggcgaaggtatcgcttccggtctggtcgagaagatcggcgagccggttgacggtcattacaagcacgagtacaacggcgagaagcatgagctcgaagagccgattcacgaccatgagcagggtctgaagcgcgtgctcggcttcttcgacgagttcggcccgaagctcgccgacgcaggcatcgtggccgtcggccatcgcgtggtgcagggtggttccatcttcccgaagccggctctggtcaacgacaagaccatcggccaggtcaaggacctcgccgtgctcgccccgctgcacaacggtccggaggccaagggcgctgaggtcatgcgctccctgctgccggatgttccgcagatcttcgtgttcgattcctccttcttcttccagctgccgaaggcttccagcacctacgcgctgaacaaggaagtcgcccagcagtaccatatccgccgttacggcgcccatggcacctcccacgagttcatctcctccgtcgtgccgtccgtcatcggcaagccggccgaaggcctcaagcagatcgtgctgcacatcggcaacggtgcttccgcctccgccgaaatctccggcaagccggttgagacctccatgggtctgaccccgctggaaggcctcgtgatgggtggccgtaccggcgacatcgatccggccgtcgtcttccacctgattcgcaacgcccacatgagcgtggacgaactggacaccctgttcaacaagcgttccggcatgatgggtctgaccggcttcggcgacctgcgtgaagtgcatcgtctggtcgaagagggcaacgaggacgccaagctggctctcgacatctacgtgcaccgcatcgtcggctacatcggcaactacaccgctcagatgggtggcgtcgacgtgatcaccttcaccgcaggcgttggcgagaacgatgacgtcgtgcgcaagatggtctgcgacaagctcgctccgttcggcgtcaagttggatgaggagaagaacgcgacccgttccaaggaaccgcgcatcatctccaccccggattccgcagtcaccatctgcgtcatcccgaccaacgaggagctggccatcgcccgcaagtccgccgccatcgcagaagaaggcaaggactcctacggcaacgtcttctccaagtgagtgacgtgtcacgtttcggctggtagaggaacgtgacggcaaacggtatgaatctgcgccgccgtgcctgataatcgatatcatcggtcaatcaggcacggcggcgcagtgcgttgggccccctttccgcgattcgcaagggattgcttggtagtacgatacgacaggttgcactgtaccgtgcaatgatgtaagagagaacggttggttattcgtggctgctaaacgacgtttcgtcggtttggacgggcttaaaggcatagcccttattgcgattgtgctgtatcactgcgatgagctttcgcttcaaggcgggtttttcggtgtggatgtgttcttcaccatctccggtttcctgattttctcatcgctgctcaatcgtatcgattcaggtaaaggcttggaactgggggagtacttcctcaaacggttccgccggatttatcccgcgctgtttgctcttatcccgatttcggtgacgttggcatggctggtgaaccgcgacatgcttgtcggcatccggaaccagatcatgaccgtgcttctgggatgctacaactggtatgccatcagcagcggagccagctatttctcccagatgaaccctgacatattccgtcacctatggttcatgtcgttgctcatgcagttttatctgatcgctccattcgtggttttgctgctgcgaaaaatcatcatcagatgggctccggtatgcatactgacagcccttgccggagcaagcgcggtatccatgggactgctataccactctggcgctgaccccacacgtgtgtatttcggcaccgacacgcacgccatgggcctatggctcggtgccgcgctggcttggatactgccgattctcagacatgagcatgggcgagccaatgaatcgcggataatggaacgattccataagatatggattcaattcggcccgatagttgcctttggctcattgctggcattgctgtggatgatgcggcatatcactcaaggcccagcggcgttccatggcggtatcttcgtcgcctccgtgcttgctgtggtgctgatcgcaggaaccataccattcggatcctggatgcaggatctgcttgtgttcaagccgcttgccgctttgggtcattattcgtatggcatttatctgtggcattggccattatggctgctgctgaggtccctgctgccccagtggggcgcatggcatgccgacaggctgctggccttcaccttcatcctcaccgtgctgttcgcgttcgcatcttggcggctgttcgagaagccagtcgctcgtgcgggattcatcgcgttgattcgtccgatcagtggagacgaagccgagcattgcggccgtctgatatccacggtcgtggtgctggcatgctcatggagcttctgcggatacgctgtggcgacggcaccggaacaaaccagtgtggcgcaatccttgggtatcagcgccaggctgttgcagcaacgcaatcatgccgctttggaacgacgcagaacaccgatgccaaggaagccacggcataagatgccggatggttcgcaaatggccgccatcggagattcggtgatgctggcgtccagcaaaggattgcgggacacgttccccaacatcattgtggatgccgaagtctcacggtcgatggcgaagggacagggtcttgtcgatcaattgaaagcgcaagggaatctgcgcccctgggtcttggtgggacttgccaccaactccgtggtgaccaatgatcagcttgacgatctgctgaatgatgtcggccccgatcatgtgctggtgctcattaacgcgcacgctcccgtttcatgggttcctggcaccaatgccgtgttgaagcaattcgccgcggcgcattccaacaacgtcgtactggtcgattgggacgggaccatttcccagcatgctgacgaacttgccggagatggcatccatccgggaatgtccaatacgatctacgcgcaggcggtcaaggattcaattgccgcttggatcaagcaagggcactgattgatgcgttgacgacttccatacgaggtccgccacatgccgtcgcatatgaatgatccccattccgtggaaatcggaatggggatcattcatatgcggacgatgccgatattagggaaatcaggcctcctgatgctgaggagcggacaggaagtgctcctcgctaggcagaacggcgttgagaatcacagccaccacgaacgacaccgcgatgcagttggaagcgaagatggactggaacagcgccgggaagttggcgaaaatgtcgccgacctgggtgaaaccgatgccaatggtcaggctcaacgcggcgatggtgatgttgcgctgcgtgtaaccggcctcggaaatcatctggaatccggacaggatgatattgccgaacatcatgatggtgcagccgccaagcacagcctgcggcagggagttgaagacctctgcaacggccggaacgaagctggcgagcaccaaaatcagaccgccggaaagaatcaccttgcggttgaccaccttggtcatcgccaccagaccgatgttctgcgcgaacgaagtcaatggcaggcagccgaacaaaccggacacggaggagattaagccgtcgccggcaatagctccggcggtttccttgtcggtgggttgacggtcgagaccgaccttggtaagcgccgctgtgtcgcccaacacctcaaccgaggaaacgacatacagcagagcgaaggagataatcgcacccggatcaaactcaagcttgaacggcatgaaatgcggcaccgacacgacctgcagattggcgaaaccggagaaatcgacctttcccatgaaaatcgcgaccacatagcccacgacaaggccgaacagcacggaaagctgcttggcggtgcccttcatgagcagctggaacgcaaggcaagccaccagcgaaatcaggccaagcgtcagattctgccagctgccgaaatccttcgcgccggaaccgccgccgaagctcgtggcgccgacggacaggagcgaaaaaccaatcgaggtgacgacaatcgcggaaacgatcggcgggacgaaacgacgccaatacttggccgtcaaaccaagcacgacctccaacaggccgccaagcaccacggcgccggcgactgcgccataaccctgatgctgcgcgatcgacatggcggccgcgacgtaggtgaaggaaatgccggtgaccatcggcagacgggaaccaatcagccacacaccgtacagctgcaggcaggtgccgagacctgcgaccagcaggccggcctgaatgatggcggcggactgcgcggcatccatcttggcggccgtggccaccaggaagataggcgcgagattcgccacgaacatggccatgacgtgctgcaggccgaacggaatgcccttccagaacgacaccggtgcgtcaagactgctcaacgcctcaaaagacacgccttttttagtgtcttttgccttcgtctttttttcggttttctctgtgttcttctcttcgctcaactgttacatcctctcttataatcgtttgagcgtgctgaaaaaaatcaggagcggaattcgatggtgccgttttccggatccatcgattcgacgattgccagggaatcgacgtcgtacccttcctcacgcagctggtcgccaccgccttggaagcccttttccactgcgatgccgatgccttccacagtggctccggcctcatggcatagctcgatcaggccttttaacgccttgccgttggcaaggaaatcgtcgatcagcagcacgtggtcaccttcattgagatagcgcttggacacgatgacagggaactccttctgcttggtgaaggaatacacggtggtcgtgtactggtcgccgtcaagattgatggactgcgccttcttggcgaacaccaccgggacattgccgaaatgacgggccacgacacaggcgatgccaatgccggaagcctcaatggtcagaatcttatcgatggtcttgcccttgaaatgctcggcccaagcggcgcccatatggtcgaacagctcgacatcgcactgatggttgaggaacgcgtccactttcagcacattgccgggtttgacggtaccctgctgcacaatgcgctcttcaagctccttcatgaaaccccttaatcttgtcggccgcgaaagcggcatcagatgatggcatacggcgagccgtatataggagttcagcatacgcgccccaattgaccgtgcgagtcggacccctgacctgctcatgtgataaacatgaatgctgcgaacaaatgtttgaatatgagcgtgcgcgaagaaaagaggaatcggtggaacagagcatgggacctgtgatgtgcgatccgcggagcctgatagagggactcaacccccaacaggaagaagcggtgaaatactacggccaggcattgctcatcggcgccggcgcaggctcaggcaagacccgtgtgctgacacgtcgcatcgcatggctgctggcgcatggcttctgggcaagcagcatcctcgccatcaccttcaccaacaaggcggccgcggaaatgcgtgaacgtctcgtgactttggtcgggccggaagccgaacatatgtggatctccaccttccactccgcctgcgtacgcatcctacgccgcgacggcaaggaaatcggccttaaatcgggcttctcgatttacgacaccgcggacagcgagcgactggtcaaactgatcgcagccgacctgaacatcgatacgaagcggtatacgccacgcatgctgctgggcaagatatccgactgcaagaacgcgttggtttcctggaaagaccagctgaaaaaagcgaactgcgattacaccccgggacagcgtggataccaggtgagcgccggcgacgtcgacgaactggtcgccgtcgtctacgccgaataccagcatcgtctggcgctcgccaacgcagtcgacttcgacgatttgatcatgcgcaccgtggaattgctccaaacctgcccgcaggtgagcgaatactatcggcacaggttccgttacatcttcgtggacgagtatcaagacaccaaccatgcccaatatgtgctcgtacgtgaattgtccggcatcgattcggacgaacagcccgacccgcaggcgaggggagcgggccgtgtgggaccgagctggattaccgtggtgggtgattccgaccaatccatctacgcgttccgaggtgcggacatccgtaacatccaagatttcgaacaggatttcccgaacgccaaaaccatcatgctcgaacagaactaccgttcgacgcagaccatcctcgacgcggcgaacgcggtgatcgcgaaaaacgaaaaccgcaagccgaagaaactgtggacggcgcttggtcaaggcgacaaaatcgtcggctatgccgccgacaacgcacagcaggaagccggatggatagcgaacgaaatcgcacgaatccacaccgaggaagacgtcgcttaccgtgacatcgccatcatgtaccgagccaacgcgcagtcacgttcgctggaagaggccatgatcaacgccaatctgccgtatcagctggtcggcggcaccaaattctatgaacgtagggaagtcaaggacgccatcgcgtatttgcaggccatcgtgaatcccgcggataatgtgaacgtgcggcgtatcctcaatgtgcctaaacgaggactcggcgcacgcgcggagggattggtggccggctacgcggacgcgcatggcctcacgttcttcgaatccattgaacatatggaccagattgaaggcatgacaggccgtaccaccaaaccgttgggcgcattccgtgatctgatgcacgagctggccgatttcgccaaggaacatgattcgaaaccatccgaagtggtggccgaagtactggacaaaagcggtcttctggaggaattgcaacgttccgaggatccgcaggatgcttcgcgtgtggacaatctttcccagttgcagtccgtggccgccgaattcgagcagaacacgccggatgccacgttggccggtttcctggagactacggcattggtcgccgactcggatcagttgccgggagagggcgaggattccggcaaggtcacgatgatgaccttgcatacggcaaaaggtttggaatatccgtatgtgtttcttacgggtatggaacagggcacgttcccgcaccagcgtgccatggaggacaccagcgagctgtccgaggagcgtcgtctggcatacgtgggcatcacccgtgcgaagcgtcggctgtatgtgacccgtgcggcggtgcgtgcccaatgggggcaggccaatgacatgatgcccagccagttcctggatgagattccggatgaactcatcgattggaaacgtcgtgaggccggtgtggagcgcatgcgcgccagctggggagatgacgacgagttcggcgggtgggacgatgatgacgatttcggatccacttccttcggcggatcgatgtacggatcgtcgacatacggttcctcatcgtatggttctggttctcgcggatcgcatcccacttatgggtcgtctcatggatcgcacagctcgtatggttccggacggtcctcctacggctcgggaagccgccgtttctctggcggatcgcactctggctcgtcctcatacggttcgtatggctcatcccggtcgtcatacggctccggcaagccctccggcaaatccggtaaggtcaccacgcgccgcgccaagccaaaggatctgacgaaatcggctccggcaagttcgttggacggcaacaacggattgagcatttcggatttccagataggcgacagaatcacccatgaccattacggtttgggaaaggtcatcgaaacgcaggacaagggcgcgaattcggtgatcaccgtcgatttcggcacggatggcgtcaaacgattgctgcttcgtgtggcgcctattgaaaagctctgacgtctttttccaataggcgcccctcgtggcggcgccgttgtgggctcataacacggattgagtgaaaaaacaagtcttttctttcggagcatttgttgcgataatcggcgatgtttgcttttcgagaggaagaaccatgccaagaaaactgttcgccgcgatatcgcagattgttctgggcgcgctgattgccatcgccccacagaccttcgcgcatgtgtgtgccgtcaaagacatgcccatggcatgccactacaccgctcgggtcgctctgggactgggcgtcgtcatcgcattgctggcaataatcggatttttcgcgccaagccgggtcagggccggattggatatcgccaatgccgtgctgggcgtgcttgtcgttctggtgccgaccatgctggtaggcgtatgcagaggctccatgatgcattgccatatggtgacgatgccgacgcttatcgtattgggcgtgctgctggcggcgctcgcagcagtcgccgcatatctcgatctcaagccggcaaagcgtggctgacgtgccgcatatcacccttgcgaaactaccgctggccaatctgcgtcgcaagccattccgcacttcggcgcttgtcattgtggtcgtcatgctcactgtggcgttctatggaggcgcgctgctttccatgaacctgaacaacgggttgaacagcatgcgggaacgtatgggcgccgatctgatggtcacgccgcagaacacgaaaaaccaggctgaggcgttgctcacgggaaactcttcgagcacgttctacttcaccaatgacattggaggccaaatcgccaaagcggacggtgtgggcgaaagcacggtgcagacgtacatctcctcgcttgcggcagcctgctgcgacgaaaaggtgcagatcatcggcttcaaccccgacaccgacttcgtcatcactccttgggtggcttcgcaattcgacggcacactccgtcgcggccaaatcatagcaggcgccagcatcaacgtgtcggacaacaatacggtcaaactgtacggtcatgaattccccgtggccgcgcaactggccgataccggaacgtcactggacaattccgtattcgtgaacatggacacggtgccggatgtcgtttcctattccgcgcaggtcggacatgccgcgattcctgaagaatacgccggcaaagcggtatccgccgtgctcgtcaaagtcaaggacggatattccgcacaacaggtcgcctcgaatatcgcaaaagccacggggatcgaaagtttgggatatgtgtatccgggcggcatcacggctacgacgaaaacgaatctcaaggtgatcatccgctatgtggcggtgttcatcacggtgttctggactatgggattggtcgtgatgttggcggtgttttcgtcggctatgaacgaacgcaagcgtgaattcgccgcgtaccgtattctcggcgccgatcgtgcgaccctggtgggcattatcgtcaaggaatcggcaaccatcggagctattggaggtgtgatcggtgtgacctgtacctcgttggtcgtgtttccgttcagtggtctgatcgctaaggaacttcaattgccgtatctgcagattggcgtcggtaaagtggcggtactgatagtcgtcgctctcctgttcgccgtgcttacgggcctggtcgcatccctcgccacaacggtgcgtctttccgccccacaggcatacctgacgctgagggagggggagtgatgccggaacagtccatattggaggttcgtggccttacccgtgaattcgtacgccgaggcaaacctttccccgcggtggatgatgtgaatctcacgctcgatccaggcgaattcatggcgatcgtcggccgatccggaaacggcaaaagcactttgctcaatctcgtcacgggattgctgaaacctacatccggttcgattctgctggccggtaacgaggtgaccacgttaaacgacaaacagatgtcgattttgcgcaaccgcaccatcggcttcgtcacgcagatccagacactattgccgaacctcaccgcaatcgacaatgtggtccttcccgcagtgctgcatcgcaacccgtctcggtatgaaaccgaaatcgatgaacggacgaatgacgcacaatcacaggaacagacggcgtcttccgtcgtggtcgatggccttcccgacgtcatccaaccagcttcgacgcagatggcttcttcatctcagcccgaccatttgacgcaacgcgcgcaacatctgttggatcaactgcttgtaggcgagcttgcgacatgctatccgaaggagctctctggcggcgagatgcgccgcgtctccatcgcccgagcgttgatgaacaagccgaaactgctgatcgccgatgaaccgacaggagatctggatgccgaaagcgccgcaatcgtcatgcggctgctgcggcaagtagcggatgacggtacctcggtgcttatggttacccatgatccggacacgcttgcttatgtggaccatacctatcgtatggataggggagtgcttactcgggcctgacgtttttaagacatgccgatgtaggtgaatcggagcatctcgtccgtcccccatgtgtatgattagcgattggtgtgcgcccggaaggacgtatgccgtctggagtcttagcccatcagtgggtcggcggccatccgtggtgttctgcattgcgggtcaagccgttcgcgcattgcgcgaagaagcactggagaggctggctcagcgtatgccggacttcggcatacgttccgttcagacaacgacagaacaaacaaaggattaaaccaatgacgaacgttcagcgttcccgccgtcaggtgcgtctttcccgcgccctcggcatcgctctgacccctaaggctcagcgcatcttcgaaaagcgtccgtatgctcctggcgagcacggccgcacccgtcgccgcactgaatccgattacgcagtgcgtctgcgcgagaagcagcgtcttcgcgcccagtacggcatctccgagaagcagctccgcgccgcttacgagaagggcacccacaccgccggccagaccggcaacgccatgctgaccgatcttgagacccgtctcgacgctctggtcctgcgtgcaggcttcgcccgcaccaccgcccaggctcgccagttcgtggtccatcgccacatcctcgtcgatggcaacatcgtcgatcgtccgtcctaccgcgtcaagccgggccagaccatccaggtcaaggccaagagccagaccatggttccgttccaggccgctgccgaaggtgtgcaccgcgatgtgctgccggcggttccgggctacctggacgtcaacctgccttccctgaaggccaccctgacccgcaagcctgaagccgaggagatcccggtgcaggtcaacatccagtacgtggtcgaattctacgcccgctgatctggattaccatactgtaagaacatacagtttaaggacatacagcgaaagcctcgcagccgttacggttgcgaggcttctcgttttttatggcgtttccggcggcatgtcgtttggctgattccacaggtaccatggaaaccatgttgcttcatcttcatctggtccgtcacggacagacgtttttcaaccgatataacagactccagggatggtcgaattccccgttgaccgatgcgggacttgccgatgcggacaaggccgctgccaaactccgggacattgagttcgccgcggcatactgctccgacaccacacgcgcccaggtgacggcacaacggatcctcgatgcgaacgaagccgcaggacacgttcgtccgtcactggtcagcgacatgcatttccgtgagcagttctacggttatttcgagggacaggacatgtccgtcgcatggaccgctgccggtggtccccatggtgcgaagaactacaacgacatcgtccgcaaatacgggcttgccgccacccgcgactttctcaaagaagccgatccgttccatgacgccgaatccgataacgagtattggcatcgtgtggaggacggcttcgctttgattgcggacaaccctcggcttaagaacggcgaccacgtgctgcagatctcccacggcaatacattgttgagccttatgcaccgattcgccccggaaggatacgatttgagcgaacgtccggccaacggttcggtgacctgccttgattttgacacgaacgaacccatggaccgcgcggtgagtgtggtctcgtacaaccagtgaacgtatttgccacagtcgtggctttttactagtcttatgcgggtattgtgttcgcgggcaaccgtggagctgaaaagaggtacaagatgggtgttggagagatcgccggtctgattgcggcaattgcattcgcggtgcttgccggtttcatgatctacccgctgatccgtctcggcaaattgttcgaccagatcgcgcagaccgtcaaagacaccggagaccatgcgattccggcgcttgacgagggcgtgaccacggtgcagcaggtgaacaagtccctggaggatgtcaacaagatctccgccgcggcgtccaccacggccaataatgtcggcgcgctgactgatctatatggatcgttcttgggcaagcccgtcatcaaggttgcgtccgccacctatgcgttgaagtccactgtgcagtctttcttggctaagagagacgtcaatcacgcggcaggcaataagggggagtgatgttcaagcgtcttttctgggtctccatcggcgtgggcatcggtgtcgtcgctgtcacaaaagcgcaggcatacgttaaagccaacacaccggacaccgcccgccaattcctgcttggtcccgaccaggaccatgtgaccatgcgcacgcttgaaggtctggtcaatgagttcaatgccacgcgtcgagcccgcgaggctgaacttaacagcaaatatgcggcgcggaacgagtagtcgttttccgcccgacagatacgctcaagcaaccaatcacacgtttggaaggcatcaggcctccaacaacaaaggagctcaaatccacatgcgcacttctgaaatcgcgaagcgctttcttgactatttcgaacagcacgatcatcttgtcgttccttcggcatcgttgatttctccgaacccgaccactctgttcaccatcgctggcatggtcccgttcatcccgtacctcatgggtgagcagaccccgccgaagcaccgcatggcttccaaccagaagtgcgtgcgtactctggacatcgacgaggtcggcaagaccacccgtcacggcacgttcttccagatgcttggcaacttctccttcggtgattacttcaaggaggaggccatccactatgcgtatgagctgctgaccaccccgcaggacaagggcggctacggcttcgatccggagaaactgtggatgaccactttcaccgacgacgaggaagcccgctcgatgtggaagaacgaaggcgtcgatcctgaacatatccagatcatgggtatggaagataacttctggaccaccggtggccctggccctggcggtccgtgctccgaaatctatgtagaccgtggtccaaagtacggtgtcgaaggcggcccgatcgccgacgagaaccgttacattgagatttgggatctcgtgttcgaaaactacgaggtcgacaacgtcaagtccaagaccgacctgcatatcgtcggcgagcttgagaacaagaacatcgataccggcgccggtctggaacgtctcgcctatctgatgcaaggcaagcagaacatctatgagaccgacgaggtcttcccggtcatcgaagccgcgcagaagctttccggccgcacctacggcgatgacgaggccatggacgtgcgtttccgtatcgtggccgaccacgtgcgttccgcgctgatgatcatgtccgacggcgtccgtccgtccaacaacggccgtggctatgtgctgcgccgcctgctgcgtcgaaccgtcaaggccatgcgcgagctcggcgtgacagagccggtcatgccgaccttgctgccgacctccaaggccgcgatggaaccgagctatccggagcttaacgacaccttccacgacgtgtccgaagccgcctacggtgaggaggacgcgttccgccgcacgctcgaatccggcaccgagatcttcgacatggccgtgacgaaggccaagcagggcggctcggacctcgtgtccggcgaggatgccttcaagctgcacgacacttacggcttcccgattgaaatcacgctcgaaatggccgccgaccagggcgtgaaggtggatgaagccaagttccgcgagctgatggccgaacagaagagccgtgcccgtgcggacgcgctgaagaagcgccacaacgtggatttgtccgtctatgacgacttcaagaagaccctgctccagccgatcgacttccttggctacaccgacatgtccgcacgtgccaaggttctgggcatcatgcaggagggcaagggttccgttcccgccgtcaccggcccggccaacatcgaggtcatcctcgaccgcacgccgttctacgcgcaggccggaggccagctcgccgatcagggcgagattctgtccgacgatggcgcggtgcttgaggtcgacgacgtgcagaagccgatcaaggaccttatcgtccaccagtgccgtctgaccgaaggcacgctggttgtgggcgccgaagtcaacgcgaacatcgatctcgagcgccgtggagccattgcacgttcccacaccgccacccacatggtgcacaaggcgctgcgtgaggaacttggtccgcaggccacccagcgtggctccgaagacgctccgaaccgtctgcgcttcgatttccaatggtccagcgcccccagcaaggacgccatgaacgccgtcgaagcccgcgtcaacgagaagcttcgtgagaaccttgccgtcaccactcaggaaatgaagttcgatgacgccatcgctcttggcgccatgcatctgttcggcgagaagtacggcgacatcgtgcgtgtggtgtccatcggcgaggacggctggagccgcgagctctgcggtggcacccatatcgaccacgtcggcaagatcggcgccatcaacatcatgtccgaggcgtctatcggttccggcgtgcgccgcgtggacgcggtcgtcggccagggcgcgtatgagttcaacgcccgcgagcacgcgctggtttcccagctttccgacatggtcaacgcccgtcccgacgaactcgccgagcgtgtgaacatgctgcttgccaagctcaaggaatccgaccgtcgtcttgccgcaatgtacgagtcccagcttgcggcctctgtgccgacgctggtggctgaggccaaagcttcctcggctccggtcaaggtcgccaagaagaacgttggacatttcggctccttcgacgcgctgcgcaagaccgtgctcgacgtgcgcggccagctcggcgaagatgctccggtcgtggtggctcttgccggcatgaacgaggacggcaagcccatggtcgccgtggcaaccaacgaagcggcacgcaagcaaggcatcaaggctggtgatctggtccgtggcgcttccaaggttcttggcggtggtggcggcggcaagccggacttcgcacagggtggcggcgcggacgccaccaagatcgacgaggcacttgaggcattggccggccaggctctgaagggctgattctccaagcatggtttggcttggtatcgatctgggtgatgctcgggtcggacttgcgttgtccgatcccgagctcaccctcgcacatcccataggcaatattcaagtgtatggggattctttccgcgcgttggatgaagtcatcgacgtcattggggacgagtcggtggaccatgtggtgattggcctgccgttgctgctgaacggcgaagaggggaaaagcgccaaaaaagcgagacgctggtccgtcaatcttgaaaaacgactgcatgcggccgtggaggatgaatcatattcggtgacgcgggttcccaccattgaattggtggatgagcgtctgacgacagtgaccgcacatcatcagttgttcgatgcgcgcatcggcggacgcaagcaccgtccgatggtcgaccagcaatctgcggtggtgattttgcagacggcgctcgaccgaagcagagagtaaggggagagagacctttgaccgataatctgaacgattttttctccgataacgcgcagtgggtcgatgatacgtcagcgggctcgtcattcgatgccgcgttgccgccgcaaccgccgaaatcgcgacgcgacatgcgtaaacgacgtgagcaacaacgtcgtcgtcgctatgtcacaatcatcgcggctgccgtcgttgtcattcttgtcgtcgtcggcggctttttcggcgtgcgcatggttaaacatctcaggcagatgaacgccaacggctcgcaaatccagattgaggattacaccggttcgggagacaaagacacgacgttcaccgtggaaaccggacaaggcgcagccgaaatcgcacgaaatctggtcaaggcggacatcgtcaaatccgaatcggcgttcacctccgcagtcgcggccgccggcgcgacgctttacccgggttcgtacgcgttgaagacgcatatgaaggcggccgatgtcgtcaagatcctgtccgaccaaagcaaggccggcggtttcgccgaagtcaaggccggcgaacgggtgtccgatgtcatcgccaacgcggccaagatgtcaggcaaggacgtgtccgaattccaagcggtcatcgacggtggcggcgcgggcattctgccagatgaagcgggtggcaaattcgaaggatggcttgagcccggatcctacagcgtccaggacaagtccgccaaggacatcctcaaggaaatggtcacggcacgcgtcagcaaactggacacattgggcgtgccagatggaagcgaacgcgaacgtatcatgaacatcgcgtccatcgccgaatccgaggcatgcaatcctgacgattacggtaaggtggcgagggtcatcctgaacagaatcgaccaggacatgccgttgggcatggacagcaccgttgcctacgggttcaacaccacaggcagcaagctgacagacgagcagcttgaggatggaagcaacccgtacaacactcgcgtgaacaaaggacttcctccgacgccgatcagcaatcccggcgattccgctatccaagccgcgatgaatcctccggaaggcaaatggctgtacttcgtcaccaccaacctcaagaccggcgagacgaagttcgtggaaaccgaagacgaattctggaagattcgcgacgaatacaaaagcaacaacgcgaatgccaactgacggtatcacgcattaacacaacgcgtgcatcgcgatgcttatcgccccggccacgacaatggtcggggcgaacggcgtcttaccggcgaatcgcgtatgcttctgcgggtcgaaccgtgtccaaatcgcaagccacagcagccccagcacactaatcgcaaaccaccagaacatcactggaaacaggccgaacatgcctacggccaagccgataagcaacgtcgtggtgacgtcgccgaatcccaaagcccctggcttgatgagcgcaagcgcacattgcagcacggcggataacgcggcgaacaacagagcctgcaatgccagaaacagtgaattaacggacaacgcatacgtgatgtccacaatgacctgcgccaaacaccctacggcgatccacatgcgtggaatgcgtcgtgcccggatatcctcaacgctgacggccattccacagagcagactcggcaggcaaatcatgtaccacataccgttaagatagtccacgaatcgtatttggcagaaaaggagtgttggcatgttgcgctggcagacagcaggtgaatcgcacggcgaagcgcttgtcgccatgatcgaggggctgcctgcgggcatccacgtcactactgaggatatcgtcggcgcattggcacgccgacgtctcggatatggccgtggtgcgcgcatgaaattcgaacaggacaaggtccgcatgctcaccggtgtgcgtttcggcgagaccatcggctctcccgtcgccatcgagatcgccaataccgaatggccgaaatggaccgaggtgatgagcgccgatccgcttgaccatgacattccgcgcgaaggccgcaacgcgccgctatcccgtccccgtccggggcatgccgatctgactggcatgcgcaagtacggtttcgacgacgcccgtccagtgctggaacgttccagcgcacgtgagaccgcgtcgcgtgtggccttaggcgaggtcgccaagcagttccttgagcagacgttgggcatacgtaccgtctcccatgtgctgtcaatcggtggtgctggcatcaccgacccgcagaatgcggtgctgccgaagcctgaggacctcgaagcattggacgcttcgccggtgcgcacattggataagacggccgaacagcagatgatcgcacgcatcgacgaggccaaggagaacgccgataccttaggcggcgtgatcgaggtcgtggtatacggcgttccggctggaatcggcacgtacgttgaatcggaccgcaggctggacgcggcattggccagtgccgtcatgggcgtccaggccatcaagggcgtggagatcggggacggtttccttgaggcgatgcgtcctggctcccaggcgcacgacgaaatggcggttggcgacgatggccgcatcacacgtctgagcaatcgtgcgggcggaatcgaaggcggcatgtccaacggccagccgattgtggtgcgtgccgcgatgaagccgattccatccattccaaaggcgcttcgcaccgtcgacgtcaccaccggcgaggcggcccaggccatcaaccagcgttccgacaacaccgccgttcccgcggcggccgtcgtggccgaggcgatggtgcgcctcaccatcgcgcaatacgtgctggagaagttcggcggcgacagtgtggccgaaaccaagcgcaacgccgaatcctatgtggcgtcctggccggagcacatgaggtgaccgattcgatggctggaatgcgtagacccgtcgccgtcatcatcggcatgatgggcgcgggcaagacccgcgtcggcaaggaagtggcgcagatgatgcaactgccgttcgccgacgccgacaacgagatcgaacatgacgcgggaatgaagattcccgaatatttcgaaaggtacggcgaaccggagttccgtaagctggaaagcgacgttgtgcttgacatgctggaggatttcgacggcatcttctccttgggcgggggcgctccaatgaccccgtccatccagcaggggctcgccgaatacatcgccgacggcggcaaggtcgtgtatttgatggccgatccgaaggaagccatggaacgcgccaaccgcggcggcggccgtccgatgctcaacggcgacgccaacgagcgttggaagaagttgtacaaggaacgcgacccggtgttcagacgcgtggccaatgtgcaggtgcgcacccacggacaaaccccgcaagtggccgcgagaaagctgatggaaatgatcgatcaacgtatcgtccacgtcaccggattcaccatcgaaccatacgatgtgtgcataggcgaaggtgtgatgagccagcttgcgcaggtgttgggagacgagcccgccaaagtggcattgattcacacccagccggtgcaacggcattccgaccgcgcgcgcacgctgttgcgccagtccggttatgacgtgcacgacatcgtcattcccgatgctgaagccggcaagaccatcgaagtggccaacggcatctggcagcgtctgggggaggaaggcttcacccgttctgatgcgattgtcggtctcggcggtggcgcagccaccgatctggccggtttcgtggccgccacatggatgcgtggcatccgctacgtcaactgcccgacctcgctgctggccatggtcgacgcctccaccggcggcaaaaccggcatcaacactccacaaggcaagaacctcgtcggctcgttctatacgccggccggcgtgctcgccgacatgggagcactcgcctcgttgccgaacgacatcttcatcgaaggtctgggcgaagtggcgaaatccggtttcatcatggatccggagattctgcgcatgcttgaagaccatgccgacgagctgcgctcgttcgacggttcgacgttccttgactccgatctgaaggatgtggtcgccgaactcatcgaacgtaccgtgacggtgaaggcgtaccatgtgtccgccgacctcaaagaagccggattgcgtgaattcctcaactacggacatacgcttggccatgccatcgaaaaactcgaacacttccgctggaggcacggcaacgccgtcgccgtcggttgcgtctatgcggccgaactgtcccatctgctcggctacatcgaccaggatctggtcgactaccatcgttcgctgctcggctcgctcggcctgccgacatcatggaacaatggcagctgggatgatgtgctggcgctcatgcaccgagacaagaaggcccgcggcaacaaactgcgtttcgtcatactcggctcgctcggccatcccatccacctcgaggatccgccggcggacgccgtcgaggaggcgttccgacgcatccagcggtaggacgcaatcgcaagaacgaacacaaaaggaagcaatatgaccaaagtagtggttgtcaacggaccgaacctcggccgtctcggagtgcgccagcctgacgtatacggcaagcaggatcttgagaccctgcgcaaactgtgcaccgaatggggtcatgaactggggcttgacgtggaagtgcgtcaaagcgacgacgaggccgagatgattcattggatgcatcaggccgcggacgaaaaaacgccgatcgtcatgaaccctgccgccttcacccattattcctatggactcgccgacgcggcgtatatggtcatcgatgaaggtctgccgcttatggaggtgcatatctccaacccgtccgcacgcgacgagttccgcaagcgttccgtgatctctccggtggccaccggcaccatcaccggcatgggattctatggctacaagctggcaatcgaagcggttgcgcacttgttggaagaacgctgacatcgacattccgtcatggattcagccggatgcctgtctttaaggcatccggctttttcgtgccaatgaggacgacgcatatcccggtctccccggattggtatacagtgatattgcaaacgtatgcaaaccgggagcatggcgaagtgacgaagaggtcgatgactatgggcgcaatcgcaagaagaatcacacgtgtcattacggcggtcgtatgcgtcgcggtatcggtcggtgtctcagtcgccacgcttcacgtgccgacacgtgaaggcggcggggaacgtttcaatcccgcgcgataccgcagcgacgtgatcgtgaccatgttccaagccaattggaaatccgtcgcccgcgaatgcggcgaagtgttgggacccgaaggcgtcggctacgtacaggtctcgccgccgcaggaaagcatccaaggcgcgcagtggtggacgagctatcagccggtaagctacaaacttgactccaaagaaggcaccgaagctgaatttaagaacatggtccggcaatgcaaggccgcgggcgtcggcgtgatcgcggatacggtcatcaaccacaccaccggcgtcgacaaaacacaagggaccggcaccgccggaagcccctacgacaataaaggcgatttccctgaagccggatacacgccatcggacttccatgccccctgttctatctggacgtaccgcgacgccgaaagcgtgtggaactgccaggtatcgggtttgcaggaccttgatacatcaagcccgcacgtgcgcgacgtgctgtctgactattttgtgaagcttctcgactacggcgtcgccggattccgcgtggatgccgtcaaacacatgcctccggaagacgtactggccatcaagaaactcgttgcgaagaaatccggacgttccatgaacgacatctggtggacgcaggaagtgattggcgacaatgcggaagccgccgaaatccaaccgaggaactatctcaaaaccggccaggtgaacgaattccagtacgcatatcggcttaagtccctgttctccaactcgctggcaggcggaagcctgtcgatcaaagacattccgcagaacatcaccgacagtggcaaggccagcgtattcgtgacgaattgggataccgaacgcaacaacatgacgctcacctacaaggacggcgacgcctaccagctagcgaacgcgttcatgctggcctacccgtatggcaccccaacgtgttctccggatacgaattccatgacaccgactcgggagctccaggcgccactgcaaccagcgtgcccgatattgactgctccaaagactccggctgaagctgcaccgaacgctggcctgacgtgcacggtatggtcggctggcataatgtcgcaggcgacgcgccgctctccgattggcaggatgacggcgacaacatgatcgccttcggtcgagggggacgtgccttcatcgccatcaacaattccgtgcgcacacgtactgtgacgtaccacacggctttgccggcaggggagtattgcgatgtctatgcttccgccgactgttccggcagcgtgcatgtgcgtttcgacggggatgccacactgacggttcctgccggtagtgcagtggccttccatatcgccgcgacaccgtataccgtgagacaatgattgcaatcgtttgctgtttttgcagctatttctgaatgttttctgcttgacttgcagaaaaaaattttgcttgcagcaacaggttgcacttcggcatatatgaagtgcatgtgcagcagagggtcacgctgtttcattgccacgcgcagccattggcatacagttaactctgattcagagtgtaaacgtatgcatattcatcgtcgagtggattctgaatcatccgcgtggatgcggatgtccatggcgcatacgttgccggttgcggagcctgccatgggcgcttgaaccggcctcacagatgagaacggagaacaatggtcgttcagacgaaccggccgtttggccgtgtggtggcaataggagccaccgcagccatggcgtgcgcctcgctggtcgcggcgccgattatggcccaagcgcaatccaacgcgcaggtcagcgccaaaaaggatgtgcaggtcatcgcgttccaacagacatggaacacgatcgccaaggaatgcaccgaaacatatggtcccgaaggcgtgggctacgtcgaagtatcgccgccgcaggaatccatccaaggcacccaatggtggacgagctaccagccggtgagctacaagcttgactccaaactcggcgccgaagcggaattcgcaagcatgatcaagcagtgcagcgccgccggcgttaacgtcatcgccgatgtggttctgaaccaaaccaccggatccgatgtggccaaaggcgaacaggccggcgttgctggaagcaaatacaacggttccaccggcgactacccgggattcgccaccaagcagtatccggacggcatcaccgcagcagacttccacagctgcgacaagaacatctccaactacaccaatcagcaggaagtgcaggaatgccgcctgagctccatgtgggacttcaactccgaaaacgagaaggtgcaggacatccagtccgactatctcgtcaagctgtggaatcttggcgtacgtggcttccgtatggacgccgtcaagcacatccacacggacagcatgaaggccatcaaggagaagttcgccaagaagattggccagaacgccaatgacatctactggattcaggaggtcatcggcaattcctccgaagccgcaggcatccagccgggcaactatgtgcagaacggcaccgtgaccgagttcggcttcaagtccgaaatgaaccaatacttcaaggacaaggtcgccaagctcaaaggactgaacgaaagactgagcaaggatctggcctccaaggacgccaacgtgttcgtcaccaactgggacaccgcccgcaaccagggcgcgctcacctacaaggacggtgcgaaatatcagctggccaacgcgtttatgctcgcctacgattacggcacgccgcgactgctctccgactacaagtgggatgacggccacaatgatgacggtgcgcctggcgccaccgcggcttccgtgccggacgtggatatgaacaaggaatgctccacgaacaactccgcatggaactgcgagcagcgttggacctccacccgcggcatgatcgccttccataattacgtaggtgacgccgaaatgaccgattggcaggatgacggcggcgacaacatcgccttctcccgcgacgaccgtggtttcatcgccatcaacaacggcaagaaagagaaggacgtcacctatacgacgtccctcgccgacggcgaatactgcgacgtgtatgccacaatggactgctccaagacggtgaccgtcaagggcggcaaggtcgagacgaaggttccggcacgttccgcgatcgcgctgtatgcaggtgccaccaaggcctcgcatcccgccgcctccactgcgaccgatccgtccgatccggacgtaagcaaaatcgacgacgaggtgacggccaccgacaagaccatcaccatctattacaagcccgcggattccacatggaaaaccccgaaggtgcactatggtcttggcgacgactggaaccagccggaagccgacatgacgctcgatgagcagggctattaccgtgccaccatcgatacgaagggcaagaagatcgacttcgtgttccatgacgccgacacggatcagtgggagaacccggacggtggaggcaactaccatgccaacgccggtatcatccaggtcggtgtggccggccaggagctgtccatcggcaatcccgagtccgtcgggcagaagacccgtctcgtagtgcactacaagcccgcaaaggctgatggccagcgaggcgtatacgtgtggggcacctccactgacggaaccgatatcacggccacgaaccatccgttcaccggaaccgattgctggggcaaggtggcgacgctcgacttcgatggcgaattcaccgatttcggcttcatcatcaccaccgaggactggaacaagtacggtggtgaccgtaaggccacggtcaataagaccggcaccgcagaagtgtggatcgacggcaccaagaacgaggacaagggcgaatccaccacagtggaaaccctcgactccgctcccgccgactacaattgcaaggccgataccgtgaacgtcaccgtgcattactaccgcgatgacggcctctactacaatgccaaggacaccaaggtgaccgtgccgcagtgggatatctggacctggtcgagcaattggaacggcggcaacgccaccttcgattcccatgacgattggggcgaggtcgcgaagtattccgtgccgaattacacctatagcaacgcggatggcaattccgacatcggcatgctgcgcaggtatggttctgacgcatgggcttccaaagacccggatgacgccaaccatatgatcccgtccgacgcgctcgtattcgacgcagacggcaacgcttccgccgaagtgtggctggtcggcggcgatcccacggtgtattcctcccgtccgtctctgaagatcgcacttaagtccgctgagatctccgatttcaaggaactgaccgcgcgtctgtcgaagaagccggccgatggcgccatcacgaaggccatggtggccgtcaaggacgccgatggcaacaaggtcgatgttgaggacgtcaccgtcaataagagcacggtgaagatcaagaccgccaagaagctcgccgtcaccggcaagtacaccattgagatcgagggcatgggctctcagacggccatcgccggcgctctggtgcgtaccgacgccttcgacaaggcatacgcctatgatggcgacgatttgggcgctaccttcaaggaggctcggaccggtttcaaggtgtgggctccgaccgccaccaaggtagagctcgtcatctacaagtccaccgatccgaacgccgaagtcgacaagaccatcgatatgaccggcgaagacaagggcgtgtggagcgccacggtgaagaagctcgcttccggcaccgcatactcctacaagctcactttcgccgatggcacggtcaacacctcctccgatccgtacgccaccgccgcggtcgccaatggcgagcgttccgtggtgctgtccaaggaggatatgggatccgccggcaagcgcatgccggccttcggcaagaccactgacgccaccatcgcggaaatgaacattcgcgacttctccatcaacccgaattccggcatttccgcagacaagcagggcaagtacctgggtgtcgtggaatccggcacgaagacgaaggaaggcgccacctccggccttgactacctgaagcagctgggcatcagccatgtgcagatcatgccgatgtacgattatggttccgtcgatgagaccggcgacctgagctacaacgcgaatggcgcgcagaactggggctacgatccggagaactacaacgtgccggaaggctcgtattcctccaatccgtccaacccgagctcccgtgtcgccgaaatgaagcagatggtcaaggaactgcataagaacgacatccgcgtcatcatggatgtggtgtacaaccacgtctacaatgcggcgaaccactcgttcaacaagacggttccgggctactatttccgctatgacgccaacggttcgctggtcaacaactccggctgcggcaacgatacggcctccgaacgcaagatgatgcgcaaatatatcgtcgattcggtgacctattgggcgaagaactacaacgtggatggcttccgattcgaccttatgggcctgatcgacaccgaaaccatgaaggaagtccgcgccgcgctcgacaagatcgatccgtccatcatcatcctcggcgaaggctgggatatgaacaccacgatggacaagagcaagatgaccatccagccgaacgcctaccaggtcgcatcggacggcaagaacaacggcattgccttcttcaacgattccatccgtgatggtctgaagggctccgtgttcgacagcgccgacactggcttcgtgtccggcaaggccggtcaggagaagctcatcgcgcacaatgcgttgggctgccagtatgacgccgaagcggaaacgacctgctggaacggcaatgcgcaggatcattacgcggatgccggccaggtggtcaactacgccgaaatccacgacaacctgaccctgtacgacaagctcaaggcatccgttccgacggatgacgaggccaccaccgtggcccgcgccaagctcgccgattccgtggtctacctgtccgaaggcattccggccatccagctcggccaggagttcctgcgcaccaagggcggcaacggcaacagctacaacgcaggtgacgcggcgaacgccatcgactggaaccgcgccgcgcaatacgccgattccgtcgactacgtcaagggtctgatcaagctgcgtaagcagatcaaggcgctgcgcctgaccaactacgacgacatcaacgacagtgtgacgatgctcaagtccgatgaaggcgtcgtagcctatcaggcaaaggattccagcggcacctacatggtgatcttcaacgccaacaacgagcccgccgccgttgaaggcataggcgccggcaagtacaacgtgctcgccggcgacggcaccgtgtacgacgagaacgccaaggatgccttcgtccgcaagggctccacgtacactgcaggcgcgctgtccgccaccgtgctcaaggtcgcctctgccgacgatgtcgttcccgttatcagcggaatgaccgaatcgacgaccatcaccgtgggatccaagttcgattcgatggccggcgtcactgccgatgactccattgatggtgatctgaccgacggcatcaaggtcgaaggcactgtggacgccggcaaggtgggcgactacaagctggtctattccgtgagcaattcccgcggcaagaccacaacgtttacccgaacggtccatgtccagaagaaggttgtcgtccctacggccgaggcgaatgcagccagcggtaaaaagaacgagaacgcatcacgggcgcagagtccggcaaccggctccaacgtcatgggcctcgccctggcgatcgcggcgctcgtcatcgcagcgggcgcgctgatcgtctcccacaggaaggaggtcagcaaccgataagaccataatcgtctgactgcatctcctattcctggaagatggggccgcgcatgaagcgcggccccatcttttcatatagtccgaaacacgccacgtctcacaccgctgataaactgaagttccatggttagaagacaacatggcaattctcaagagcacgtcaccaagcatattttcgttaccggcggcgtagtctcctcccttggcaaaggcctgaccgcctcctcccttggccgcctgctccgtagccgcggcatcaaggttttgcagcagaagctcgatccgtacatcaacgtggatccgggcacgatgaatcctttccagcacggtgaggtctatgtcaccgaagatggcgcggaaaccgatctcgacatcggccactacgagcgtttcctcgacgtgtacctgagccagaaggccaacgtcaccaccggccagatctatcaggaggtgctgcgcaaggaacgcgccggcgaatacctcggccagtgcgtgcaggtcatccctcacatcaccaacgaaatcaagtcccgtatgcgcgcgcaggcgtccgatgacgtcgacgtgatcatcaccgaaatcggcggcaccgtcggcgacattgaatcccagccgttcctggaggccgctcgtgaagtacgccgcgacctgggcgccgaaaactgcatgttcgtgcacgtctccctggtgccgtacatcgccgccgcgcatgagctcaagaccaagccgacccagcattccgtcatgatgctgcgccagctcggcatctccccggacgcgctcgtgctgcgttccgaccggccgctcaaccagtccatcaaggacaagatctccctgatgtgcgacgtggactccgaaggcgtcgtcaactgcgtggacgctccgagcatctacgacgtgccgaagaccctgttcgacgaaggcctcgacgcctacgtggtgcgtgaactcggcctgccgttccatgacgtcgactgggacgagtgggaggacctgctcgaacgcgtgcaccatccgaagcacgaggtcaacgtggccatcgtcggcaagtacattgacctgccggacgcctacctgtccgtcaccgaggccatcaaggccggcggcttcgccaactgggccaaggtcaacgtcaagtgggtggccgccgacaagtgcgccaccgaagaaggcgccgcggcggccctcgaccaggtcgacggcatcgtgattccgggcggcttcggcatccgtggcatcgacggcaagatcggcgccctgcgttacgcccgcgagcacaagctgccggccctcggcctgtgcctcggtctgcagtccatggtcatcgaatacgcacgcgatgtcctcggcatcaccgacgcgaactcctccgaattcgatccggattgcgccaacccggtcatcgccaccatggaagagcagaaggacatcgtcgccggcaagggcgacatgggtcacaccatgcgtctgggctcctacccggcggaactggaggaaggctccattgtcgccgaactgtacggcaccacgcatgtcaccgaacgccaccgccaccgttacgaggtgaacgtggcatacaaggatcgtctgcgcgaaggcggtctggtcatctccggccagagccctgacggcgaactcaccgaattcgtcgaactgccgcgcgaggtgcatccgttctacgtggccacccaggcccatccggaattcaagtcccgtccgaccaagccgcatccgctgttcgcgggtctggtcaaggccgctctggaccaccagcaggcgcgctgagacgatttgagcgcataagctcgattcatcgcaaagcggaagaccgaatctgcatggtcttccgcttttttgtaaggcaaatcacgggcgaatactgtcgaatttcgaataaggtctagtgtttcgctgtgtgttctgttaggttgtcataggtatcaatgagtgaatggaggcagcgtacggtggcagagaaccaagcgtccaacgccgcggccgacgtggagatgagccagtatgtggctgatcgcacgcgcgtgaacgaagacaagatcaagcaggatgacgagatcatcgagcaattcggtgactacaactacggttggcacgatacggacttcgccggcgaggcggcgaagaaaggcatcgacgagaacgtcgtgcgtgccatctccgccgacaaacacgagccggaatggatgctggaaaagcgattggaagggtatcgcgatttcatcaaccgtccaatgccgcagtggggcgtcgatttgaaggacttcgacgccgacgatttcaagtactacgtcaagccgatcgacaagcaggccaccacttgggaggaactgcccgacgaaatccgctccacgtacgacaagctcggcattccggaagcggagaaaagcagactcgtctccggcgtcgccgcgcagtacgagtccgaggtcatctacaattcaatccagaaggatctcgaagagcagggcgtcatcttcgtcgacaccgacaccgccgtgcaaaagtacccggaactcgtcaagaagtatttcggcaaatgcattccgagcaacgacaacaaattctcggcattgaacaccgccgcatggtcgggcggctcgttcgtatacgtgccgaagggcgtgcacgtggacatcccgctgcaggcatacttccgcatcaacacgccgaacatgggacagttcgaacgcacgctgatcatcgctgatgaaggctcctacgtgcattacgtggaaggctgcaccgcgccgatctactccaccgactcgctgcattccggcgtggtggagatcttcgtcgagccgcacgcccgtgtgcgttacaccaccgtgcagaactggtcgaacaacgtgtacaacctggtgacgcagcgcgcctacgtgcgtgagggcggcaccatggaatgggtggacggcaacatcggctcgaaagccaccatgaagtatccggcatgcatcctcgccgagccgtatgcgaaggccagcaccatgtcgttgggcttcgccggtaagggacagtaccaggacacgggcgcgaagatgattcacctcgccccgcataccagctccaccatcgtggcgaagtcgatttcccgtggcggcggacgttccgcataccgtggcctcgtcaaaatcgtcaagggcgcggaagggtcctccaattcgacggtctgcgacgctttgctcgtcgacgaattcagccgttccgacacgtacccgcatgtggatgtgcgtgaggacaacgtctccatggcgcatgaggccaccgtttccaaggtctccgaagaccagctgttctatctgatgagccgcggcctgtccgaagacgaggccatgggcatgatcgtgcgcggcttcgtcgaaccgatcagtcgcgagctgccgatggaatacgcgctcgaattgaaccgtttggtggaattgcagatggaaggatcggtgggctgatcaccatggcacaaactcaggaaatcaacatccccgtcgcggatccgtccgatccgtacgcgaatccggcggccatgccgtcatccgcggaccgcgctccacgctcattcgacatcgaagcgttcgccaagccggaccgcaaacaggaggactggcgctacacgccgatagagcgcatcgaggagttcttcgatgtgttcgaaccatccaatgaaacgcaggtcaccgtttccatgatcgacgggtcgccgcttgccgaaggcgtcacgtatgccgaaggcacggtgggggacaccggcacaggcatcgtctccaagccgaacgaccgcgtgtccgcagtcgaatggaattccggcaaacgcgctggaatactgaccatcgacggtgagatcgaccagccggtgctcgtcaaaatgcatggcaccggcaaggacctcgacgcgttccacctgtcgatcatcgcagccgaccgcgcccatgccgacgtggtcgtcgaacatgacggcgacgcacgtctcgccgaaggcgtggaaatcaccacaggcaaggactcccacatttccaccaccttcatccaggaatggaacaaggactccaaacacgtcggcaaccagcgcatccacgtgggcgaggaggcgtccctgcgccattccgtggtcaccctcggtggtgatgtcgtgcgcattcgcatggaccaggacttcggcggcgaacagggcgacctcaacatgctcggcatctacttcgtggacccggacgagcatatcgaacaccgcacgatggtggtgcacaaccatcccgaatgcaagagccgcgtggtctacaagggcgcgctcgacggcaagggcgcgcactccacatgggtcggcaacgcgctgatcgagcctaccgcgccaggcaccgactcctacgagctcaaccgcaatctggtgctcaccccaggtgccatcgccgattccgagccgaatctggaaatcgaaaacggcaacatcatcggtgccggccacgcctcatccgtcggacgattcgacgacgaagagctgttctacctcgaatcgcgcggcatctcggaaaacgaggcccgcaagctcgtggtgcgtggcttcttcggcgagctcgtcgaggaaatcggcattccggcgatttccgagcatcttatgaacgtcatcgacaagcgcctggcccgcggcgaaagcgacgcgatcgcacaggtattggaagagaaataatcgtcaggagaaaccatgtcaacccttgaaatcaaagatctgtacgcgcacgtcgaaaccaaggacggcatcaagccgatcctcaaaggcgtgaacctgaccgtcaactccggtgaaacccatgccatcatgggccccaacggttccggcaaatccaccctggcatacacgctggccggccacccgaagtacatcgtcgactccggccaggtgctgctcgacggcgaggacatcctcaagatgaccccggacgagcgagccaaggcgggcatcttcctggccatgcagtacccggtcgaagtgccgggcgtgtccatgaccaatttcctgcgcaccgccaaaaccgaagtggacggcaaggcgccggccatccgtacgtggacgaaggaactgtccgaagccatgaagcggctcaagatggacccgaagttcgccacccgttccgtgaacgaaggcttctccggcggtgagaagaagcgcgcggaagtgctgcagctcgaactgctcaagccgaagttcgccatcctcgacgaaaccgactccggcctcgacgtcgacgcgctgcgcatcgtttccgaaggtgtgaaccgtgccaaagaagccaaccagttcggtatcctcatggtcacccactacacccgcatcctgcgttacatcaagccggacatcgtgcacgtgttcgccgacggccacttcatcaagaccggcggtccggaactcgccgacgagcttgaggagaccggctacgacgcatacctgccggaaggctccgattcggaaagcgcattggcatgaccgatttcgcagcgatccgcagccaatttccgattctcgaccaggaaatccacggccatccgctggtatacctcgattccgccgcgacatcgcagaagccgcagtgcgtgatcgacgcggaatcggacttctaccgcaccatcaacgccggagtgcaccgaggcgcgcatgagcttgccgcgcgtagcaccatggcgttcgaggatgcgcgcgccaaagtggccaagctggttggcgccgattcggcggaaggcgaagaggagatcgtcgtcaccgccggcgccaccgcaggactgaacctgttggccaccgcattcggcaacgcgtcgcttggacgcgggggagaggccgccaagcgtttcgcgttgaaaccgggcgatgagatcgtcgtcaccaaggcggaacaccattccgtgctgctgccgttccaggaacttgcgctgcgcaccggcgccacgctcaaatggttcgacttggacgaggaaggccgtgtgcgttccgacaccgcgaacgaagtaatcaccgaccgcacgaagatcgttgccgtcacgcatgtgggcaataccacaggagcgattaccgacatcgcgccgattatccgccgcgcccacgaggtgggtgccgtgttcgtgctcgacgcatgccagtccgtgccgcacctcaaagtggatttccacgctttggacgtcgacttcgccgcatggagcgcccacaaaatgtatggcccgaccggcgtcggattcctctatggcaagcgtgaaatgcttgaggcattgcctccggccaatttcggcggatccatggtggagcttgcctggatggaccaggaagcccagtacatggagcctcccgcacgattcgaagcgggcacgcagccggtggcacaggtcgtcgccgccggtgtcgccgccgaatggctgatgaacatcggcatggaaaacctcgaggcgcacgaacgcaccatcaccgacgaactgctcaaaatgggcgatatcgacggcatccgaatcctcggaccccgctccaacaaggagcgcatcggtaccgtcgcgttcgaagtcgaaggcgtgcacccgcacgacgtcggccagttcatcgacgcgcagggcatcgccatccgcgtcggacaccactgcgcgcagccggtgcaccgccacttcggcgtgtatgcctccaaccgcgcgtccagcggcatctacaattcggtcgaagacgcgcaggccctcatcgaggcgctcggcaaagttcgtccgttctttggagttgagtaacgaaatatgagtgattttgagatgtccggaagcgaccttgagcagatgtaccaggaagtcatcctcgaagccgcgaagaacccgcacggcaaggagcatttcgcacctgacctcgcttcggaaaacgcctcgcatgccgccgaaaccacggtgcaggccagccacgaatactgcacgccgggagaatcgcaccaattcaacccgacctgtggtgacgaggccaccatccatgccgaagtctccgatgccgagccatacaccatcgaacggctcgtatgggatggccacggatgctccatctcccaagccagcctgtccgtcatggtcgatctcgtcgaaggcaaaaccgtggacgaggccatgaaactcgccgaaaccttccataagcttatggagtcacgcggcaaaggactgaatgacgaacaggccgaggaatccttggaggacggcatcgtcttccaaggggtctcccagtatccgatgcgcatcaaatgcgcgctgctcggctgggagggcatgaaggacgccgtggccaaggctctggccgcgaaagcctgagccttcaactcggcgtttggaaaaacactagtgacaaaccccaagcgacgcgctattcttgctcaacagatacaagcaacgtccatcaacagtttggagagacaatgagcgacaccctggtacccgaaccgcaggcgtcgatcttcgattccgtgaccaaggccttgggcaacgatgaggacgcggcccgtcgcgtcatgctcaatccgaacctggccaaagggttcaaggacggcaaaccggtgaacaaggaatccaaaaaagacgggcaggacacttgcggctgtggcaatcatgccgacgcgtgcggatgctcccaaccgcaggatgacgacattccgctgaaagccgtcgacgatatcggacgtgccacggcagctgacgtgaaagaagccctgcaccaggtcatcgacccggaactcggcatcgacgtcatcgaccttggtctggtttacggcatcgaaatcgacgaactgggccgagccatcatcacgatgacgctcaccacgccggcctgcccgctgaccgacctgatcgaagacgaatgcgccagcaccctcgccggtctcgtcgaagaattccgcatcgactggacctggcaacctcgttggacgatggacaagatcatgccggaaggccgtgaccagctcgccgcgctcggcttcaatttcgacaatctgccgaaatactgacgtttgctgcggttgccgtgcagtgaaccgcagccgccaaacgtaagaaaaacggaacaacatacgaaaggcgcgcctcccgaacggggaagcgcgcctttcgtattacgacgtatgtcagtcgtcgaccacggtacccttcggcaccacggtgatgccttccggcgtgacggtgaagccacgcgccaaatcatgctcggtatcgatgccaacggtcgaattctccgtcaacacgacgttcttgtcgagaatcgccttgtagacccgcgcgcgacggttgacgaccacaccgtcgaacagaatcgaatcgacgacctgagaccacgaatggatgcgcacgttcggcgacaggacggaatggtgcacctcgccgccggaaacgatgacgccgggggagacgatcgaatcggtggcatggcccaggcggtcgcggccggcatgcacgaacttcgccggcggcaggttgccggacagcgtgtagataggccattcggtgttgtacaggttgaactccggcacataggagatcagatccatatgcgcatcgtagaactgcttcagcgtgcccacgtcacgccagtaggcgtggtcggtcggtgtggctcccggaatctcgttggaattgaaatcgtagacgccggcctcgttgcgtgccgcgaaatacggcgcgatgtcgccgcccatatcatgcttcgtatcctcggccttctcatccaacgaaagcgccgcgaacaaggcatcggtgttggccacatagttgcccatggaggccaggatggaattcgggtcgtccggcagtcccgtggtggtctgcggcttctcctggaagctcttgatcatattcggatgatcgggatcgacctcgatcacaccgaactggttggactggctgatgggctgacggatgccggcaacggtgaattccgcgccggattcgatgtgctgctgcaccatctgctggaaatccatgcgatagacatggtcggcgccgacaatcaccacgatgtcgggctgcacgtcctcaatgatgttgatggtctggtagatggcgtcggccgagccgagataccaatgcttgccgagacgctgctgcgccggcacaggggagacgtagttgcccaacagcggcgagaaacgccatacagtggagatatggcggtcaagcgaatgggacttgtactgggtaagcacgaccgtctgcatgtagccggaattcaccagattgctcagcggaaaatcaatcagacggaacacgccgccgaatgggacggcaggcttggccctgtccctggtcaatggcatcagacgggtgccctcaccgcctgccagcacgatggaaagaatctttgggttcttcgccatgggaactcctctctgagagcgtcttgcgacaccgtacgcacggtcggtccgcttcatcacgaaaccgcttacgcacactatgattgcataaattcagcaaatcgcaaggagtttgcagcgcgagtcttgaaaatttccagttcgtttcagcaacgtttcaccatgcgttcatgcgcgtctcacgcatgatggtccactcgacgcgtcgcatagaaggcgaccgcgcttgatgcggcgacattgagactgtccacgccgtggctcatgggaatcttcaccgtaaggtcggcgcgggagatggtgtggtgcgacagtccatctccttcggtaccgaaaatcaacgcgagcttgtcaatatggtcgctttcagtctcggcgttgttgagacggcggaccaattcggccaaagaaatggaatcatcctcaagcgccatcgctacggtggtgaaccccagatcatgcagttcccgcatgccggtgaacggccaataatgcttgtcgtcccctccgatgcgcgtccacggcacttggaacaccgtgcccatggacacgcgtgccgcgcgccggtacaacgggtcgccacaggacggagtgacgagcaccgcatccacgtcgagcgccgcagccgaacgcatgagagcgcccacattcgtgtggtcgacgatattctccatgaccgcgacccgtcgagcgccacggcagacctcttcgacgctgggcagggaccagcgtttcatcgcggcaagggctccgcgatgcagccggtagccggttagacgtttgagctgctcaggcgaagcgacatacacgggaatgccatcgccccaacgtttctcgatgacatcgaacatgccgctcatgccgtcgatccacgactcctcgaccagcagggaaatcggctcgcgtccagcggccagggcacggtctatcactttgggcgattcggcgatgaacaatcccttgctgggctccagcctgttgcgcagctggatttccgtgagattcacataagccgccacacgctcgtcgtcgatggagtcaagatgaatgaaccgcattgcccgtattccgccaatctttcgtcagatacaagaaaaccccttgtctccaaggggtttattccggtgtccggagcgggacttgaacccgcacgcctgtataaaataggcactagcacctcaagctagcgcgtctaccattccgccacccggacaggtgtgttgctcagcggcaacgaatgaaaactatagcagttgaaatccatgatgcaaatcccggcgtgtcgcgataggtccgatatgggttatgtggggttcctgataggctcggaagctatgactgatgccctttttctgcttgatacggaccatgacgacgtaccggtgaacagcgacgagctcaacgccggatggaggctgacgcttccctcatccgtacgcaggcacgccatccaggccatgcgattgaaggacggcgacgaactgcagctttccgacggcaggggattgcgcatccacgccgtactgcgcgacgtgcagcagggaatcgcggaagtgctgcgattcggcaaggagccgcagccggtcaccaggctcgcgctggtgcaggctctcgccaaaaccggccatgacgagcaggcgatcgatatggccacgcagatcggcgtcgatcaggtgattccctggcaggccgaccgttccatcgccaaatggaaggcaggacgtactgacaaaaagtggaggcaggtgctggaatccgccaccgaacagtcgcgcagatcgtggacgccccagctggacgattgcgtgaccagcaagcaggtggtcgccatctgcaagcgcgcatgcgtgcatggcgacatggtgatcgtgctgcatcaagatgccacgaagacctgggaacaactggaaaccggtatcgccaaactgtccgatacgtgtctgaaggacggacgtccgcgcaccatatatgtgctcgtcggtccggaaggcggcatcagcgacgccgaagtcgaggcgttcacgaaagccggcgccgaagtgtgcgtgctgggaagcaacatcctacgtgcgtccaccgccggtccggtcgcgctgtcattgctcgcgcgagcattgggacgtttcgtctgatcccggctccattgcgtgaaattgccggaatcgccccgtttcctgctggtgtagcatggtagcgaaggtttttccaataccgataaggagcgttatgagcgacaaggattgcctgttctgcaagatcatcgcaggtgagattcccagcgagaaggtgtacgaggacgatgccacctacgccttcaaggacatcaatccgaaagccaaggtgcacgtactgatcgtgccgcgcaagcactacgcgaacgtcgccgaactcgccaaagaggatccggcacagctcgcccacatggccgaagtggcgcagaaaatcgccgaccaggagttccatggcgccttccgtctgatcttcaacaccggaatcgacgccggacagaccgtgttccacgtgcacgcccacgtgcttaccggcgaaaagctcgacgaatagtccacatactgcctaccgccaataccgacatcggaagaggttctgtgcccaccactacacgcaccatcgcgataccccaacagcttgatccggtgaccgtgctcggccctgtggacgaggtacttcgggaagtcgaacgtgcgttccccgacctgaccatcatcgtacggggcaaccgcatcgccatcatgtcgcattccagcaaatccgaatcccaagccgcccaagccgaacaggtggttgccgatatcatccaagccgcctataccgcgccgatggacgccgataccgtccgtcgcatgctcgaccagaacgtgcttaaaaatccggtccgcgccacacatcccggccacggccgcgtggtggaggaattgcgcatggccggcaggcaacagtcgcacgcgtcccatcgtgaggaaaccgccgacaggcggcgtcctcacgtgccgggcgtcatcaccttcgcgctcggcaaaccggtccgtgccaaaaccgccggacagatagcctacgtcaacgccatcgaatcgcacaccatcaccttcgccatcggaccggcaggcaccggcaaaacctatcttgccgtagccaaagcggtacgtgctttccaagacaggcaggtccggcgcatcatactgacccgtcccgccgtcgaagcaggggagaacctcggtttcctgccgggcacgctcaacgaaaaggtcgacccgtacctgcgaccgctgtacgacgcgctgtccgacatgctcggagcggaccagctcaagcgatacatggacgacggcaccatcgaagtggcgccgctcgcctacatgcgcggccgcacgctcaacgacgcgttcgtgatcctcgacgaggcccagaacaccaccgaacagcagatgaagatgttcctgacccgactgggattcaacaccaaaatggtcatcaccggcgacgtgacccaagtggatctgaccgtgccgaaatcaggtctggccaccatcgaacgcatcctcgacggcatcgacgacatcgccttcgcccacctgaagcccgaagacgtggtccgccacgcgctcgtgggcaaaatcgtcgccgcttacgacaggcacacggccatagcgggagaccacagcagaagcgcgcgtgccgcatcatcgcaaccattcgacgacaagaacaaggaaaacgcataaatgagcgttgaagtgacgaacgaaaccgcctggcagatcgacggcaaaatcttttccgacctcggcgtatgggtcatgagccagatgagggtcagcacacaatccgacctgaccatcatgttcgtggacccggatcccatcgcccaactgcacatgcgttggatgaacctcgaaggccccaccgacgtcatgagcttcccaatggacgaactgcgccccggagacggcggaaccgaaatggaaggcgtgctgggcgacatcgtgctatgcccgtgggtggccgcccagcaggcgctcgcggccggccacagcaccatggaggaaatgatgctgctgaccatccacggcatcctccacctgctcggatacgaccatgtcacacccgaacaggaacggcagatgttcggcttgcaacgccagctgctattgacgttcttcgcgcttcgacagggagccggcgcgcgggcgacgcttcccgccggcacgccggatgcgctcgccgaatgggaccgcgaacacgcggccggcggcaaaacggccaaatgacggcatgatgcatcatccgacggtttcgaaagtgggggttgacgaaccatggaaacaacgactatcacgatgattgcgattctcgtcgtcatcgcattgctgctggtctggctgtcgctgtcgatggccgcgacggaaggcgcggtgggacgtgtcacgagggcaagtctgaacaacctcattcttgagattcagacggatacggaggcgtcgcaattcatacgcgacaagaagatcaaacgcatccacaaggtgcagcggctgatcgccgaccgctacgcgaccgccggttcatgcgcgttcttccgcatcacctgcaatgtgcttgacggtgtgttggtcgccgcgatcgcgtcgttgtgcgatgcaccgttatgggcgggactgcttgtcggcttcgtgttcgcgctggtggtcgcggtgatttcgctgctggtccgtccacgtagcgcgggcgcctccaaaccggtcgatctgatgctgaagcatgccgatgcggcgtcggtcgcggtggctttgacgccgttcgctaaaatcggcggacagaaggatgcgaaacgtcattcgaatgatctgtcggacgatgaggagcttgaaaaaatccaactcgaacaagggcgcgccaccatagatcgtctggtcgaggcgaatgatttcgaccctgaggtttccgaaatgctgcgcaacgtattgacgttgtccgaaacgttgacgcgtgagatcatggtgccgcgcactgatatgatttgcatcgaacgcggggagacgctggagaacatgctgaaattgtgctcccgttccggattctcccgtataccggtcatcggcgatgatgtggatgatctggtcggcgtggcatacctgaaggatgccgtgcgcgccacggcgttcaatcccgcggcgatatcccgcgatgtcgaatccatcgtccgtgacccgatgctggtgcccgaatccaagccggtcgacgacctgttccaccagatgcagcgcacccgccagcatgtggctatcgtcgtggatgaatacggcggcatcgccggcctggtcaccatcgaagacaccatcgaacagatcgtcggcgaactggaggacgagcacgaccgtacccagcatgccgatccggaacaaatcggcgagaacaaatggagcatgccggcacgcacgcccatcgccgacttggaggagatcttcgaaatcgacatcgacgaggacgacgtcgacacggtatacggtctgctcaccaagctgcttggccgcgtgccgatcgtcggttcgacggccgtcaccaggggcctgcgcctgaccgcggtcgactccgcgggacgccgcaagaaagtgtccaccatcgtggtggaaccggcccacgtcgagggcgtggacgaaactgaacaacacgaagaccatacgaacggtgccgaagaggcatcccatgacgacaaggattccaaggacaagcatgactgacgcagatgtgaccgaaccggcttcccagcattccgacgccgaagcccccgttccatatcgttccggcttcgtcgcggtggtcggacgtccgaacgtcggcaaatcgacgctgatcaacgcgcttatcggcacgcagatcgccatcgcctcatcccgtccggagactacacgtaaggccatccgcggcattctgaccacagacaacgcgcagatcgtgctggtcgatacccccggtatccaccgtccgcgtacgctgctcggacagcggctgaacgatgtcgtcgacgaatcgctatccgatgtcgacgcgatcgccttcctgctacccgccgaccaggaaatcggccccggcgacaaacgcattctgagcaggctgcgttctgatttcgccgtcaaacgcgacgacggcacattcaaatggaaggtgccgctgatcgccatcgtcaccaaaatcgacgaattggaccgaagcgctttgatcgacaagctcatcgaaatcaacgagttcgccgacttcaccgacattgtgccggtgagcgccctcgagcacgacaatctcgccgaagtacgcaacgtgctggtggagaacatgcccgaaggaccgcagatgtatccggccgagcaaatcaccgaagaacgtccggaagacaccatcgccgaactgattcgaggcgcgttcctggaggaattggatgacgagctgccgcattcgctcgccgtggtggtggattccatcgaatatccggaagacaacgacagcggcgaatcctacgcgggcaaggcgcaggtgattgtgtcgatctacgtggaacgtgattcgcagaagccgatcatcatcggacataacgcggagcatctggtacgcgtcaagaagaagctgcgcaccgcggtcaaccgcatcgtcgggcagaaggccaagctcgacctgcatgtcaaggtggccaagggatggcagtcggatcctaagcagcttgagaagctgggcttctaagccgcttaggatccgcttcgcggcgaagccgctcacttcgcctacggtcagcccactgggctgcccgtttgacggctcagccaagcagcttgagaagctgggcttctgatttttttccgggtgggaacaataaagcctgccgctgtttatgcggcaggctttcttatgctctaagcttgttggtgctggatggtcacttcttcttggtgtacatttgcgtgttcagcagggtggcgtaacgcttgatcaccttcggacggatgaccttcatggaagcggtcatcaaaccgttctcctgtgtgaactcctccggcaggatgatgaacttacgcacggattcggcacgggacacgccctcattggcctgatcgacccacttctggacttcggcgcggacggccgcgttgctggaggcctcctccatcgacatatctcggttgagacccttgctttccagccatggacgcaacgcttcctcgtcaagcgtgatcagcgcggagatgaacggacgcttgtcgccaagcaccaacgcctgagagacgaattcgcaacgcttgatgacatcctcgatcgggccaggggagacgttcttgccgccggcggtgatgatgagatccttcttgcgtccgatgatgtacaggaagccatcgtcgtcaatgcggcccaagtcgccggtcttgtaccagccatcctcggtaaaggaatcctcggtggcctcgccgttcttatggtacttcgggaacaccgaagcgcccttgacctgaatctccccatcctcggcgatacgcagctcgaaaccagggaacgcgatgccgacggaaccctgatgatacggcacgccaagcacgttgaacgcgcacggcgcggtggtttcggtcaatccgtagccttcgtagaccggcacgccggcaccacggaagaacgccaacaactccggatcaagcggcgcaccgcccgcgacgatccacttggcgcgtccgccgagcacctcacgcagcgaggcatagaccaccggatcgaacgccgcgcgacgtgccttggtaagcgttccggtcttccccttggtgctgacttccttcatataattctgcgcggcgaccacggctgcggcgaaagcaacgcccttggcgccatgaccggccttctgggaagcagcgttgtacaccttctccagcacacgcggaacaacgatcatgatggtcggcttggccacctgcaaatcggcggtcaacgtcttgatgccctgcgcgatataaatatgcagattgcttgctacgcagatgtagttgatggcacgggcgaaggaatgcgcctgaggcaggaacagcaggacggtgttcttcttgtcatgcagcagttccggcatataatcgggcagattgaacgcggtggcgcaataatgctcatgcgtcatctccacgcccttcggcgcggcggtcgaaccggacgtgtacacaatggagcacagatcggtcttctgcacggaatcgattcgcgcatcgagcgcctcatcgctcacaccggagccatacgccttgatctcgtcaagaccaccggtctcgaagcagacgatgtgctccaaagtcgggcattcggtttcggccccgtccgccttcgccttcatatcagtggtttccacgaccagcagacgcgcatcggaattgttgacgatattgcggatctgctcggcggaatcggtatcgtaaatcgtggcgagcacgccgccgcaggccatgacggccgcgtcgaacacatcccaatcgtaggaggtgcggcacatgaaagccacgccatcgcccttcttcaaaccataatgcagcaagcccttcgcgacggcgcggatgtcggcgagcgtctcatttgcggtcttggtgtgccaatcgccatcttgcttgaacgtgtacaatggttcgtcgcccatacgagcggcgcggtcggcgtagatatcgtagatggaggtgccttcgtctagcggcggattgccctctgtcttcgtggtcaacagtccggtttcggggtcaaggaacgtggtggacgggtatcccggtccccattcagcggtgtgcggcagctcgatatggccatcgggggagaggatgctgttcgggtcgttgtaatccggtgtattgccggaatcgtcgctgaccgggtgcacgaaatcgttgcccaggcgcaacgcctttcttgcgagattagtggcctgcttgttcaacgaggtgatgatggacacgtgactctcctacgtatataaacggtatctaaagaaggaatgatagcccgtcgcgcgcgacacgtcaccttacggtagcgtaaggtgacaggccatcagggaaacgggcggcgcatgccggatacagcccgtgattcgaaagatgaacgattgcggccgcgatgttgccgtgtacgttacacttgggcgctgtatctgttcattagatttctttaacgaggaagaaagggcacctatggctgaaaaagctgaagccaccgtggtcttcggagttctcaatgagacttccgaacacgagtcccgtgttgctctgacaccggatatcgtaacgaggttgcgtaaatcaggtgttacatgtctgattgagtccggtgcgggcgtcgcatcgcactacgttgatgaagattatacgaaggcgggcgcgcaggtcgtctccgccgacgatgtgatagcacgcgccgacgcgctgggttttgtggaccgtccaagcaatgagctgctcgcccgcgtcaagcagggcacatggatcattggcatgttgggatcgttcaccgatgccgattacgtcgccgcgatcgagaaggccggtctggtcggcgtcgccatggaaaagctgccgcgtcagctgagctccgcgcagtccatggacgaaatgacgtcgcagaactccgtgatgggctacaaggccgccatcgtggcagccaacgcgtacggttccttcctgccgatgatgaccaccgccgctggcaccatccgcccggccaaggtgcttattctgggcgccggtatcgccggcctgcaggccatcggcaccgccaagcgtctcggcgccgtcgtcaccgcgtacgacgtgcgtccggcatccaagggcgaagtcgaatccttgggcgccaagttcctcgaccttggtcttgacttctccaagggccagggcgaaggcggctacgcacgcgcgctgagcgccgaagagcaggcccagcagcaggccgcggtcgatcagaaggccgccggcttcgacatcgtcatcaccaccgccaaagtgccgggacgcaagcctccggtccttctgaccaaggccggtgtggccggtctgcatcgtggcgccgtcatcgtcgattgcgcggcaagcgaccttggcggcaatgtcgaaggctcctccgtcggcacccaggtcaccgacaacggcgtgaccatcatcggcgccccgtatctggccagcggcgtgtccaccaccgcatccaacctgctgagccgcaacgtggccgacgtgctggcgcatttcgtgcgtgacggcaagctcgccatcgacctgaacgaagagctcgacaacgccatggtcgtggccggccgcggcgaggaagccaagaaggaagaggagtaaagcaatggatatcgtcgttgcgatcacactgttcgtcctcgcgctgctcatcggcgtcgaggtcatcggcaaggtgcccgccaccctgcacaccccgctgatgtcgggcgccaactccatccacggcatcgtcatcgcgggcgtcgtcatcgtcgccgcgcacgccaccagtccgctcgcctgggtgttcatcttcctggccgccgtgctgggcacgatgaacgtcgtcggcggctacgtcgtcaccgaccgcatgctggagatgttcaagtccgacaagggcaagaagaaggaagaggaggccaagtaaatgggtaccctggccgaaatgctgagcacgccgctcggcgtcatcgaatggttcgtctacctgctggccgcagtgatgttcgtcatcggcctgcacctgatgaactccccgaagaccgcccgcaagggcaacatggtctccgccatcggcatggtgttcgccgtggccatggccttcatcgtgctgttcgccggtgagatctccaacggtttcaaacactccgtcgccgtcgtggtgctgatcgtcggcatcgtcatcggcgccgtggcgggcgtggtctccgccaagaaggtcaagatgaccgacatgccgcagcttgtctccgtgttcaacaccgtaggcggtggcgcggctgcgcttgttgctctgaacgacattctgacctccgccgaaactccgtccattgtggtgctcatcactgctggactgggcattatgatcggctccgtcaccttctccggctcgctgatcgcagccggcaagctgcagggcatcaagtgggtcaagaagctgagcctgccgggcaagggcttctggaacatcctgttcgtcgtgctcaccatcgtgtccttcgtgatgctgtgcgtgcagccgaaccagcgtctgctctggtcgatcctgaccaccgtgttcgccctgtgctacggcctcgtgttcgtcatcccgatcggcggcgctgatatgccggtcgtcatctccgtgttgaacgcctgcaccggcaccgcagtggccatgtccggtctggccatcaacaacatcgccctgatcgtggccggcgcgctcgtcggtgcggcgggcgtgaccctgtccatcgccatgtccaaggccatgaaccgtccgctgctgtccgtccttgccggcggctttggcggatccaacgccgctgccggcgctggtgaaggtcctgaaggcaccatgaaggaaacctccgccgacgatctggccgtccagctcgtctacgcagagaaggtcatcttcgtgccgggcttcggtctggcccaggcccaggcccagcgtgagctcgctgaccttggcaccctgctcaaggaccacggcgtcgaagtctcctacgccatccatccggtggcaggccgtatgcctggccatatgaacgtgctgctcgccgaggccaacgtcccgtatgaggagctcgtcgacctggatgacatcaatccgcagttcccgcaggccaacgtggctctggtggtcggcgccaacgacgtgaccaatccggccgcccgcaagccgggcaccccggtttccggcatgccgattctcgacgtcgacaaggcgcagaacgtggtggtcatgaagcgtggccgtggcaccggttatgccggcatccagaacgagctgtacttcgaagacaacacgcagatgctgtttggtgacgccaaggcgagtctgcaggccgtcatcgcagcggtcaaggaactcatcaactgacggaccggctcgtcgcctacgcgaagatcaggcccttcctctttttggaggaagggccttttgttattgcgcaagttgtccacagacaggtatgggggtgtggataggtggaaattgtccacttattcacttttttcaaaggattgtgacggagaggtggacggatatgcgacagtaggtgcatctctacgacgaaggagttgcatatgacagttgccgtggccacgccattcaatatggacgaacaggctttcctgcaaacgatggatcggctgatcgagcgcttcgaccggtacagctcggggcgttgtttcgcggaccttgatcggatacgtctcgaacacgatatggaaggtccgctttccctgttcgatgacgtggtgcacgagcttgcggatgacttgttcggcggcacgtcatggccggtgaacctcgacatggatatgatcatattggatcggttccaaataggctatgatgccgaattcctgaccggatgccgcaatgtggttcgtaaatacggcatgagcgcatggctgtatgaaatgattaatgatgcttccgtcgcggtggcgacgcatcggccgagcaacaggatgccgttccagcttggtctgttcgatacacgtgaggtgttccgaaggaaaaagaccaaggggaagaagagcggaggcggaaggaggaaacggctcgaatgcatgatggaatacctgcgacagacctaccgtctggccgcatacactctgttgcgatggggagggggcgagcctagggccgctgatgcggcgctgatggttctcgcttatgggggattgggtatgtgtatgctccgcgatgatccgaaagtggtcgaattgggatgtgatcccgatttccgatacaggcatgtatgcgcccagttgcaggatatgcggatcaaggcggatctggaatatgcctgttctgtggatctgagcgtcaccagctcattggaatatccggcttgcctcgatgccagatatctgtatgacgccgaacacattgtggaggcatatcggaatctgtgggatgagaacactaagcccgtcgcccaactactggccgagatcgaggacaatggcgtatatgaagtggaggatatatggaaagacccgctctatctgcatgaccttgccatctcccttatggggccgtcggcttcgggtcttctccaggaaggcttcagactgcgtgatcgaaccatgttcgagaatggtgtcaaagaacttgacagccaggcacgcaatgtgaggaaggctggtctgctgcttacccttgccggatatatctttttcgccgaaccggaggatcgcatggatgcgatgctcgcttcgcacaaggatcgcaaacgcatgttggacaactatgaaaagcttggcgaaatggccgcgaccatcgccttgtaccgtcttcctcgggatcgcgaatcgcttcgggcagtgcgggccctgctcatgcatgagacgggcgtgtacgcggacaagatgggagagctcatgggtctcgccgacgagccggacggggaagacgaagccaccgctccggtcatggggtgaaagacggttttccgcatattggacatgacaatgctttgggattgactctacaaccattgtaaggtttagccttcctgctggaagacataggccgaaacgggaggataagagacaacccatgggaaagaacctgacaacgggaagcgtgttcagaacgatcgtcaccttcgcgttgccatatctgctgtcgtatttcctgcagacgctgtacggcatggccgatctgttcatcgccggacagttcatcggcatcgacggcatcaccgcggtggcgaacggcagccaggtgctgtacatgctcaccgtggtcatcgtgggtcttgccatgggcgcgaccgtcaccatcggccgtgcggtcggcgcgaacaggctcgaccgtgcggccaaggccatcggcaacgtcatcacgctgttcgcaggaatcgcgttggcgctgacggtcgttctgctgttgaacgtgcacaacatcatctcgctgatcggcgtgccagtcgaagccgtcgagggaaccgcgcagtatctgaccatctgctatatcggcatcccgttcatcgtcgcgtacaacattatcagctcggtgttccgtgggatgggcgattcgaaaagccccatgtatttcattgcggttgcatgcttctgcaacatcgtgttcgactacctgtttatgggctggctgcgtcttggtccctcgggcgcggcattgggcaccacactggcgcaggccatcagtgtgaccgtgacattggtggcgattcgccgccggcgtacgggcatcagactgaagttcggcgatcttcgccccgatagggccatgctccgcggcattctcggcatcggagtgccgacggcggttcaggacggctgcatccagatcgccttcatcatcatcacggtcatcgccaactaccgtggcctgaacgatgcggcagctgtcggcgtcgtcgaaaaggtgatcagcgcgttgttcctggtaccgtcgtccatgctggccacggtatccgccgtctcggcgcagaacatcggtgccggcaggatggagcgagcgacgaagacactgcgatacgccaccgcgatcaccgtcgtctacggcatcgtcatatcgattgtggtggaactgacggcgggctccatcgtcggcctgttcaccaccgatgcgacggtaatcctgctgggaacacagtacatccgcagctacatcgtcgacagcatcttcgcgggcatccacttctgcttcagcggcttcttcgccgcatgcgggcgctcctatatcggattcatccacaatatcgtggccatcaccctggtccgtgtgcccggggcgtatctggcatccaagctgttcccgaacaccttgttccccatgggcgtcgccgcacccgccggatcgctgctttccgtgctgatctgtcttggcttctacgcgtggctcaagcgtcacggcgtaatttcggagaaggcgcgtgcatgacggcgagtgagcgaagtggagggcgcgacgctttgccgggtgacggcagactgttccgtataggcaaggttgcagatatgttcaatgtgtcgctgggcacgcttcggcattatgagcgttgcggcttgctggaacccgaatatatcgacccgcgcaccgggtaccggtattacggtgccaagcagttcgaggtgctgaacaccatccggtacctgcgtgtgctggatatgccgttgacgcagatagccgagttcctgcacaatcgcgacgtgcatgtcatcgaggacaagcttgttgcacagaaagccctgatcgagcgcaaacagcatgagctggaaatggtccagcggaagatcgaccatcgcttggagcggctgcgggacgctgagcagtccgaattcgacgtgatacgtgttgtgcggcaacccgcctgcaggatcgtctggatcagggattcaccgaaggtcgactcgtatctcggcctggaatattcgatccgcaagctggagcagcatcagaaggattcgctggtcttcctcggcaaggtcggcgtcggcattgacaaggaatcgttggaacagggcggatatgccgattacgggttggtgttcctattgcttgacgacgaggacgaatatgagggcgacaccgtggcattgccggagaccgattgcgtgcgcatccggttccgggggagtcatggcgatgcccccgaccggtatcgcgagctgatatggtacaccgcagagcagggtctcgacatcaccgggttctcacgtgagatcgcgttgatcgatgaagggttgacatcggatcccgcccagttcgtgaccgagatctgcatcccggtgcgctagccactttccggcgacgtgtggcgctacttggctttctccttcagggtcggcgcaagggtgccggccagcgcgcgctcgcccggcctggccaatgggccgaccagttcatgcgccgtgtacggctcctcaagataggcgatgtcggattcgctgagttttactccaagtgcttcgatgacatcatccacgcgctccgtcttcgagcagccgacgatcggtgccgtgacgtccttggcccaatgccaggcgagggcgatccgcgccatcggcacgccgagccgttccgcgagcccgtgcacgcgttcgatgatcggcatatcctgcgcacgtgcctgatcgtacttgttgcgcatggtgccgtcggtggtgccgcgtttggaatcggaatcccaggacggatgggtcagatggccggacgccatggggagtatggggtgagcgccatgttgtactgacggctgttcggtggcgtcggcatcgatggtccactgatggaactacggggaggtcttgccgaaactcataccgccaaggcagaccttggaaacttggatgccggaccatcccagtggggcgtagctcatgtcagtcatactgaagctcttctgccgttgatgttcggaaggtcagcatatcccgtttcgattggcagaaccaatacctcgcatgaatggtttgatatgcaatcgacgcatggaacgatataccatactcacattggacattctttttcgccgggcgttgaatagggaacggtacagagcataaatgaaaggacgggtcgacaatggaaaatccgagcgcattcccgatgggagaaccgaacgacggcttcgcgcagtacttcgtgggacagagctaccttgctccggtgctcgagactccgcagattgccatccataacgtgaccttcgagccgggttgccgcaacaactggcacatccatcacaacgcggcgcaggtactcatcgcggtcggcggtcgcggttactaccagatcgagggacaggagccaaaggagctcaaggccgggcaggccgtctgcatccccgcggatacgaagcactggcatggcgccgcccccggcgaatcatgctcgcatctagccttcatggtccctgcgggcgatccggcatccatgagcaacgaatggctcgagccggtggatgccgaagcctacggcaaacttgcctgaggtctgttgttcttatatggagggccatcctgcaaaagtgggatggccctttttgttgttcagggcgataacggtttgaagccttgcggcgagtggcgtcatgcgaggaaatccgcaagcagattgtacaagtagcttgtgtaagtgctatggcggccagctggaggcaatcgaaatggatacgaaagacgaatattcgacatcggatgtcgccatggaattggcgattgcggtcagcaggctgcaagctcggatgaagcatgaggccggcatcgcggaacggggcatcaccgcttcgcagcttgccatgttgaagcggctggataccgagggagaactgtcggtatcgactttggccgcgtacgaacacgtatcgcaacaggccatcacccagcgtcttgaactactgaggtccacagggtatgtcacacagcatgccgattcgaaagatcgtcgtcgtcgactggtcggcttgaccgatgaaggacatgcgttcctcgcccacgtaaccgctagccaaacaacttggctggcgcatgccatcgaatatgcattggatgacggcgagcgcggggacctcgccgctgcgaccacattgatcgaacgcatcgccgccacggaatcgctgccgacgggaggcgacacgcgatgaagacggctgataagacaagagaaactcccgcgtttcccaagaccttcatcatggcgatgatatttggggtcggtctcaaccctgtcaacagcacgcttatctcgacggcgctcgcaccgatttcacatgatttgcggattgatgccggaagggcgaccctgctgatatctgcgctgtacctgacatgtgccatcgcgcagccgacggcgggcaagctttctgagatcattggtcctcgctcggtgttcatggccggtgcggcattggtcatgattggaggactactgggtggtttcgctccgaatctcggcgtgctgctgacgtcgcgtgtgcttattggtgcgggcacatcctgtggctatcctgctgccatgctgctggttcgcagacgggccgatcgcatgggattggcggaaccgccttcgttggtcctttccattctcgctatggtgggactggtgctcatcgctgtcggtccaccgttgggcggcctgttggtcacctttttgggatggcgctccaccttcttcgtcaacgtgttggtcggcatcatcacgattgtgctgggattggcaagcatcgagcccgatgcgaagcatgaacatcgcatgaccgtatccttcttcatcgcgcatctcgatgtcatgggtctgttgctattctccatcacaatcagcgcgctgctgattgttcttatgagtttgcctactttcgacaaggtgtccggttgcgtcactgtcatcgctttgttggcttttgtcgcgtgggagttgcatgcggcaacgcctttcgtcgatgtgcgttcactcgcggcggatagtgtgatgacgttgaattttctgcgtgcgatgctcaccatgcttggcgcttatgtggtcatgtacgccttgccccagtggctggaggatgcctgccatatgaacgccggtgtttccggcatgttcatcattccgatgggggtggtggcgacagtggcttcgttatccatcgcgaagaagccgatagtgcgcctgccgttgatggtgtgctgttcggcgatggtgacggtgggcatgttgttgacttgcacgtcatccgctggcatggtcgtattgccgttgaccgcctccgctgtcgcgggactggtgttgggactcagcatgtcgaccagtcagaccgtgctatatcgccgagcggcatccgagcatattggcacgtcgtctggtctgctgcgcacgtccatctatatcgggtctatcggtgcgtcctcattgagtggcgtgttcttcggtgagacggtcactgatggagggctccacggcattggcatcacagttgcggttttgggggtcgccgcgctattggcaacggttatggatcgtacgttgcggtagtccggggaagttgtccgcatcgtgaatgatggtacggatggcctcgcgtgccggatatactggactgcggtgatgggactcgcctgaagccgttacaggcttcgaaccgcaaacccgctgatggttcctacgacatagggtgtgctgtaccttatggctttcagcggttgtggcatcgccattcttccatgtctgtcatattggttcggcacctcgctggaaagaagatacatggcacgacaacatatcattcgagtcgatctcatatgcgtggtgttccttgggggatgcatcggaaccgcattacgctacgcttgttcggtcattcccgactgcggcgcattccatatcggcacattcgcggcgaatatggccgcctgcttcgtatacgcggcgctttcggcatggctgggaggaacccgcagaatcgtgggacgcgcgaaggaatatgtgaaccgtggatgtggcatgggcatgtgtggaggattgtccaccatgtccactctcgccctcgaggaattcactatgctgcatgacggcaaagccatggattgtgcggcgtattgttgcacgaccttcatcgtgggctgtctgctggcatacgttggcgcgcatgtcgggctgcggtttgccggtactgagcataacgatggtgatcgccatgccatgggcaaggaggcggactgatgaataatgcggtcatcgccgtatcggtgtgcctgtgtggtggtctcggcgccgccgcaaggtatgtttgtgattccgttatcaaagcttcttggcataaggcatttcctttgtcgacctttgtgatcaacagtattgccggattcctggcaggcgtgattgcaggtctgtactcacgccggtttctgtcggatcccgcgcatgtgatgttggcgaccggcttccttggtggattctccacattctccaccatgatgaacgaatccgtgacgttgttgcgcggtgggcggatcaccgtgttcgtgggatatgtgctgacgtcggtggtggttcctgtgatggccgcggcattgggatattgccttgtcgtctgagactggagcgaggacgttgactcggggcgtcgtttcattgtctctgggtatggatggtttatggattaccgcgacgcggattggatagttttccatgaaaacgaggaaaaactattgtcttttccgtgtttcctcgatacattggtggctggccgcccatgacaatcgaaaggactgaccatgacgcagcagggcatgtcgaccaagtcgaggcatctgaccattcccgatctcatcacgataggtgtgttcactgccttgtatttcgtgctggtcgccgtggccacgctgttcagttccgtggctttgatgggattcggcatgattcttctgcctgcggtcgccgcattgatctgtggttgcgtatatatgctcctggttgccaaggtcggaaaattcggcgcgattagcgtgatgggcatcgtcgtcggattgttcttgttcgtatccggacatttcatcctttcccttgctgcgagcatcgtgtttccggtcatcgctgatgccatcgctcgcgccggggactatcggagcaagacaggtatcctggcgagttatgtcgtgttctgctatgggctgaccggtccgattctgccgttgtggttcatgaaggatgcctatgtggccagtctgcaggcccgtggcaaggactcgtcctatatcgatggtgtgttcgcacatgtcaataccggcacgtttttcattgccatgatagcggtactggtatgtgcgttgctcggaggctggtttgggcagcgtatgctgaagaagcattttgcgaagaccggcatcatctgatggccctggacccaagaaccaaactgtacctagtggcattggccaacctgttgctgttcttccatgtcgacgtggttgtggagtcgcttacagtattgctgcttcttctgccactgctcggcgcgggacgatgggcggctgcggtacgcttcggttgcatctatgtattgctactggtggggacttgggcatcgacgcttgacgatggcggcagctggttgcatatgcttggtttgctttgtgtcggcatccggatgatgatgccttgtctgattgccggcatatacgcattcaccacgactacggccagtcaattcgtgtgtgccctgcggcgcatgcgcattccggagacgattgtgattccatgtgtggtgtgcatccggttcttcccgacaatccatgacgattaccatcagattcgtgacgcgatggcattacgtggcatcgcccaggggacattcgccctgctccgtcatccggctcagtctttggaatacatcctgatgccgttgttgatgaacgctacgggggtcgcccaggatttgtccgtagccgcactgaccaaaggaatcggcattcgcgggcctcatacatgtcataccgaaatccgcatgcatggcattgattgggcatggatggtcatctgcacggttcctctggcattgggcattggaggagcatggtgagtatcggaagtgatatcaatcggatagtcgcatggacgcaacggtgctcattcgcatatcatgctgatgaagctgctgaggtcgatgcgctgaatgacatcagctgtgccataccgcaaggcgagattgccatcttatgtggacaaagcggctgtggcaaaaccacgtacacacgtttgctcaatggtctgatacctggtttctattccggcgatttgcagggcatccatatgacgtgcggaatccgcgccggattggctcctgtggaaagctatgtgggacaggtgggcagcgtattccagaatccgaagacgcagtatttcaatgccgattccaccgatgagctggcattcccctgcgagaatacgggcatgtctcccgcgcggattcggcaacgcgtgcatgatgtcgcggagcagtttcacatcaggcatctattaggtcgtaggatcatgacgctttcaggtggccagaagcaacagcttgctgtcgcggcatcgaccatgctggctcctggactcatcgttatggatgagccgacaagtaatttagatatggtggcgattcgcaggctgcatgacatggtctcccgattgagagctgatggaatgaccatcgtcattgccgaacaccgtcttgcatggtgcgcggatttagcggaccgtttcatagtgttcgatcacggtacgattctcggtgaatatgaggcgtccgattttctggcgatgtccgaacagcgcgtcgcggcattaggattgcgcgccctcgatgacagaccatacaggcttgccgtgcatcgtaaactccaacatggaggcattgcgcccgacgaggacaagcgacaggtcgtcattggtgtgcgcggcctgagtgtaggccatacaaagcggggacttctaggccgcaagacacccgtattcgcacgtgatattcccgatttcgacattcacgagggtgagattcttggccttatggggtcgaacggggttggcaaaagcactttggcacgtacgctatgcggtcttgccgctccgttgaacggcatggtgctattgaatgggacgaaagcgagccgcggcgctttgactcgtgccggatttctcgtcatgcaggacgtcaattaccagctcttctccgatagtgttcgggaagaggcattactgggacttgatgggatggatgacgctgtgcgtgaccgatgcgatgctgtgctacgagacctcgacctattggattccgtgcagcgccacccgatgagtttatccggcggtcaaaagcagaggctggctatagcctgcgctttgatgagcgataagcgattcattgttttggacgaaccgaccagcggactggaccggttgcatatgacccaagtcggcggacttctgcgaaagctcgcggaccgtggcaaagcggtgttggtcgtaacacatgattatgagcttgcagcgctatggtgcgaccgcatcatagcgctggaagacgaactgcataacgaacagggagaagaagaggatcgtctggcatggacttcaatgtgaacgattggctgggagactggattagcttcgaacatttgatcaacaatcatgacccgaaccttgaccgggcttggaaggattcgacgaaagccatgcgatccaagccgctgttcgcgatcatgatgctcggcgatgcgcgacgcttctgggcaaaagcctgcaaaacctcgggcaaggagtggcgattccgcattggtggatggcatatcgagcagccgtccgcagttggcgacgatgatgctgtcgcaggctttaacctgacttggctggacgaaaaacgcacccccatcacaacacatgaatatcggctcgatcatgtgcacgacaaggggctggaaggcaaaccctgctatgtgttccacgctagcgatgccggtgcctccgatcccttcgccgtactcatcgcgatggagcccatgcctgaacgctccgcgctcagacacgggggactgctcagtcatctgcattttcaatatgcctctgatgaaggcgaactcatcaaaggtactggcaaacaagccacgctccgccatcgcatgtggtatcccaccatgtgcgccgctgaagggacgttacttgatcaatgcaacatcgtacgtgcgctgcatcatcttcaagcatggcgggaactgcctgtcccatcatcagactgactgcagatgcccgaagatgggacaatatcagcattgcgacgattgtaggtatcgtccagtgacgctttccggacatgcggcgatccgagaaggcgctccctcgcatactacgcgtccgcctgcttcaccgccgcccggtcccatatccaccacatagtccgcattggcaatcacgtccaaatcatgttcgatgacgaccaccgtcgcgccattcgctacaagttcatcaaatacgtgcagcagcacgcgaacatcaagcggatgcaagccgattgtcggctcatcgaacacgaataccgcatcatgctgtttccgccccatctcgctggccaatttcaaacgctgggcctcaccgcccgacagcgcgggagttggctcgcccaacgcaagatagcccaaacccaattcatgcaacgtggcaagcttcgtttggatcggtttgacatctcgtaagacaggcatggcatcgtcgacggtcattgtcattaactgcggcatcgaatacgccactccgtcggtgcaggggagcttcagctcggcgattgcatcggaataccgcgagccatggcatgccgggcattcgatatcgacgtcaggcaggaactgcacgtcgagcgaaatcgatcccgtgccgtcgcacgtcgcgcaacgcagcttgccagtgttataggagaatgcccccgctttcagaccgatggtccgcgcagcatctgtttttgcgaacgcgcgtcgaagatcgtcatggacgccgcaatatgtagcgacggtggaacgtatgttcgcgccgataggcgtggcatcgataagatgcgccttggacacaccgtccgcctcgaggagccgcacctgcgtcggctgcggcgacctgtcgatccgcgactgcaaagcgggcatcaacatctccagtaccatcgtcgtcttgccggaaccggatacccctgttacggcggtcagccgtccacggggaatatctaccgataacgggccgacggtatgcagacggtcggtttccatatgaattcgtcctgcggagaagatttcatgggcgtcaatgttgtcacgcacacggtcatgaacgttgccaccctgggcaaggaacggcgcgatgcgcgattcgcgggtatcaatcacctgcggcaccgttccctgcgcaatcacctgaccgccctttgcgccggcacctggccccatctcgatgagataatcggtttcggccagcacccgagtgtcatgatcgaccactaccacggaattgccatcagccaccaggtcacgcatgacaccgagcagtccgtcgacattcgcgggatgcaacccaatcgacggctcatccagcacatataacacgcctgtggtgcgattgcgcacggcgcgggcaagctgcacgcgttggcgctcgccggtggacagtgtggctccggcgcggtccaaggacagatacccgagaccgagttccaataaacgccgtgacgtattgaggaacgattcacagatggcgctcgccatggtgcgcatatgtggttccagcgattccggcacggaccctacccaggaaacgagtgcgtccagagacatcgcggttgcctgagccagattgatgtctctgatacgtggctggcgggcgcgttcggaaagtctggtccctccgcaatcgctgcagggacgctctttgaggaacctcgcaacacgtttaagccctttttcgtccttggctttggtgagggcgttctccacggtgtatacggcgttgtagtacgtgaagtcgagttcggcgaaatcgtcgccttttttcggcttgtataggatgtgcttcttgatggctgggccggcgaacacgatatctcgttcttgttcggtgagttggttgaacggtacgttggtacgtactcccatggccccgcatacttgcttcatcaaatcccacatcaacgatccccacggcagcacggctccctcgtcaatgcttttcgactcatccggtaccaaggcggaacggtcgacttccctcatgattccggtgcctgagcatgtcggacacgcgcccgcggcgttgaatgcgagatcctccgctgatggcggatgcatgagtccgccgcagaacgtgcaatgcatcggaagctcggcggcaacgttcatcgtgggttggttgcgtgctccgcagtgttcgcacacgtgcgatccgatccgggagaacaggaggcgcagactgttgagcagttcgctcattgtgccgaacgtggaacggactccaggcactgatggacgctgatgcagtgccaatgccgccggaatatgacgcacctcgtcgacggttgcgcggcttgcctgggtcatacgtcttcttgtataggtcgatagcgcttccagatagcgtcgtgatccctccgcgtacagcacgccaagcgcgagggagctttttcctgagcctgagattccggctatgccgaccatgctgttgagcgggatgtcgatgtcgacgtctttcagattatgtacgtgggctccgcgcacttcgatacatgaggggagtggccgagacacttgtgtttcgtatgcaaagatagaaggagacggtttcataccggcaattctatgcttgccatatggttatcacatatacggatgaaaagaaattcaccaaggaacagacccagcgactgtttctttcagtcggctgggtgtccggtcaatatcctgaacggttgcataaggcgttgatggggtcatccaccgtattcagcgcatgggatggcgaacgtctggtgggtctggtgcgagtgcttgatgacacggagatggtggcatacatgcactatgtgctggtcgatcctgaataccaagggcgcggcattgccggacatcttgtcggcatggtcaagcagcggtaccacgattacctgtatatcgaggttatgcctgaggaaagcaagaatgccacgttctatgagaagcatggattccatattatggaggatggcgtcgccatgcagatatgcaatccgggagaacggcactgacggaacgggcatcgggcatgtcttgagaacttcgggcggtgaggggcgccatctttcgccggaggcgtttccattaccgcttatattttttggggttcggctgtcagatcttgaatgaacgacggatgaatccgtatacggtgtcccagtagcgtttcggatccacggcggagctttccatatgatcggcgtccggaaccagcagacgttcgcggtcgatgctggagcaggcgttgtagttcatgtcgaggaaacgtgggctgaccatgcggtcctttcctccatggatgaacagcatcggaatgaccgtatgccgcaatgacggtatgcaggacgcttcggtgaaatcatagccggcacggcgcttgcagatcagacccgccgcgtccacacatgccgaggcgagaagctttggcatgtggaacatgcctcgcgcgctgtctatgaattccatgcgggcggaagtgtatccgctttcggcgattgccgcgatgacattgcgtggcagttccggcgtgccggtcgtcatcatcaccgtcgtggctcccatggatcctccgaataggagaatgcgtgcttgatcgtcgctatccacaatcagccgtatccaatcaagcagatcattgcgctccaaccatcccatgcctacatatcgtccttcgctcagatcctgggcccgttgggatggtgtgaggacggtgaagcccatgcgggcatagcggtgtgcccatttggcttgttcttcaggggctccggtatagccatgcacgcagatggcatatatatgcggcgtcgggtcgatgcaatccggatcgaagagccagccatgcagcttaagcccatcgcggctggtgatggataccggctgtttcgtttcggaaaaccattgcccggcctctttggcctcgccttggttcatctttccctcgcgatccggagcgatcagcgcctgatggaaaatggaatgcttccactgcgtgtcgatggcaaagcggaacagcatatgtgctgacgccgcgagcaatcccgtcgctgcgacggtcgtgacgccagtcgcgagctgaatgttgcggatgagcgcggaatggtcatgcgtcgttgccattttctgattccttaccactggttggtgcttgtctgactacgattgtacgtgggtttgcgcatagtccgcgttttatgcaccttgctcctctgattgcagggaaatgtcagcggcaccatgtatactagataactgttgtcttggcgagggaggttccgcctccgttatcgacttggcgtatgatatgaaactccttgggttttctatgcggctcgtcggtgcgccgaaacataagaacgatgtatcaaggagatattgattatggctaccaccatcactcttgaaggtgctgctcgtaccgagttcggcaagggcgctgcccgccgcatgcgcgtcgcgaacctcatcccggccaccgtttacgcgggtggcgaggatccgaccttcgtgcagctgccgatgaaggagaccactctggctctgcgtcacaccaacgccctgttcaccatcaagtatggtgacgagaccaagatggccgttgtcaaggacgtccagcgcaacccggtgaagcgcatcgtcgagcatgtcgatttctacgaggtcaaggccggcgagaagatcgacgtcgaggtgccggtgttcgttgagggtactccgaagggcgctgccgtcgcgttcgtcgacatccaggagctcaaggtccgcgccgatgtggccaacctgccggagaagatcgtggtcaacgttgatggcctgaccgatggttccaaggtcttcgccaaggacgttgtgctgccggaaggcgtcgtactcgatgtcgaggatccggaagaatccgtcgtcaccgtcgaggtgccggaagatgccgcaccggttgaggccgctccggctgctgacgccgctgccgctccggctgctgacgctgagtgagatcgttgctcaagctgatttgattccgatatgcctgccatatcggtagtacaaggtccctgtgtgtgaaaacacgtggggacctttgcgtttccttatgtttcttgctatctcatatcgcgaacgccggttatcgaaagcgtttatggtgtgagaaagtacataccagaacccggcgccacaagcgccggagaccaataaccgctggccgcctttgggtggctgatgcaactagaagaagtaaagaatgactgaacagaatcatcacgatccggcggagcttgacaagctcgctgagaagttcaccgtgctcccgaacgacaatccggcatccgacgccaagcgcgccgaactcatcgacaagccggccttcggtcaggtcttctccgacaatatggcccacatgacctggaccaagggtgaaggctggtccgaccgtcgcatcgagccgtacgcgccgctgaagatggatccgggcgcatctgttctgcattacgcccaggaatgcttcgaaggtctgaaggcctaccgtcacgccgacggctccacctggctgttccgcccggacgcgaacgccgagcgtttccagaactccgccaagcgcctgtacctgccggaactgccgatcgacgacttcatcggctctgtcgcggcactggtcaagcgtgatgtgaactgggttccgtcccgtcgcgaatacacgctgtacatgcgtccgttcatgttcgcttccgagccgttccttggtgtgcgcgctccgcaggaagtggattattgcgtgatcgcctccccgtccggcccgtacttcccgggcggcgtgaagccggtcagcatctgggtcgaggacaagtggttccgcaccggccctggcggcactggcttcgccaagtgcggcggcaactacgcagcctctctgctcggtgaatacaccggcatcgaccatggctgccagcaggtgtgcttcgtcgacgccgccaccaagacctacctggaggagcttggcggcatgaacatgatggtcgtgcacaaggacggccacgtggaaaccccgtccctgaccggcaacatcctgccgggcgtgacccgccgctccctgatccagctcatccaggacaacggccacgatgtggtcgagaccatgatcgccctggatcagctgcttgaggacatcaagtccggcgaagtcaccgaggtgttcgcctgcggtaccgccgccatcatcaccccgatcggtcgcttcaagtccgagaagttcgatgtgaccgtcgccgacggcggttccggcgagttcaccctcgcactgcgcaaccagctgctcggcatccagcttggcgagatcgaagacccacacaactggatgtggaaggtctgctgattttcccgttagcgattattagctgacatatagctgtaatggccgccggagggtggcgcgtgcttcaggccaagttcacatggtctgacaatgtacgtgccgccctccggctcttttattgcagctcttgccccatattgtgctatttttaacagctggttggaaaagaaatatgtgagggaaggggagtggccatggaagtggcgctggaaagcaacggcttcttcataggtatcgaatatctggcgaccttctgctgcggcatggtcggcgggctcgccgccgtacgcaaaggctatgatatttttgcgattcttgtcaccacatggctcaccgcattgggtggcggcatcattcgtgatgtgctgctcggagcgcttcctcccgcaggcgtctccgacaaagggctggtgatcaccgcactgctcgcagctgtggccgtagccatcatttatcccgaagtcgacaagctcaaatggtccatgctgtcattggacgcgctggcattgggcctttacgccgtcaacggcacatccaaagccatgatgtaccacatgtccggcaccacggcagtgttcctgggcatgttcacggcacttggcggcggactcatccgtgacatgctcatcaacgaggtgcccatggtgatccgcgacaagcattggtacgcggtgccttcagccgttggatgcgtattgacggtactcgtatgtaaaggagtgaacgagggaatcgtcagttttcccgccgaagtcgtgcttgatgtgctgattgtagtgctggtggtggccatgcggcttatctccgtgtttttcgacattcaattgccgggggctttggccaggcataacacctacctgccgagcgaagccaaatatctcaaacgtccggtcatccatcccgatcggaatgatgacgatatcaagcgtaagtgagcattttcaacagagcacgaaatgtaaaaaagaagaagccccgcaggttttcctgcggggcttcttacaagctgtgagttacgaaaactcagagagcgttgatggccacagcgagaccggacttgcggttggcagcctggttcttgtggatcacgccagcgccggcggccttgtcgagcttctgggctgcgaccttgtaggcggcttcggcggcggccttatcgccagcggcgatggcttcgcgggtggcgcgaacggcagtcttcaggctggacttcacggccacgttacgcttgtgcgccttctcgttggtgagaacgcgcttcttctgcgacttgatgtttgccactatttctccaaacgacgtttgctataaggacatacaaacgatgatgataacatggcacgcggataaatcgccaatgcgtataagagtgtcgcggaaggacatgccgacactaccagttagaatcgtttgcgtcgaatatttccagaggaggatggcgtggggcagcagcataatcagcccgggtacaccgatcagtcgttgatccgcaacttttgcatcatcgcgcatatcgatcacggcaaatcaacggtggcggaccgtattctgcagttgagtggcatcgtgccggagcgcgagatgcgcgatcgcttcctcgaccgcatggatatcgagcaggaacgcggcatcaccatcaaatcgcaggccgtgcgcgtgccgtggacggttgacggcaccgaatacacactcggcatgattgatacccccggccatgtggacttcacatacgaggtgtcccgagcgttggccgcatgcgagggtgcggtgctgcttgtcgacgccacgcagggcattgaagcgcagacgctgtccaacctgtatatggccatcgaccatgatctggccatcatccccgtgctcaacaaaatcgacctgcccagcgccgaacccgacaagcatgccgaggaaatcgccggcctgattggttgtgacccgtccgacgtgttgcgcgtctccggcaaaaccggagaaggcgtcgccgaactgctcgaccgtatcgtcgccgaagtgcccgcgccgacgggcaatccggacgcgcctgcccgcgcgctcattttcgactccgtatacgactcctatcgtggcatcgtcacttacattcgtatggtcgacggtgaactgaaatcgcgcgagaagctgcacatgatgggtatcggcatgacgcatgaccccatcgaaatcggcgtgatcagccccgacatgatgcccaccaaggcgcttggcgcaggagaggtcggctatgtgatcaccggagcgaaagacgtcagccagtccaaggtgggcgacaccatcacctccgccataaatccggctaccgagccgctcgaaggctaccgtgatccgcaaccaatggtctacgccggcctgttcccaatcgacaacgcgcaatatccggaactgcgcgaggcgcttgacaagctcaagctcaacgacgcggccctcatctacgaaccggaaacctccgtggcgttgggcttcggctttcgttgcggcttcctgggcttgctgcacatggagatcgtcaccgaacgtttgagccgcgaattcgaccttgacctgatctccaccgcgccgaacgtgccgtacgaggtcaccgcggaagacaattccgtgcatcgcgtcaccaatccgagcgaattccccgaaggcaagatcaagaagatcgtcgaaccgatggttgccgccgacatcatcacgccgaaggatttcatcggtgcggtgatggacctgtgccaagaccaccgtggccagatgggcaccatggaatacatttccgccgaccgtgtggaaatgcattaccgtattccactcgccgaaatcgtcttcgacttcttcgaccaactgaagagccgtaccaaggggtatgcgtcgctcgactaccacgaggatggcgaacagtccgccgatctggtgaaggtcgacatccttattcaaggcgagaaagtcgatgcgttcagcgccatcgtgcaccgtgacaaggcgtacagctatggcgtgatgatgaccaagaagctgcgtgagctcattccgcgtcagcagttcgagattcccatccaggctgccatcggttctcgaatcatcgcacgcgaaaccatccgcgccctgcgcaaggacgtgctcgccaagtgttacggcggcgacatctcccgtaagcgtaagctgctcgaaaagcagaaggccggcaagaagcgtatgaagatgctcggccatgtggaagtgccgcaggaggcgttcatcgcagccctgtccaccggcgaagcgggcaacgaccgcgacaccaaggacaagattcgcgccgcgcagaagtccgaaggctgagcctttcgtgacgttcgaaatctacattcatgttccgttttgcttacgtcgctgcggctattgcgacttcaacacctacacggccgtggacatgggcgcgggcgcgtcacgcggcaactacgcgaacatggttatccgcgaaatggcgattgtccgcgattggcagacaacgcacggtatcaacgagccgaaggtggcaaccgtcttcttcggcggcggtacgccgaccacactcaaggcaagcgatttggtcgccatgctggatgcggtacgcgccacatggggcatcgccgatgacgcggaaatcaccaccgaagcgaatcccgacacggtgaatgccgactatgtgaaagaactcgcagacggcggtttcaatcgtatttccttcggcatgcaatccgcggtaccgcatgtgcttgcaacgctcgaccgtacgcatacgccggaaaacgtcgctgccggaatcgcagcggccaatgcagcaggcatgcgttccagcgtcgatctgatctacggcgcgccgggggagagccttgacgattggcgcacatccgtccgcaccgccatcgatttgggcgtcaaccatatttccgcatatgcgctcaccatcgcgccgaatacgaaaatgggacgacggatcgcggcgggcacgttgtcgagaccggacgatgacgacgaagcgaacaaatacgaaatcgccgacacgatgttcaccgaagccggcctcgaatggtatgagattagcaattgggctcgtcctggatacgagtcgcaacacaaccttggctattggaggaacgtcgattgggccggtctcggtcccggtgcgcattcgcattatggcgattgcgaagacggcaaaggattgcgctcctgggatatcgcgcatccgcgattgtggggcaccgccatcaatgagggcaatgtgccatgggccggcagtgaacgcatcactgccgacgaggacatcgaagagaccatcatgttgggcctgcgcattcgtgaaggactcgacaccagacaattcagccacttgattcctgagcaaaaatggattgagcttgagcacgacgggctgatcacaatgcttgatggccgcgccatacccactttgcgaggccgactgctcaacgacaccatcatcacggagctgttggaaacactggactgaccgggttaatgagcataagtgaagtgcgtgcgcatgagcatgacatgcgaagtatgcgttcatgggctaaatcctctgcgaggcattgacaaaaatagccattcgttatatggacacgtgcaacgttgccgacataatggcgcggtattctaaaccacgcattaaagaaccgcaagacttttcttgcccaaaaacattgaaggtggtttcggtgactttccacgccccgttagatctgacgatccatgattcccaaggtatgtacgatcctggagccgagcatgacgcttgcggcgtgggtatggtcaccaccctcaacaagcgtccggaacgcaagatcgtcgatgacgccatcgaggtgctggtcaatctgaaccatcgtggtgccgtgggcgccgaggagaacacgggcgacggcgcaggcattctcatgagtatgcctgacgaattcatgcgtgccaccgccggtgtggagcttcctgaagaaggccattacgccgcgggcatcgccttcttggatcgcgacatcgccacttccggccagcaggagcaggccatttccaagatcgtgcgcgaagagggcctcgaagtgctcgcatggcgcgtcgtacccaccaatccggacggactcggcctgcagtcgttggccagcatgccggcgttcaagacgctggtcgtggccgatccggaaggcgaactcggtggcatcgagctcgatcgcaagaccttccgcatccgcaagcgtgtggaacatgaggtgggcatctacttcgcgtccctgtccgcacgcaccatcacctacaagggcatgctcaccaccatgcagctcaagcccttcttcctggacctgtccgacgagcgcatgaaggcgaaaatcgccatcgtgcattcccgcttctccaccaacacgttcccaagctggccgctggcacagccgttccgccagctggcgcacaacggcgagatcaacaccatccaaggcaaccgcaactggctgtccgcacgtgaaggccgactgagttccgaactgctcggtgaattcaagccgctgctgccgatcgccacctccggctattccgattccggcactttcgacgaatgcctcgaactgctgcacctcgccggccgttccatgccgcacgccatctccatgatgctgccgccggcatgggagaacaacgaccagctcgatccggacgtcaaggctttctacgaatacaacaacacgctgatcgaaccatgggatggcccggcgcacatcatcttcaccgacggcacccaggtcggcgcactgctcgaccgcaacggcttccgcccgggacgttggcaggtcaccgatgacggctacgtcgtgctcgcgtccgaaaccggtgtgctgccggaagtcgccgaggagcatatcgtcaccaagggccgtctggaaccgggcaagatgttcctcgtcgacaccgacgagggtcgcatcatccccgacgaggaaatcaagaagactcttgccagccagcacccctaccgcaagtgggtggaaggcaactccgtggaattgagtcagctgcccaagcgcgagcacgtcaaccactccggtcagtccgtgcagcgtcgtcagcgcgccttcggctacaccgaggaagatctgaagctgctgctcgccccaatggccaacaccggcaaggagccgctcggctccatgggcaacgatacgccgctcgccgcgctgtccaagcacagccgcatgctgttcgattacttcacccagaagttcgcgcaagtcaccaacccgccgctcgactgggaacgtgagaagatcgtgaccagcctcgaatccgccatcggtcccgagccgaacctgctggccgattccgaactgcacgccaagaagatcctcatcccgctgccggtgctcaactccgacgagatggcacagctcaagcgcctcgaccgcgccaagattctcggtggctattacaagccgttcatcgtcaagggcctttaccaggtggccggcggcggacaggcactgaaggaccgtcttgacgagatcttccaggagatcgacgaggcgattgagaacggtgccaacttcctggtgctgtccgaccgcgattccaactatgcgtggggtccgattccatcgttgctgctcacttccgcagtgcagcaccatctgctgcgccgccacacgcgtacgcagatctccatggtggtcgaagccggcgatgtacgcgaaatccaccatgtggcactgctgatcgcctatggcgctgccgcggtgaacccgtatctggcattcgaatccgtcgaagacctctcccgcaagggctacctcaaggtcgacgcggaaaccgccgtgaagaacctgacccgcgcgctgtccaccggcgtgctcaagatcatggccaagatgggtgtctccaccatcatgagctaccgtggcgcgcagctgttcgaagcggtcggcctcaacaaggacgtcatcgacgagtacttcaccggcaccacgtcccgtgtgggcggcgtcggcctcgacgagctcgccgaggaagtcgccagccgccatcgcgtggcgtatccgacccaatggaccgcccgcccgcaccgcaacctgcgtaccggcggcgactacaagtggcgtcgtaccggcgaggaccatctgaacgatccggaagccatcttcctgctgcagcagtccacccagcgcggcgactacaacctgttcaagaagtactcgaaccacatcaacgacacctccaaccgtctgatgacgctgcgtggcctgatgaagttcaagtccactcgcaagccgatcgacatttccgaagtcgagccggccagcgaaatcgtcaagcgtttctccaccggcgccatgagctacggctccatctcccaggaggcgcatgagacgctcgccattgccatgaacacgattggcgcacgctccaactccggtgaaggcggcgaatccgaggatcgtatcaacgatccgctgcgctacagcaagatcaagcagattgcttcggcccgcttcggtgtgaccagcgactatctggtgcatgccaccgacctgcagatcaagctcgcccagggcgcgaagcctggcgaaggtggccacctgccgggagccaaggttccgccgtggatcgccaaggtacgtcacgccaccccgggcgtggagctcatctccccaccgccgcaccacgacatctactccattgaggatctgaagcagctgatcaacgatgcgaagatggccaatccgaaggcccgcatccacgtcaagctcgtctccgaattcggcgtcggcaccatcgctgccggcgtggccaagtgccatgccgatgtggtgctgatttccggctatgacggcggcaccggcgcggctccgctcaacgccatcaagcatgccggcaccccgtgggagatcggcctgtccgaaacccagcagacgctggttctgaacggcctgcgttcccgcatcaccgtgcagtgcgacggcgagctcaagaccggtcgcgacgtggtgatcgccgcgctgcttggcgccgaggaattcggcttcgccaccgccgcgctgatcgtcgaaggctgcgtcatgatgcgcgcctgccagaagaacacctgcccgcagggtatcgccacccaggatccggagctccgagcacgcttcaagggcaagccggaacatgtcgtcaacttcttcatgttcatcgccgaggaagtccgcgaactgctcgcgcagctcggcttccgcacgctggaagaggccgtcggccatgtcgaatgcctcgaccaggacgaagccatcaagcgttggaagtccgacggcatcgacctgagcaacgtgctcatgcagccgggtccggttccgggaaccatcctgcacaagacgatcgatcagaaccatgagctcgacaaggcgctcgacaacaagctcatcgagcttgcccagccagcccttgacaagaaggagcccgtgcgtatcgaaatgccgatccgcaacgtgtaccgtacgctcggcaccatgctcggctatgagatcaccaagcgttacggcgaggaaggtctgccggacgacaccatcggcatgacgttccatggtgccggcggccagtccattggcgcgttcattccgcgtggcgaaaccatccgcgtctacggcgaagtcaacgactacgcgggtaagggcctgtccggcggccgcatggtggtccgtccagaggacggcatcaccttcgatccgcacgagaacgtgatcgcaggcaatgtcaccggcttcggcgcgacttccggccaaatgttcgtggccggccgcgcaggcgaacgtttcgccgtacgtaacggcggcgccaccttcgtggtggaaggcgtgggcgaccacggctgcgaatacatgaccggcggtacggtcgtgattctcggctccaccggccgtaacctcggcgcgggcttctccggcggcaacgtgtacgtgctcgacctcgacatgaagcaggtcaacccggcggccgccaccaacggcgcgctgctgttcgagccgcttgacgccgatgccgacaagctggtgcacggtctcgtcaagcagcatgccgaagagaccggctccgccttcgcgaaggccctgcttgacgactgggaaaacagcgccaagcgattcacccacatcgttccgaagcacttcctcgccatgcagaaggcgatgaaggaagccgaggagaagaacatcgatttcaatacgcccggcgtctgggaacaggtgtacgagcaggttatggaaggagcgcgctgacatgggagatcctcgtggattcctgaaggtccgtacccgtcgcgaactggccgaacgccccgttgaagagcgaatcaaggactggttcgacgttcacaccgaatccggcctgcagtcctggaccaccgagcaggcggcccgctgcatggattgcggcactccgttctgcatgagcggatgcccgctcggcaacatcattccggaattcaacgatctggtccgtcaggagaagtgggaggacgcgtacaaccgtctgtccgaaaccaacaacttccccgaagtgaccggtcgcatctgcccggcattgtgcgaagccgcctgcgtgcttggcatccatcagccggccacgatgattcagaacgacgaacgcaccatcatcgatcaggcatggagccttgactacgtcaagcctctgccgccgcagcgtctgaccgaccagaccgttgccgtggtcggttccggcccatccggtctcgcctgcgcccagcagctcacccgtgccggccacaccgtggtcgtatacgagcgtgatgacgccatcggtggtctgatgcgttacggcattccgaacttcaaactcgacaagcgcctcatcgaccgccgagtcgagcagatgggagccgaaggcaccgtgttccgcaccggcgtggaaatcggcaaggacatctcctgggatgacctgcgttcccgctacgacgcagtggtggttgccatcggctccaccgtgccgcgtgacatgaagattccaggccgcgagctcaagggtatccatttcgccatggagttcctgccggacgccacacgtcgcgtgtacggtgtcaagccggtcaacgacatcaccgccgaaggcaagcatgtggtgatcatcggcggcggcgacaccggttccgactgcctcggcacatccctgcgccaaggcgctaaggacgtcaccgtgctgcagatcatgccgcaggaaccgaaggagcgtccggccaaccagccatggccgaccttcgcccgcctgtacaaggaaacctcctccatgaaggaaggtttcgaaacgcagcgcgccgaatacgtgtacaacaccgactcggtcaacttcgagggctccgacgaggacaaggccaaggtgaaggtggagaactccaccgccaccgaaggcttcgtcgccgacgagaacggacatgtcaccggtctgaaggtcgtcaacgtcgctccaggagagaacgggccgttcacccgccagccaggcaccgaacgagtgattcccgccgatctggtgctcatctccgtgggcttcctgcaccctgacaccaccacgctggtggatcagctgccggtcgaccttgacggtcgaggcaatgtggcgcgtaacgacaagttcgccacctcccaggacggcgtcttcgcctgcggcgatgccggacgtggccagagcctcgtcgtgtgggccatctccgaaggtcgctcctgcgcggccgcggtcgacgagtaccttaccggctccaccgaactgccggcaccgatcgtcgcttccaagcgtccaatgatgctgccgcgatagacaacactgttgtaagggtatgaacgaggtggcccggctcgcgaatagtgagccgggccacctgtttttcacccgaaatgcggtaaagtaatcccagcaccatgcaacaaaggagtgactaatgccaaatcgcgcagaacgacgtgcccaagccaagcgcaatcgcaggggagtgccacagcaatacgaccaaacccaaggccgcgcacgttccggcatgttggacgagtatcagctgcaggaaaagtcacgtcgtctgcaggacggcaccgatgggccatggaagccgagtgccagtacggtcacggaaacggaaaacgcgctgaacaccaatcctgattacaagaatccgaagatgttcaaggcaccccattccgtccgtcaatggttccgtgtggccagctgggtgctgattgcgctgtcggccatcgccttcctcgtggtcatgtggctgccgtcgcatccgatgtggctcatctccacagtcgccatcgtcttcgcagtcggtgtgctgagcctgttcttcacggccggcaacccgaagcacaatccgaatctcgaccaaaacggaacagccgtctgatcacaaaaacgatggaaagcggtgagacaaccagaagcatttgtctcaccgctttttctatcggattttaggtatgcgctacttgacttcgactaaccgtaaagggtatgcgagaatgctgtttcatcgtttttcagaaaaagaatggaactttctgaaaaacgatgaaaacaatgagtgtttttcgtgtctgatgttttacagtagaacaggaaacgctggaagactcgaggaggagattacagacatgaaggttgacattctatcgcgtgaatacccgcccaaggtgtatggcggcgcgggggtgcatgccgaagagctttccaaggtgctggcggaacgtgtcgatgtgacggtccgcgcattcgacgggccgcgcacggccgccgacattcccgcgattcccggaacagacccgaaagggtcgctcactgtcgtcggctacgacgtgccgaaggagcttgaggatgcgaacggtgcgctgaaaacgtttggcgtcgatttgcaaatcgccaacgacgttgatgccgacatcatccatgcgcatacatggtacgcatgccttgctggctatctcgccaaaatgctgcatgacaccccattggtcatcaccgcgcactcgcttgaaccgttccgtccatggaaacgtgaacagttgggcggcggctacaatctgagctcctgggctgagaaagacgcctacgagcatgccgaccgcgtgatcgccgtatccgcgggcatgcgtgaggacatcctcaccgcctatccgaaccttgacccggacaaggtggtcgtagtgcacaacggcatcaccatgagccagtttgaaaccccggcggatgacgatccgggctggaaggtgttcgaacgttacaacatcgaccgcagcaaaccgaccttgctgttcgtcggacgcatcactcgtcaaaagggtctgccgtacctgcttcaggcactgcacttcgtggacccgaacatccaggtcgttctgtgcgccggcgctcccgacacgccggaaatcatggaagaggtcaagaccgccttcgccaagctcgacgaggaacgcggcaacatcatctggattgaggagatgctgccgaagccggagctcaacgcactcgaacatggctgcgacgcattcatctgcccatccatctacgagccgctcggcatcgtgaatctggaagccatggcatgcggtctgccggtggtcgcctctgcgaccggtggcattccggaagtcgtcgtcgacggcgagaccggatatctggtgccggtcgaccaactgcatgacggcactggcacccccaccaaccctgacaaattcgtgcacgatatggccgacgccatcaaccgcatcatggctgaccctgaaaaggcgaagcggatgggacaggccggttacgagcgcgcccgcgaccacttcagctgggagtccatcgcagacaagaccgtcaaagtctacgaggacgtgcttgccgaacggaagtagaaccgaacctgtctgatcgcggataaccgatccggctgatcgacagccagaataatcctgaaatgcctcctgccgacgcactatgctggcaggaggcatcatcgtatccaagtggtttgtgaaaatggaggggaccatgaacgaacagaacatcgcgttgaaactggacgatgtggaattccgtcgccgcaggcgcgtaattctcaccaaagtcaatctggaagtcaaaaaaggcgagaaatgggtgctgttcggtcccaacggcatcggcaaatccacgttggtgcagatgatgagcacccgtggattcccatccgaaggcacagtcgacattctgggaaaacgtctgggcaaagtgaacgtgttctcctaccgcaaccgcatcggtttgagctcggccgaactcggacgcgcgttcccgccgcaggaagatcctcttgacgccatcgtgacggcgctgaccgcaaccaccggccgttggcgcgacacctatactgacgaggattacgccaaagcccgctcattgatgcgtgaattcggcatcgaatacctggaaggcaagatgatgttcaagctttccgaaggcgaacgcactcgcgtgcttatctgccgtgcgttgatggcggatcccgatttgctgattcttgacgagccgaccacgggtcttgatttgggtgggcgtgagattgctttgcgtgcgttgagtcgtgttggtgcggagcagtctgaccgcgccgtgattctggtgacgcaccgtcttgaggagattccgcaaggcttcgaccacgtggcgatcatgggacgtatcaccggcaacgaggcggatgcgtatgccgataacgtcgccggcaacgatccggcgccgggcactatcgtatatacgggtgatttggagcatggttttacttctgaacggttgagccaggtgtttggattggatttgaaggtcacgcatgcgaatggtcgttggaacgcgtacgcggtgtgatgtcgacgtcgccgtcacattgccgtcgcttcgtgccgtctgccggtatgacggcggatacggtagcataggttcgttgctgtccgtggaatgcggtctgcaatcgtaagccatagtcgtgaaatcgcatactgaacgaacgtacgaaggagcgtaaaccatgcgtcgagggccgcttgccgccggtgaaaaagtgcagttcacggaccgcaggtcgaataaaatcaccgatcagctggtgccgggtggtgtgacgcagacctcgcatggcatcatcctgcatgatgatgtgattggccagacggaaggatccgttgtcgtgacggtgagtgcgaaacgtgaggctcaggtcaaccagacgcatccggaacgcgacgcgaacaagccgtggaagggaacgcgtgccatcggtggttgggagttcgccgtcatgcgtccgcgcttggctgactatgtgctgtccatgccgcgtggcgcgcagatcatgtatccgaaggacatcgcgcaggtcatccagctcggtgatattcgttccggtatgaacgtgctggaatccggagccggttcgggcgcgatgagcatcaatctgctggatgccgtgggggagggcggaagcctcaccaccatcgagatgcgttcggaattcgcgcgcgtcgccgaagccaacgcgacggtttactttggcaaacgtcccgcatggtgggatttgaggaccggcgatttcgattcggtcgcggctggtttgccggaacactccttcgaccgcatcatgcttgacatgcttgacccgtggaaccgtcttgaacaggcgtatcgcgtgatcgcgcctggcggcgtgctcgtcgcgtacgtcaccaccaccacgcagttgagccgtcttgccgaagcgttgcgcgaggtcggctgctggaccgagccggacatgcaggagactttggaacgtaattggaaggcgcaaggactggccatccgtcccgatcaccagatgattggacacaccggtttcctcatggtttctcgcgcgatggctccgggcttccaggcgttgcgtaaacgcgaccgtgccacgaaggacacgacgaccgacatcgattcgttgacgcccgaggagcgtgccgaacagcttgaggatctggaattgcgtgacatttccgatcgcaagctgcgcaaggtgctgcgtgacctcgacgcgcaggtcgaagccataaaggagtagatttagagcgtttcatgccatgtcccagcggaaaatctgagacaatggacattagacatttgaaatgcggcgctggaaccggatcggagcgtgcgattatgggaacgagcctgaagaaggtcgctaaaaaggccaaggaatacaagtatgtgctgctggcgatgcgccacgccaaaaccgagccgttcggcggcaacggcagcgacgtgggacgtgagctcaccgacaaaggacgtaagcaggccaaagccgtggccaaaggattggcggcgttcaaaatggtgcccactcgcatcgcatgctccagcgccacccgcgcccgtcagacctgcgatcgcatgctcaaggtgttcggcgacgatccgaaagtcgactaccggcaaagcctgtacgaaggcggcgtgcaatccgtgttcgacgagctcgcgcaaaccaaggaaaagcatcgcacgctgctcgtgcttggccacgaaccgaccatttcgatcgcctgccaatggctggccagcaccgaatccgatccgacgttgcttgacctgctgaatctcggcatgtccccggcctcgatcgccgtattcggctcgaacgagccattcaaccagtggcagctgcacagcggcgaactcatcgcgctgcttaccgccaaagacttcgagtagggcttgcgtgttccgggctgattcggaacgatgagcattccgcagagtgctgtgatttgacttcaagcggcttcaaggttgtatggtgctttctgaaccgatgttcagaatgatggataggagagcccatatgaacaatcccagtgcgttccctcttggggaaccaaatgacggtttcgcccagtatttcgacggacagagctggcttgcgccggtacttgacgcgcctgaagtgtcaatccacaatgtgacgttcgaacctggatgccggaaccactggcatatccaccatcacgcggcccagattctcattgcggttggagggcgtggctactaccagcttgagggcgaagagccgaaggagcttgaaccgggacaggccgtccgtattccgccggacgttaagcattggcacggtgccgcccctcgcgaagctttcagccatttggcgttcatgattgcggatggcacgggcgacgtgacgaatgaatggctggaacccgtagaccccgacgcatacgagacattgcgttaaatccgcttgccgggctgttctgcattattgatccataaacataaatgtgtgaatatagacggcatacggactgcgttataaggacagtttataacgacattcaaattttcttgatgtcttatagctggcggttttgtgatagcttgagcgggttgcattgttcatatcagatggaggattcatgtccgctcttacttccgtctccggtttcccgcgcatcggccagaaccgtgagctgaagaaaatcatcgaagcgtattggaagggcaacaccaccctcgatgaggtgcgtgccacagccaaggaactgcgcgccaagcattggaagctgcagcaggccgccggcatcgacctgattccgagcaacgacttcagctattacgaccagatgctcgacactgccatcctgctcaacgtcattccgcagcgctaccagcgtctcgccttcgagaacccggaagagaccctcttcgcaatgggtcgcggctatcagggcgagaagggcgacgtgaccgccctgccgatgaagaagtggttcaccaccaactaccactacctcgtgccggaaatcgactccgccaccgacatcaagctcaacagcaccaagccgttcgacgaattcaacgaggcgaaggcgctcggcatcaccaccaagccggtgctcatcggcccgtacaccttcctcaagctcgcccgcaatccgcaggccgaggagctcgactacgacaagggcctcgtcaacgcggtcgccgcggtgtacgccgaagtcgtcgccaagttcgccgaactgggcgtgcagtggatccagatcgacgaaccgtacctcgtgctcgacaaggagccgggcgacgtcgaactgttcaagagcctgtacgccaagatcctgcccgcccgcgaaggcaaggtcaaggtgctgctcaacacctacttcggacacatcgccgacgtgtacgaaaccgtcaacctgctcggcttcgacggcatcggcctggacctgaacgaaggcaaggacgaaaacctcgccgccgtcgaaaagtacggcgtggcagaaaaaaccaccatcttcgccggcgtgatcaacggccgcaacatctggcgcaacaactacgccgtgagcctcggcctggtcgacgcgctgaagcaggtcaccgccaacgtggccgtctccaccgccagctccctgctgcacgtgccgttcagcaccgaaggcgaggacggtctcgccgacgacgtgcgcaagcacttcgccttcgccgtccagaagctcgacgaactgcacgaagtcgccgtgctcgccgacgcttccgacgacgagaagaaggcatccgccgaactcgcagccaaccaggcgctgttcgacggcacccgcgtcgccgccgatcctgcggtcgccaagcgaatcgcaagccttaccgacgccgacttcgtacgtcagccggcacgcgccgaacgccagaaggagcagcgtgaggcgctgaacctgccgctgctgcccaccaccaccatcggctccttcccgcaaaccaaggaagtgcgcgccgaacgcgccaagctgcgcaagggcgagatcaccaaggccgaatacgacgaattcatgaagaaccagatcgacgcctgcatcaagcatcaggaggaaatcggcctcgacgtgctcgtccacggcgaattcgaacgcaacgacatggtcgaatacttcggccagaacctcaacggcttcctgttcaccaagaacgcgtgggtgcagtcctacggcacacgttgcgtcaagcctccgatcgtgtggggcgacgtatcccgcgccaacccgatcaccgtggaatggagcgcctacgcgcagtcccgcaccgatcatgtgatgaagggcatgctcaccggtccggtcaccatcctcaattggtcctggccgcgcgaggacatcacccacgagcagcagacccagcagctcgcgctcgccatccgcgacgaagtgctcgatttggagaaggccggcatcaaggtcatccagatcgacgaggccgcactgcgcgagaagctgccgctgaggaagaccgactggcacaagaagtacctcgactgggccattccggcgttccgtctggtgcattccgccgtcaagccgaccacgcagatccacacgcacatgtgctattcggagttcaacgacatcatcaaggacatcgacgcgatggacgccgacgtgatctccttcgaagcctcccgtggcgaccttgtggtgctcgacgccatccacgacgccaacttcgaaaccgaagccggcccgggcgtgtacgacatccactctccgcgcattccgtccgaacaggagatcgaggaccgcatctacgagatcctgaagaagatggacgtcgaaaaggtgtggatcaacccggactgcggcctgaagacccgtggcaacgccgaaacctggccgagcctggagaacctcgtcgcagcggccaaggccgtgcgcgccaaactcgccaagtaaggccggcataggcataaacaggcaagatttccaaggaatcacatgcattcgccaatcttctcgctggaggtgttccctcccaagcgcaccagccctgtgggtaccatctacgatacgttggatggcctgcaggggctggaccccgacttcatctccgtcacctacggcaccggcaaatcgtccgaccgcacgttgaccgcacgcatcgcgcatacggtgaacgaatacggcattccggccgtggcgcacctgaccgcgcaataccttgacaaagacgacgtggatgaggcgctcgacctgttcgaccaggccaaagtctccggcgtgctcgctttgcgaggcgaccgtgtggaaggagccgaaccggcgggagtgttcgaccatgcgagcgatctggcggcctacatccgcgagaagcgtccggatctcaagatctacggcgcctgctatccggaaaagcacccgcaggcggccacgcttgaggaggatatcgacaatctcaagaagaaggtcgacgcgggcgtaagccacctcatctcccagctgttctacgacaacgaggatttccttcgattcgtggacaaggctcgtgccgccggcatcgacgttccgatcgaagccggcatcatgccggtgatgaacgcgaagtcggtgctgcgcatgtcgaagatgtgcgaatcgcgtgttcctgaaaaacttgccgtcctgcttgacaagtgggggagcgacaccgcgctgcttaaagaggcgggtatcgcttacgcgtccgaacagatctgcgacttggcggcacgcggcgtcgacggcgtgcacctgtacacgatgaaccatccatgcgtcagccggcgcatctggtccaacgtcaaaccattcttcgtctgattcagacgatgcaacaaacacgaaagggatgatttccggcaactgtcggaaaccgtccctttcgccatacttacggatatgaacgattactatgggaaccatggcttcttctacgcatcagtttgaggtgctcgatctgattcgggcgggattgcaggatctggacacggcacgcacgttgcttgacgagttgcgcgccgacggcatcgacgacgaccggctatgcctgctgatgaaaacattggaacagacctgcgagcccgacatcgcgctacgcaacctcgtcgacatcatcaaagcgttgcaaagccaaggccgcgacttccaccaggtcatcaccgacgacgccggactcgtacgactcgtcaccgtgctcggcgtgtccgacggaatgggcaagctcatgcgcttccgccccgaactcgtcatggccgcagccagcgactcatgcgaaagccatctgtacaaccacgcgcaacgccgcgcgcatgtcctcgaagcggtcggtgccgacccggccgacaatcgcatgccaaaagccacgaaaccactcgccgaagcggcgaccgcgctacggcagacctacagaaaacagctcgccgccatcatggcgcaggacgccaccgcggacgacccaatcgaaatacaaccgagaatcagccaggaactgtccgatcttgccgacgcggccctggaaggcgcgctcgccatcgcccgcaacgaagtggacagcagcgaacacgtgcgcttcgccatcatcggcatgggcaagctcggcgcacgcgaactcaactacgtatccgacgtggacctcatctacgtggtggaaccggcggacgcggacaccaacggcatgaccctcaaccgtgtcggcaccaaaatggccaccaccctgcagcgcgtatgccaatccgtcatcatgggcgtcgccgaacctacattgtggcagatcgatggcggactgcgccccgaaggcaaggacggcccgctcgtacgcaaactcgaatcgcacgaagcctactacgaacagtgggcggaaaactgggaattccaagccctgctcaaggcccgccccgtggccggtgaccccgacctcggccaagcgtacatggacatgacccgaccgttcgtatggaccgcctccaaacgcgacaacttcgtctacgactgccagcagatgcgcaaacgagtcgaagacctcatccccgcgcccctgaaggaccgtgaaatcaaactcggccgcggaggcctacgagacgtggaattcaccgtgcagatgctccaactcgtccacggccgcgccgacgagaccctgcgcaccagctccaccctcgaatcgctgcaacgcctcgccgaaggcgggtacgtctcacgcagacaagccaagaagctctcctgggactaccgcttcgaacgcgtcatggaacaccgccagcaaatgtgggcgctcaaacgcacccacctgttcccggacctcggcaaagccagtctcggcggcatcgaacgcaaacgcgacgccaacgacgacgaactcaaccacaacctcgaactgcgcagactcgcccgggccttccacatgcaccctgaggaactcgtcgacaaatacgacgaaacccgacgtgaagtgcgccacctgcacatggacatctactaccggcccatgctgcccatcaacgccggcctcgacgacgaacaagtggaactgtccgccaacgccatgcaggaacgcttcgcctccatcggattcgccgaccccgacgccgccatgcgccacgtcaccgcactgaccgccggcatctcccgtgccgcgaaaatcaaccgcatcctcctgcccgccgtcctccaatggctcggcgaagggcagaaccccgacatggggctgctcaactggcgcaaactcgaagaacactttggcacggacagcgaatacctcggcttcctgcgcgactcgccgtccgccgcgcaacgcctgtgccacgtcctgtccaattcacggttcctgggcgacgcgctcaacaaatccgtcgaatccgtcacctggctcggcagcgacaacgacctgcagccacgttcgcgcgaaagcctcgacgtgcagacacacgcctccctcgaacgcaacgtaggcagcatcaacgacttcgccaactccatccgcgccatgcgacgccacgaaatcgaacgcatcggactagggtggatgagcggcgtcatcgacgacaaggcgtcgctcgcaggtatgaccgacgtatacgacacggccatcgacgcatcgctcacctgggccatccgccaccaaacgcaggaaatgggattcgacgaagcgccggcggcaatcgccgtcatcggcatgggacgctacggcggcagggaagtgaacttcagctccgacgccgacgtcatcatcatctaccggccgtccgataacgccgacgacaaccaagccaacctcttcgcacgcaaagtgcaggaagacctccgcgccatcctgcaaggaccgaccacgctcgaacccaaaatcgaactcgacatggacctgcggcccgaaggcaaaaacggacccctcgtgcgctcctacgcgtcctgcgaggaatactaccgttcctgggcgagcacatgggagcaccaggcgctcctgcgtgcgcgttacgcggcaggcgacgcggcgctcgccgaggatttcctgatgaacgtcgccgacccgctgcgctatccgaagatcgatttgacggaggcgcaggtcgccgaaatacgcaagctcaaggcgcgtatggaagccgagcgattgccgcgcggcgtgcgtagggaccgtcacctgaagctgggcaaaggtggtctgtccgacgtggaatggacgattcagctgctgcagttgcagcatgccggcgacaacgcgaacctgcgagtcaacggcacgatgcaggcgttggacgagttggagcggcgcaagctggtttccgccggcgacgccgtcgtattgcgacgcgcatggtggatgtgcacggccgcgcgcaacggcagctacctgtggagcgggcgcgtcaaccaggcggatatcctgccggatgacacgtattcgctgggaggactcgccgtctatctcggatacgacgcgaatcgcggacagcatttcgaaaacgatctgct

SEQ ID NO: 2 - DNA, 23384 bp, Bifidobacterium adolescentis WBS-01
cggatgaaatccacaaaaaggccttaagaggtatgaatattaccccctagggccttagcgattcaagaagactgccatctataagcgaaatagcatcggtcgggtgaagaaatccgccatccataagcgagatggcggatttctgcggctcactgcacggcggcgagggcttggtcgaggtcggcgatgatgtcggccgtgttttcgatgccgcagctcaggcgcaccaggtcgatgccgacgccggcttcctcaagctgctcctcggtgagctggcgatgcgtggtgccggccggatacagcgtgcagctgcgcgcatcggccacatgcgtggcgatggacaccatcttcagatggtcgaggaacgcggagaccttctcgcggccgcccggcacgccgaaggagatcacaccgcaggtgccgttcggcatgtacttctccgccagcgcatggtacttgtccgtttcgaggcccgggaagctcacccagctgacgcgcggatcggcgtcgagccacttggccacggccagtgcgttcgcgcagtggcgctccatgcgcacgccgagggattccagatgcatgcccatgatccacgaattgattggcgccggagtggagccgaagtcgcgcatgagctgcgcggtggccttggtgatgtatgcggccttgccgaattccttcgcgtaggtgacgccatggtaggagtcgtccggagtggtgaggcccgggaatttctccgcatgggccatccagtcgaaattgccggaatcgacgatcgcgccgcccacgcaggatccgtggccgtccatgtacttggtggtggcgtgcgtgacgatgtccacgccgtactggaacggacggcagttgatcggcgtcgggaaggtgttgtcgacgatcagtggcacgccgtgacgatgcgctgcgttcgcgaacttctcgaagtcgagcacgataagcgccggattggagatggactcgccgaacacggccttggtgttcggctggaacgcggcctcaagttcctcttcggtgcagtccgggctgacgaaggtacattcgacgcccatcttgcgcatggtcacgttgatgaggttgaacgtgccgccgtagatggcggaggaggcgacgatgtggtcgccgttgttgcagatgttgaacagcgcgaagaagttcgccgcctggccggacgaggtgagcatcgcggccgcgccgccttccagctcgcagatcttcgcggcgacggtgtcgttggtcggattctgcaggcgggtgtagaagtagccggattcggacaggtcgaacagtcggctcatctgttcgctcgactggtatttgaaggtcgtggcctggatgattgggggagtgcgggattctccattgcccggctgatagcctccctgcacgcagatggtgtcgacgttttcgctcatatgttccttctttcgattccgcgcttccgtgtgccgcgcaggtgttgcgccgcgatgcgaacaaacaaacacactgtatcactgcattgataaatggcttgattccaatggaaacgccgtatagtttaacgaattgacaaacttaggtaattcaatttattatgtagaccaagacgggcggaaagcccgctgcgaaataaagctttacgtaagtaaaccaagcaaaggagcattccatgggtctgtgggatatcgataagattccgtacgtcggtcgcgaaaaggggccgcaggagggtcttgctttccattactacgatgccgacaaggtcgttgccggcaagaagatgaaggactggctgcgtttcggcgtcgcatggtggcacaccttcgaccagcagctcgtcgatccgttcggcaccggcaccgcccagcgtccgtggtacggcaagtattccgatccggaggacgaggccctggccaaggtcgactacgccttcgagttcttccagaagctcggcgtcgagtacttctgcttccatgatcgcgacatcgctccggaaggcgacaccctgcgcgagaccgacaagaacctggacaaggtcgtcgacaagatcgaagagaacatgaagtccaccggcatcaagctgctgtggaacacctcctccctgttcaccaacccgcgcttcgtctccggcgcctccacctccccgttcgccgacatctacgcgtacgccggcggccagctgaagcactccctggagatcgccaagcgccttggtgccgagaactacgtgttctggggcggccgtgaaggctacgagaacctgtggaacacccagatgaagcgcgagcaggagcacatggccaagttcttccacatgtgccatgactacgcgaaggaaatcggcctggacgcccagttcctgatcgagccgaaggccaaggaaccgacgatgttccagtacgacttcgatgccgccaccgccatcaacttcctgcgcacctatgatctgatggacgtcttcaagctgaacctggaaggcaaccacgccaacctggccggccacacctaccagcacgagatccgcaccgcccgcgaggccggcgtgctcggctccttggacgccaaccagggcgacaagctcatcggctgggatatggatgagttcccgaccgacctgtacgagacctccaccgttatgtgggaagtcctcgccgaaggccagatcggccctcacggtggtctgaacttcgacgccaagccgcgtcgtacctccttcaccgccgaggatctgttccgttcccacatcgcaggcatggattccttcgcagcaggcctcctggtcgccgccaagatgcacgaggacaaggtcatcgagaacctgcaggccgagcgctacagctccttcgattccggcatcggcgcaaccgtcgagaacggcaccgcctccctggcttccctcgaggagtacgctctggatatcccgcagtccaagctcatcgaagccaccaagtccgatcacctcgagtccgtcaaggccacgatcaacaactacatgatcgacgccctggccgaggcgtgagccgaaaactcactagggttttaggtagcctcgggcgaagtccgagacggtagtcgagggcgagcaatgactgggcgcgcgtagcgttccggaattgcaggaccgaggcatgggcgcagtaaggagtttccgttaggactcctgattcatcgctggatcaaacagtggggctcgactgtgacagagccggatgtggtgtgccgaagcgtcggtgttccggcacaccactcacttttctttccttcctccttcctcaaatttccttcgcacgcaagtcgtttgccggctagatcgccggtgagcggcttgcgtgcgttgttagaccaagcgaaaatttcgattattcgcaatgatgtgatgtatccaaacgttcccgaatgaggcgtacttatgaccacaacgattaccatcgccaatcccattcttcacggaatgcatcctgatccgagttggatttgggatgatgatcttcggcaaatcgtgcttgtgacctccaccttcgaactggttccaggcttgcctatttacgtttccagggatatggcccactggaaacacgtgtcggatgccatagatgaggagttggcaagacgtttgctcattcctttcgtggatgactcgggtggcgtctatgcgccgacgctgcgtaggattcgtggcaaatacgtgattgcctgcaccatcgctcgcatcaatggacgcaaagccatcgcggaaggatgctcccaggccgaattggatgcggcccaggcggcggaaggcaacttcgttcttgagtcggactcgatcgacggaccttggcgtgggccgttctggatcgagggcgccgaaggcatcgatccagacatattcgaggacggggacggcaatgtgtactggacccagacccgtcctgcggtcaatccgcaatgggaaggccagaccgaggtctggacccaacgcattaatccggagacttggacttttgtcgatgacggtcttcctgcgggatcgggcaagacggtaatatggcgcggatacggtatggaatcggtgtgggctgaggcgccgcatctctatcgcgtgggtgattatgtgtatctgatgaccgctgaggggggcaccagtttcgaacatagcgaaatggccatgcgcatctatgcaccgcatggactgcttcgggcgttcgaagcttacgaacgggaagcatccgaatcgggtgagtgcattccgcaggttcgtgacggggaacgctgctatcttggcaccgcaatccgtgccttccacgcggataagaagaatccgattctcacccaccgacatctgggtttgtcggaaccgctgcaatgcgtgggacatgcggacctgttgcttcatccggaactgggatggtggctggtgtgtctcggcgtgagggagacgcggggaaagcatgacggcgaattattgagctacttgggaagggagagctttgtcgctccggtatcctgggaacataatccggccgattggaagctggacggcaacggtgcattagatacgcatgagggtgaccccggatggccagtgacgtgcgctggtcttggccgcttggccgacgagatcacggttactactgaagacgatggcatcaccatcgagcctagggtgaaatcctcgctcgccggtgacgtggaacctgcgctggtggatgtggctgatggctcgacgaacgatgtggtggtgcgcgacgagcgtgatgtcagctaccgcagaatagcgaaactgccgacgctcatgccgattcccatgtccggttctttagtgattcggcagaattccacgcattacgcggtgttttcgatgcatggcacggatgtgcgctacgagatggtgaatggagacgattcgcaagctgggtctgttgccgtacaggctgacggagtgcgtccggcggtacttttcgacgacaaccgcttgtcggtcatcgtaactggcatgcatggtccggttgattctgcgacgttcgtgcgtcaggggcaggtcctgctgagtgtcgatgcccgtttcctcagcaccgaatgggctggtgggttcgtcggttgcatggccggcttcatggcatagattctacggaatttcaggatggttcactgctggtgttccgacgggccgtcttagaacgaggtgaaaacgggtcgaaaggctaggagcgctgtgttctcccttacggttgtgcctgtgaggtttgccccgctgattaaccctcgagttgctgtgtgctgttgcgtaccactagcgatgtcggcatgatgatgtgcggttggatcacgtcgtcggtggacagcgcctcgaccagcatgcgtacggcggcccttgccatgtcttggagcggctgccgtacggtggtcagcgccgggccaaggaatgcggcagtctgcacatcgtcgaatccgaccacggataaatcctccggaatacgtaatcccagctgtcttgccgcctcgtagacgcccatggcctgcagatcgctgccggcgaagattgcggtcggacgatttggtcgtttcaacagggagatggactgtgcgtaaccgccggaagtggtgaaatcgccttcggtgataagttcgggatcggtttcgattccatgttccgcaagcgctgatgtatatccgtccagacgtgctttggaacacatcatttcctccggtccggtgatgatgcctatgcgggtatgtccgagtgcgagcagatgcctggtggcgattacgcctccggtccagttgtccgcttgcaccgacagcgtgtctggatctggattaccgaatggatcgaacaagacgaagggaatacctctggaatgcagtttgttccgttcgatacgtgtcagactggagaagacaagaatggcgccatctgtctgccgacgcagcatgttgtcaatccaggatgagtccgggtgctggcgattgccgccttcggtggtgatgacgttcaaatcatgcaacttggcttcgcgaatggcgccacggagtacttcaagggcccaaacattatcgaaatcttggaacacgatttcgataattcgttggcttttcgcgcctgtcgctttacgggaatacccataccgtttcaacaccgcgttgatggtttgccgcgtctcttcggaaacgtcggctctgccgttgagcgccttggatacggtggaaagggaataaccggtctctttagctatgtcagagagtcgtaccgtagctttctttgtcgtattgcgcatgagtcactccttcttcatgctcatcatatccgaaaacgcgaacgaaagtttcggtttgcgtttttcgaaactttcgatatgttggcaatacttaaaaacgttgtaaaatcaacgaaaaataattagttttctgattttacaaaaaacttgactttgtgtgatttgtttcggtagtctataggtacaacgaaaacgaaatggaaattttcgaagggagtcaaaggctgattctctgtctgccaggggagctgcagcagcattcgttgcggtcatgcttcccgattcgacccaattcgagagaaattcctgtcgttgccatcattttgtcgatgatgatttggtcaataaggagaagacaatgaagttcagaaccattgcagctgccactcttgcggtggcgaccatgttgggcatgggtgcctgcggctccagcactggtgctaaagacgataagaccattacgttctggcataacgcaacagctggtgacggcaagcagtattgggaggatatggccaaagcgttcgagaagaagactggtgtcaaggttcagattcaggccatccaaaacgaggatttcgaaggcaagctgaccaccgctatgcaggatcccgcctccggcccggatgtgtacatgacccttggtggagccaagaccaaggacatgattgacgccggacagaccatggacctcactgataagatcagtgacaccgtcaagaagcagatgtcttctgcgctggagtccatgtcctatgacggcaaggtctatggtgttccagtcactgtgcagcctggtggcatctggtattccaaggatctgttcaagcaggctggcatcgatgccgcgccgaccaccttcagcgagctgaagaccgatgtgcagaagcttcgcagcgctggcatcgatccgatcgcactcggcggcaaggatgcttggccggtcggtcactggtactactggttgtccatgcgcgaatgctctccgaaggcctacgccaagggcgtcaatgacaaggacttctccgactcctgctggaccaaggccggagatgatctgaaggatttgttggatgcgaatgcttttaacgaaggattcctcaccacgacggcccagcagggcgccagctcgtccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctttgatgggcgctgtgaccggtttcgctgtcaatcccgaggctccggacgctgctgttgatttcgtcaatttcatggctgagaaatcaaatcaggagaaatacgccactgcgttcagcaccattccggcttccgccgaagcttacgatgcggttaccgatgaaaatcttaaagccatcatcgaagctatgaaaaagtccgatggcatgcagctgtggatggataccgctctcggcggaaatattggcaacgctcttaattccggagtggtgaatctgctttccggacaggggacttcggctgacatcgtcaaggcgatgaaggacgcagcggccaagggctgacagtgaacatggctggttgaaggccaaaggagggtggatagacagattttcatctgccctccttcctattcgagaaacgtatctggtagtggagaaaaccatgtcaagtacaagcaaagacgcggtgacgctgcgcgctaagcggtccaagaaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggttacggacttccctccaagacaggtaaattcgttggtctccagaactacatcacagcgcttaaggatcccgcgttccaggcggcaattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctgcagaagaagggcgccatcaatgagattctggccaacttcggcatcaatggtcccgattggctggccgacccgaagatcgctatttggacgctgctgttgctgatcagctggaaatacgtcggtttcgccgtaattctgatgctcgccggcatgcaatccattcccgaggaactgtatgaagcagccaaggtggatggggcgagtttctggcagatgcagaaaagcatcacgttgccgttgcttgctccgacgttgcggatctgggtgttcctttccatgattggctctctgcagcttttcgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgaacagaaagaagccgagaagcgtgccaggaagcgcgcaaaagaagtgcagcatcgtgaggttgctgccctggcaagtgaggtgaagtgatgactgccgcaacaatcgcaggacattccaacaaaagcgagtacagcaagaagaatggttaccgtaagtcatccaagacgccatggggcaacccaatcgtctacttcttctccctggtgcttgtggccatctgcatcactccggtgttgtacattatcttcggcggtttccgtaccaattcgcagatcaccaaccatccgtccgggatgccgaacccatgggtccccgacaactacaagacggtcttcgaaagtgatattttctggacggaactgaagaattctaccatcgtgggtatcgccaccatggtaggtgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcatcatcttggtgccgttcctacagtcgattcctaatgagcttgaggaggcctgtcttctcgatggatgctcccgccttggcttcttctggcgcatggtcattcgctgtccatgcctggcgtggccaccactggaatcctcacttcgtggaagctggaatgcctacatgctgccgctgttcgtgctcagtgatgccaacaagtacacattgccacttggcgtacagatgttcagctccgaacactccgttgacaccgcacaggtgttggccttcacctctctggctatgattccggccctgatctgtttcaccatcttccagaagaagatcgtcggcggcctgacaggtgcggtcaagggctgacgaaatgtgacaatccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccactttcgaatggttcccaggcgttcgcctgcatgagtccaaggacctggtgcattggaacattcttccaagcccgttgagccggtccagccagcttgatatgagaggaaacccctcttcgggaggcatctgggctcctgacctaagctatgcggataacaaattctggttgatctacactgatgtcaaggtggtcaatggtgcattcaaggattgcactaattatttggtcaccgccgaggacatccacgggccatggagcgagccggttcgcatcaacggggtcggttttgacgccagcctgttccatgacgacgacggccgcaaatacttggtgcagcagacatgggatttccgtgaataccaccaccagttcgacggcatcacgttgacggaattcgacgtcgacaccatgaagctcaagccagaaacggcccgcaccatctgggatggcacttcggtgaagatcaccgaaggtccccacctatacaagaaggatggttggtactacctgtttgccgcagaaggcggcacggtgtatgaacatcaggaatctgtggcgcgttcccgtacccttgacgaatactccttcgaagttatgccgaatggcccgttcatcggtaacttcgacactcctgacacctatttgcagaagcagggccatggagcgttggtggacaccccgtccggcgagtggtattacgcctccctatgcggtcgtccgtggcgtcatgataccgaaccggcccatggcacccgcggatggtgcacactcggacgcgagacctccatccagaaagtcgaatgggatgaggacggttggccgcgcgtggtcggaggtcacggcggacagcgttacgttgatgctccgaaagatgccatcgagactttggccccaacaacgcgtgacgaacatgatgagttcgattccggcgagctcggtccgaattggaacactctacgcgtcccgttcaccgacgccatgggcacggtgggcggtggcaaactggcattgcgtggtcagggctcgctgtgcaacctgtttgacttgtctcttgtggctcgtcgctggcaggcatttgatttcgacgccgaaaccaaggtgcgtttcgatccgaagaattacatgcagatggcaggcctgaccaactattacgatgacctgtgctggtcatgggcgtttgtcacttgggatggaagaacgacatgcaagggtcatcgaagtggctcagaacgatttcaaccaatatacgtcgttcctcaaggatgacgccatcgtagtgcccgaagacgccgaagcggtatggctgcgcaccaaggtccgcacggaatactattcctacgaatattccttcgacggagaacatttcaccgagattccggtcaagctcgatgcgaagatcctgtccgacgattacgtgaaccaacgttacggcggcttcttcacaggcgcgttcgtgggacttgcctgcgtcgatctgtccggctacggcgcgcaggccgaattcgactacttcgactatcgggagctttccgataaccagtagacagtgccggctggcgacagagcgtccgtcgtcaaggcagttcggcaatcgcaagaccatgctcgtccgctcctcattgcccatagatttcaatgccgtcgagtatgccggctgacgacggacgctctgtcgccagccggcactgtctactggttatcggaaagctcccgatagtcgaagtagtcgaattcggcctgcgcgccgtagccggacagatcgacgcaggcaagtcccacgaacgcgcctgtgaagaagccgccgtaacgttggttcacgtaatcgtcggacaggatcttcgcatcgagcttgaccggaatctcggtgaaatgttctccgtcgaaggaatattcgtaggaatagtattccgtgcggaccttggtgcgcagccataccgcttcggcgtcttcgggcactacgatggcgtcatccttgaggaacgacgtatattggttgaaatcgttctgagccacttcgatgacccttgcatgtcgtttctcatcccaagtgacaaacgcccatgaccagcacaggtcatcgtaatagttggtcaggcctgccatctgcatgtaattcttcggatcgaaacgcaccttggtttcggcgtcgaaatcaaatgcctgccagcgacgagccacaagagacaagtcaaacaggttgcacagcgagccctgaccacgcaatgccagtttgccaccgcccaccgtgcccatggcgtcggtgaacgggacgcgtagagtgttccaattcggaccgagctcgccggaatcgaactcatcatgttcgtcacgcgttgttggggccaaagtctcgatggcatctttcggagcatcaacgtaacgctgtccgccgtgacctccgaccacgcgcggccaaccgtcctcatcccattcgactttctggatggaggtctcgcgtccgagtgtgcaccatccgcgggtgccatgggccggttcggtatcatgacgccacggacgaccgcatagggaggcgtaataccactcgccggacggggtgtccaccaacgctccatggccctgcttctgcaaataggtgtcaggagtgtcgaagttaccgatgaacgggccattcggcataacttcgaaggagtattcgtcaagggtacgggaacgcgccacagattcctgatgttcatacaccgtgccgccttctgcggcaaacaggtagtaccaaccatccttcttgtataggtggggaccttcggtgatcttcaccgaagtgccatcccagatggtgcgggccgtttctggcttgagcttcatggtgtcgacgtcgaattccgtcaacgtgatgccgtcgaactggtggtggtattcacggaaatcccatgtctgctgcaccaagtatttgcggccgtcgtcgtcatggaacaggctggcgtcaaaaccgaccccgttgatgcgaaccggctcgctccatggcccgtggatgtcctcggcggtgaccaaataattagtgcaatccttgaatgcaccattgaccaccttgacatcagtgtagatcaaccagaatttgttatccgcatagcttaggtcaggagcccagatgcctcccgaagaggggtttcctctcatatcaagctggctggaccggctcaacgggcttggaagaatgttccaatgcaccaggtccttggactcatgcaggcgaacgcctgggaaccattcgaaagtggaattggcaatgtaataagtgtcaccgacgcgaatcattgaaggatcggcatgaaaaccggtgagcaccgggttggaaatcttcataatgtacctcttgcataagagatgaagcccggaagacggaaaggaacatcttccgggcgtggattgtcacatttcgtcagcccttgaccgcacctgtcaggccgccgacgatcttcttctggaagatggtgaaacagatcagggccggaatcatagccagagaggtgaaggccaacacctgtgcggtgtcaacggagtgttcggagctgaacatctgtacgccaagtggcaatgtgtacttgttggcatcactgagcacgaacagcggcagcatgtaggcattccagcttcccacgaaggtgaggattccagtggtggccacgccaggcatggacagcggaatgaccatgcgccagaagaagccaaggcgggagcatccatcgagaagacaggcctcctcaagctcattaggaatcgactgtaggaacggcaccaagatgatgatggtctgaggaagtccgaaggcaatttgcggaaggatcagaccccacagggagttggccagacccagattgcgaatcagcagatacaaaggtgtaatgccaacggtcatcgggaacatgagaccagcagagaacaacgcgtacataagcggcgcatagcggaatttgtatcgggcgatgacaaagctcaccatgatgctaagcaccacgacacctaccatggtggcgatacccacgatggtagaattcttcagttccgtccagaaaatatcactttcgaagaccgtcttgtagttgtcggggacccatgggttcggcatcccggacggatggttggtgatctgcgaattggtacggaaaccgccgaagataatgtacaacaccggagtgatgcagatggccacaagcaccagggagaagaagtagacgattgggttgccccatggcgtcttggatgacttacggtaaccattcttcttgctgtactcgcttttgttggaatgtcctgcgattgttgcggcagtcatcacttcacctcacttgccagggcagcaacctcacgatgctgcacttcttttgcgcgcttcctggcacgcttctcggcttctttctgttcagtaacagcaccgtccaagtcacggttcagcacgaacttctgatagacgagtgcgatgatcaaagagatcacgaagatgatcagagcaacggcggaaccatagccatagttgccggctccacgaccttcacgcaccatgtaggtggccatggtggacacaccagcggtggtcgacacatacttgccccacacgatatagaccagatcgaaaagctgcagagagccaatcatggaaaggaacacccagatccgcaacgtcggagcaagcaacggcaacgtgatgcttttctgcatctgccagaaactcgccccatccaccttggctgcttcatacagttcctcgggaatggattgcatgccggcgagcatcagaattacggcgaaaccgacgtatttccagctgatcagcaacagcagcgtccaaatagcgatcttcgggtcggccagccaatcgggaccattgatgccgaagttggccagaatctcattgatggcgcccttcttctgcagcaacaggctccatcctgtgccgacgatgacctcggaaacgacatacggcacgaagatgagggtgcggatgagaccacgccccttgaacttctggttcagcagcaatgcgaacaggatggcgagcggagcctggatgaccaacgagccgatcacgacctcgaaggtatgcagaattgccgcctggaacgcgggatccttaagcgctgtgatgtagttctggagaccaacgaatttacctgtcttggagggaagtccgtaacccttccactgatagaagccgtaataagcacccaagacgataggcagaatcacaaagcagacgaacagaagaatcgcaggtgcggacagtacgaaaatctcaacattacgacgcattttgccatcggacggtttcttggaccgcttagcgcgcagcgtcaccgcgtctttgcttgtacttgacatggttttctccactaccagatacgtttctcgaataggaaggagggcagatgaaaatctgtctatccaccctcctttggccttcaaccagccatgttcactgtcagcccttggccgctgcgtccttcatcgccttgacgatgtcagccgaagtcccctgccggaaagcagattcaccactccggaattaagagcgttgccaatatttccgccgagagcggtatccatccacagctgcatgccatcggactttttcatagcttcgatgatggctttaagattttcatcggtaaccgcatcgtaagcttcggcggaagccggaatggtgctgaacgcagtggcgtatttctcctgatttgatttctcagccatgaaattgacgaaatcaacagcagcgtccggagcctcgggattgacagcgaaaccggtcacagcgcccatcaaagcaccttcctcgccttttcctccgtccacggtcgggaaggcgaagaagccaaggtcagccattggcttcttgtccggagtcaggtccttgagaactccaggctcccatgtgcccatgagctccatcgcagccttatgattggccagcagacctgcggacgagctggcgccctgctgggccgtcgtggtgaggaatccttcgttaaaagcattcgcatccaacaaatccttcagatcatctccggccttggtccagcaggagtcggagaagtccttgtcattgacgcccttggcgtaggccttcggagagcattcgcgcatggacaaccagtagtaccagtgaccgaccggccaagcatccttgccgccgagtgcgatcggatcgatgccagcgctgcgaagcttctgcacatcggtcttcagctcgctgaaggtggtcggcgcggcatcgatgccagcctgcttgaacagatccttggaataccagatgccaccaggctgcacagtgactggaacaccatagaccttgccgtcataggacatggactccagcgcagaagacatctgcttcttgacggtgtcactgatcttatcagtgaggtccatggtctgtccggcgtcaatcatgtccttggtcttggctccaccaagggtcatgtacacatccgggccggaggcgggatcctgcatagcggtggtcagcttgccttcgaaatcctcgttttggatggcctgaatctgaaccttgacaccagtcttcttctcgaacgctttggccatatcctcccaatactgcttgccgtcaccagctgttgcgttatgccagaacgtaatggtcttatcgtctttagcaccagtgctggagccgcaggcacccatgcccaacatggtcgccaccgcaagagtggcagctgcaatggttctgaacttcattgtcttctccttattgaccaaatcatcatcgacaaaatgatggcaacgacaggaatttctctcgaatgggtcgaatcgggaagcatgaccgcaacgaatgctgctgcagctcccctggcagacagagaatcagcctttgactcccttcgaaaatttccatttcgttttcgttgtacctatagactaccgaaacaaatcacacaaagtcaagttttttgtaaaatcagaaaactaattatttttcgttgattttacaacgtttttaagtattgccaacatatcgaaagtttcgaaaaacgcaaaccgaaactttcgttcgcgttttcggatatgatgagcatgaagaaggagtgactcatgcgcaatacgacaaagaaagctacggtacgactctctgacatagctaaagagaccggttattccctttccaccgtatccaaggcgctcaacggcagagccgacgtttccgaagagacgcggcaaaccatcaacgcggtgttgaaacggtatgggtattcccgtaaagcgacaggcgcgaaaagccaacgaattatcgaaatcgtgttccaagatttcgataatgtttgggcccttgaagtactccgtggcgccattcgcgaagccaagttgcatgatttgaacgtcatcaccaccgaaggcggcaatcgccagcacccggactcatcctggattgacaacatgctgcgtcggcagacagatggcgccattcttgtcttctccagtctgacacgtatcgaacggaacaaactgcattccagaggtattcccttcgtcttgttcgatccattcggtaatccagatccagacacgctgtcggtgcaagcggacaactggaccggaggcgtaatcgccaccaggcatctgctcgcactcggacatacccgcataggcatcatcaccggaccggaggaaatgatgtgttccaaagcacgtctggacggatatacatcagcgcttgcggaacatggaatcgaaaccgatcccgaacttatcaccgaaggcgatttcaccacttccggcggttacgcacagtccatctccctgttgaaacgaccaaatcgtccgaccgcaatcttcgccggcagcgatctgcaggccatgggcgtctacgaggcggcaagacagctgggattacgtattccggaggatttatccgtggtcggattcgacgatgtgcagactgccgcattccttggcccggcgctgaccaccgtacggcagccgctccaagacatggcaagggccgccgtacgcatgctggtcgaggcgctgtccaccgacgacgtgatccaaccgcacatcatcatgccgacatcgctagtggtacgcaacagcacacagcaactcgagggttaatcagcggggcaaacctcacaggcacaaccgtaagggagaacacagcgctcctagcctttcgacccgttttcacctcgttctaagacggcccgtcggaacaccagcagtgaaccatcctgaaattccgtagaatctatgccatgaagccggccatgcaaccgacgaacccaccagcccattcggtgctgaggaaacgggcatcgacactcagcaggacctgcccctgacgcacgaacgtcgcagaatcaaccggaccatgcatgccagttacgatgaccgacaagcggttgtcgtcgaaaagtaccgccggacgcactccgtcagcctgtacggcaacagacccagcttgcgaatcgtctccattcaccatctcgtagcgcacatccgtgccatgcatcgaaaacaccgcgtaatgcgtggaattctgccgaatcactaaagaaccggacatgggaatcggcatgagcgtcggcagtttcgctattctgcggtagctgacatcacgctcgtcgcgcaccaccacatcgttcgtcgagccatcagccacatccaccagcgcaggttccacgtcaccggcgagcgaggatttcaccctaggctcgatggtgatgccatcgtcttcagtagtaaccgtgatctcgtcggccaagcggccaagaccagcgcacgtcactggccatccggggtcaccctcatgcgtatctaatgcaccgttgccgtccagcttccaatcggccggattatgttcccaggataccggagcgacaaagctctcccttcccaagtagctcaataattcgccgtcatgctttccccgcgtctccctcacgccgagacacaccagccaccatcccagttccggatgaagcaacaggtccgcatgtcccacgcattgcagcggttccgacaaacccagatgtcggtgggtgagaatcggattcttcttatccgcgtggattgtttgtgaggcacggattgcggtgccaagatagcagcgttccccgtcacgaacctgcggaatgcactcacccgattcggatgcttcccgttcgtaagcttcgaacgcccgaagcagtccatgcggtgcatagatgcgcatggccatttcgctatgttcgaaactggtgccccctcagcggtcatcagatacacataatcacccacgcgatagagatgcggcgcctcagcccacaccgattccataccgtatccgcgccatattaccgtcttgcccgatcccgcaggaagaccgtcatcgacaaaagtccaagtctccggattaatgcgttgggtccagacctcggtctggccttcccattgcggattgaccgcaggacgggtctgggtccagtacacattgccgtccccgtcctcgaatatgtctggatcgatgccttcggcgccctcgatccagaacggcccacgccaaggtccgtcgatcgagtccgactcaagaacgaagttgccttccgccgcctgggccgcatccaattcggcctgggagcatccttccgcgatggctttgcgtccattgatgcgagcgatggtgcaggcaatcacgtatttgccacgaatcctacgcagcgtcggcgcatagacgccacccgagtcatccacgaaaggaatgagcaaacgtcttgccaactcctcatctatggcatccgacacgtgtttccagtgggccatatccctggaaacgtaaataggcaagcctggaaccagttcgaaggtggaggtcacaagcacgatttgccgaagatcatcatcccaaatccaactcggatcaggatgcattccgtgaagaatgggattggcgatggtaatcgttgtggtcataagtacgcctcattcgggaacgtttggatacatcacatcattgcgaataatcgaaattttcgcttggtctaacaacgcacgcaagccgctcaccggcgatctagccggcaaacgacttgcgtgcgaaggaaatttgaggaaggaggaaggaaagaaaagtgagtggtgtgccggaacaccgacgcttcggcacaccacatccggctctgtcacagtcgagccccactgtttgatccagcgatgaatcaggagtcctaacggaaactccttactgcgcccatgcctcggtcctgcaattccggaacgctacgcgcgcccagtcattgctcgccctcgactaccgtctcggacttcgcccgaggctacctaaaaccctagtgagttttcggctcacgcctcggccagggcgtcgatcatgtagttgttgatcgtggccttgacggactcgaggtgatcggacttggtggcttcgatgagcttggactgcgggatatccagagcgtactcctcgagggaagccagggaggcggtgccgttctcgacggttgcgccgatgccggaatcgaaggagctgtagcgctcggcctgcaggttctcgatgaccttgtcctcgtgcatcttggcggcgaccaggaggcctgctgcgaaggaatccatgcctgcgatgtgggaacggaacagatcctcggcggtgaaggaggtacgacgcggcttggcgtcgaagttcagaccaccgtgagggccgatctggccttcggcgaggacttcccacataacggtggaggtctcgtacaggtcggtcgggaactcatccatatcccagccgatgagcttgtcgccctggttggcgtccaaggagccgagcacgccggcctcgcgggcggtgcggatctcgtgctggtaggtgtggccggccaggttggcgtggttgccttccaggttcagcttgaagacgtccatcagatcataggtgcgcaggaagttgatggcggtggcggcatcgaagtcgtactggaacatcgtcggttccttggccttcggctcgatcaggaactgggcgtccaggccgatttccttcgcgtagtcatggcacatgtggaagaacttggccatgtgctcctgctcgcgcttcatctgggtgttccacaggttctcgtagccttcacggccgccccagaacacgtagttctcggcaccaaggcgcttggcgatctccagggagtgcttcagctggccgccggcgtacgcgtagatgtcggcgaacggggaggtggaggcgccggagacgaagcgcgggttggtgaacagggaggaggtgttccacagcagcttgatgccggtggacttcatgttctcttcgatcttgtcgacgaccttgtccaggttcttgtcggtctcgcgcagggtgtcgccttccggagcgatgtcgcgatcatggaagcagaagtactcgacgccgagcttctggaagaactcgaaggcgtagtcgaccttggccagggcctcgtcctccggatcggaatacttgccgtaccacggacgctgggcggtgccggtgccgaacggatcgacgagctgctggtcgaaggtgtgccaccatgcgacgccgaaacgcagccagtccttcatcttcttgccggcaacgaccttgtcggcatcgtagtaatggaaagcaagaccctcctgcggccccttttcgcgaccgacgtacggaatcttatcgatatcccacagacccatggaatgctcctttgcttggtttacttacgtaaagctttatttcgcagcgggctttccgcccgtcttggtctacataataaattgaattacctaagtttgtcaattcgttaaactatacggcgtttccattggaatcaagccatttatcaatgcagtgatacagtgtgtttgtttgttcgcatcgcggcgcaacacctgcgcggcacacggaagcgcggaatcgaaagaaggaacatatgagcgaaaacgtcgacaccatctgcgtgcagggaggctatcagccgggcaatggagaatcccgcactccccaatcatccaggccacgaccttcaaataccagtcgagcgaacagatgagccgactgttcgacctgtccgaatccggctacttctacacccgcctgcagaatccgaccaacgacaccgtcgccgcgaagatctgcgagctggaaggcggcgcggccgcgatgctcacctcgtccggccaggcggcgaacttcttcgcgctgttcaacatctgcaacaacggcgaccacatcgtcgcctcctccgccatctacggcggcacgttcaacctcatcaacgtgaccatgcgcaagatgggcgtcgaatgtaccttcgtcagcccggactgcaccgaagaggaacttgaggccgcgttccagccgaacaccaaggccgtgttcggcgagtccatctccaatccggcgcttatcgtgctcgacttcgagaagttcgcgaacgcagcgcatcgtcacggcgtgccactgatcgtcgacaacaccttcccgacgccgatcaactgccgtccgttccagtacggcgtggacatcgtcacgcacgccaccaccaagtacatggacggccacggatcctgcgtgggcggcgcgatcgtcgattccggcaatttcgactggatggcccatgcggagaaattcccgggcctcaccactccggacgactcctaccatggcgtcacctacgcgaaggaattcggcaaggccgcatacatcaccaaggccaccgcgcagctcatgcgcgacttcggctccactccggcgccaatcaattcgtggatcatgggcatgcatctggaatccctcggcgtgcgcatggagcgccactgcgcgaacgcactggccgtggccaagtggctcgacgccgatccgcgcgtcagctgggtgagcttcccgggcctcgaaacggacaagtaccatgcgctggcggagaagtacatgccgaacggcacctgcggtgtgatctccttcggcgtgccgggcggccgcgagaaggtctccgcgttcctcgaccatctgaagatggtgtccatcgccacgcatgtggccgatgcgcgcagctgcacgctgtatccggccggcaccacgcatcgccagctcaccgaggagcagcttgaggaagccggcgtcggcatcgacctggtgcgcctgagctgcggcatcgaaaacacggccgacatcatcgccgacctcgaccaagccctcgccgccgtgcagtgagccgcagaaatccgccatctcgcttatggatggcggatttcttcacccgaccgatgctatttcgcttatagatggcagtcttcttgaatcgctaaggccctagggggtaatattcatacc

SEQ ID NO: 3 - DNA, 75754 bp, Bifidobacterium adolescentis WBS-01
cgtcagatagatgttccgataaggcctcgcatctttttgcccactcgtcgatccggacggcaacggaagcctcatcagcatatcagcgttgtcgagacgtcctggatgcaagccgtcgacgctttgtggaagcaggagccaccgttgcacgactgcgacctgatagccgtgagccaagctctcttctttcagtcttgcgtattgttcgttgtcaatccgtgccatgattcggtacgggaagttcttgcgtcccacgttaatctcgcctttcgcttgtttgttcagtgacggtctggcatccggaaaggatgtctccgcctggaccggaagaaggttcttcctcttttggattcagcggtcgatacaaatcgaatatgacatcatgcttccttccggataccaactacgcatgattcccattgccacttctggcgcaaggtattcggtgtagcccataactccgtggaccggcctcactatccgcgtccatactgtctttagccacctcaaatccggatacgaaaaggccgcgcccagtaggtgcggccggaagacgacaggcgacgtcacagttcaacgaatccgagcaatggcgcgaataccgccgccacaccaaacatggccacgatcatgaagacgacaccgagcacgtatgcggcaacgatgatggtggttcgtccagccaggctcccgttcaaatcagccgtcggaccgttcatgcgtttcgcaacgattgtgcacacgcctgacatgacgaccgccatgaggacgagcgtgacttgcaatccgccgttcagtcgtatggtccaatcccatagtccggtgagcatgccggcaacgttttccagaagacgctccattctctgatccttcccattgttggctattgatgaatggctcttcaatcctgatgcggttcccaccagccagcggcgcacggtgtctacacattctccgaacgctttttgtagacaccgtgcgccgtcgagcgcggcgtatcgattcatccttgcagggtatccggttcatcgaaggtaaggagttgaatttgtcccacagcaacagggcccgcgacacaagacgcaacatttcgaaggcgattcgcgaatcccagcagtctcggatggacgcgctcgatgcgttagcccaaggattgactgaaatcagtgccgcgcgcatacggctcaaggagcttgagacgcatgtggaagacttgcgcgtccaggcgaagaatgcgggcaacactgccactgacattcgggccgtggaacgtattgttaatgaactcgctctgaaacggtccgaagcgccggagaacgattccaaggacatggaagagccatccgggatgggggatgagtgatgaccgggagggggaaagaaccgcatccgatgcctcgacccttccgctggctggccatgttcctcgcgtttgtgttcgtcatatctctcggcgtggctgccacctatcgaatgaaacgaaccggcaacgatggagatcttgggagagtcccgtccaaatctgcgcagaaggaggacgtcagcccgcacggtgaatatgccggtttgaaggccgcgggagtccccgttcccggtgaatggtcgcgtcagtcgctcttagccgtcgacgggacgcagaacagtgacggaaacggtgccgcgctatcacctgtcggaggggatgggggaccggtcaacgtcgcgttggagacagtcaacaggattctcaacccaacgcaatccgacgtggaatgggaccggacgatgagagacctcttccaaccggatatggccggattgacgcatggcccgtcgaacatggctcgttactggtggcagcaacgccgcttccaaccggaccgcctctgcacgggaatcgcaaaggacatgctcatcattcagtcctatgactgttcgacggaccgcatgttccaaggccagaatacggaagcgatcaagggtacccagtactggtggacgggcatatcatttttcgatgctccacggtcgatcacggaaaagattccatcgtcgaccgaccctcagaccgtgatttcgcaatactacgacgcggttgctttccccatggatgacggcgtctggtatgtgaccgtcgcatgcccggcgatgtccgatcatccatatctcgacgaaaacggcaatgagctggcgacggaagacgacagcgctccatcctccaagtactggattagcgtcggttcgatggtgggagtcggcacgaaccaacgtccgtgccggccggttgaaatcaccgtcggcgggcaacgtccgttctggtacatcggtgcggacgggagtaactgacatggctgtatcctgttccaccgacctgatgaaaggcttgttccgtcgccgtgtgcttcctatcgttgccatgctgtgcatcgtattgacgaccggtgcgtgcaatccgactgatgtattgcatttcctcgccggctgcaaggatggctcctcgtcggcggaatcctcatcgagcatggtcgcttctactgcaaagggcgactggacgggactcgtcggcaagaccgaaggcgagatcaaacatatgtggcctagccacgtggcgccatgctcaggctataacgtgctgtatggcggctccagattgcaatgcacttggtgggcgtgcatgcgtcagcgtgccctcggccatgatctgggccaaggatcctggggcgacggcggcagttggggagcatccgccaaggcacgcggttggaaacaaggtgccaaagccggaggcatcatctcttgggcgcccggctcgggaggctcggatggactgtatggccatgtcgcagtcgtcgaacaggtcgatggcgacaacgtgcatatcagcgagggcggtgccgggttcaggaattccaacggcgtggccgctatccacacccgggtcatccccattcacggcacgggcgcgactttctggtatccggacggcaacgacaacgccgagcccgtggccccagataccagcaaacgatcctcctcgtcattggccgccacgtcggcgaaatggacatgctcggcatcctcgtcgaacgattcgacgagcggagcggtgaacgtgaaatacaacggaaacgggtatcatgccagtcctgaggacgccaagggcatcgccaagcagatgatcgccagcggatacaaggaatgggataacgacaacgactggcaggcgctcgtgtggatatgggagcatgaatccggctggcggtggaacgccgagaatcccacgtccggcgcatacggcattccgcagtcctatcccgcatcgaagctcgctgctgccggaaacgactggaaggacaacgcggccacccagatcaaatgggggctgcagtacatcaagcaacgttatggcagtccacatcaggccaaggagttctggctgcgcaacaacgcttactaagattccatgaccttatgtgcctttgcctcacgattacacaatctaggagggctggatagaaaagtgattctgcaaaacatcggcgtcatcgcgagcatgcgacggacggtagattgtggagtactaaaacatatgcatcgtcagggaagttcggcttcctgtggataaaaaggagaatgcttgatgacgtgcaccggcactgaagcaaaaagtctgtcgaagacggctatttcagatgaccatccaagcacgctgggcaagacgagcgtggagaaagtcagcgaaccactgacgaagtccgtgaattaggcagacagaggatgcgtagttatcagcaagcgaatgcctctcttcctattgcccgacagcatttaccttggcgtccgataagaggtttcgaacgttctcttggaaatatgcatgcaattttaaactctacgagcgcatttgaaaagaacaaattccgctgcgattcgtaaaggaaagtaaactcatcaaattcatttgcaatgatgctcagcacctgaacggattaatcgttagttttatccactatacagaattcatataacaagcaagcgttttctggccttcctttttctaccattgatttcaatcaacttatggcaagaaagaaacatgatgaaagtagcagtcttttcagcagggaacaccggattggccacagcagctcatctatcaagtcttggttttcaaccgatgttgtatacacgtaactccgaaaaactacgaatgcttcaatcccatgcaatggaatcgaccggcatactggatggctcatggcatataccagcaagcagggacgcgaagcaggttttgaacggtgccagtctcgcaattgtgtgcacatgggcaaatgcacaccgtgcgattttcgaaacaataaagcacgcatggcaagaattgccacctcagcctttgcggattctcgtgttcaacggtaactggggcgcatacgaagcgtatcagatgttttccatggactacatagttccagagagcataaccatcgctgaaaccgctggaatgccgtatgtggcacaagcgtcatttgacagggatcatccggtgccatcagcgtcagtccatattagtggcatcaagtcctccattgaggtcgcatacgcggccaatcatgacgccgaccatgtcatcgattcctttttacaggctatgtacgccatagtacgctatgacacatccgtcttcaccacttcgctcactgctcccaatccaatcattcacgctccgttatgtctgctgaacatgacgaaaatcgaagccggtgccaattacaagatgctggtggaaggattcacggaaaaacagaacggctcatcctagctatcgatgacgaacgtaaagcgttagcgaacgcgcttggatgcaaatatattccaatcggcaaacagctcaatagcttctggggaagtagctatgcgaccctgcgggagctttttacaaacaattcattgtattcgcacgtccgcggccccgcgaacgtttcgcatcggttcatccatgaggatgtgccattcggcatcattccgctggtcaggcttggacacctgttagatgtccttacgccaaccagcgaggccttatcgactatctatagcatgtacctcaacgaatcgttcgacggtcccctgttcgatatagagatggttgaggcattgggaaaatgacgcgacgccgtttcctcccattcagactcatgcaacaacatgttcaatcatgttttccgagctaaacgtcatttcgccatcatcttgctgagaaattccttgattcggggcgactggggattatcgatgacctgttcgggggttccctcctcgatgatgttaccttgttccacgaaaacgacccgtgacgctacattccttgcaaaacggatttcatgggtcacaaggatcatcgtgacgccggtgccggcgacttttgtgatgacatcgttgacgtcgctgacgagttcgggatcaagggctgaagtgggttcatccagcagaatcacgtccgggcgaatcgcgagagcgcgagcgatggagacgcgctgctgctggcctccggacagctgcaccggatacctgtcctcatacccgtccatcccgacgcttgacagggctttcaacgctctttccctggcttcgttcttggcgacgccacgcacgacggtcagaccttgtgtgacgttgtccagaaccgtcttgttcttgaacagattgtagttctggaacaccatcgcggtcttgcggcgtagttcgagtatctgcttgttcggcactttgccgctgaaatcgatggtggttccatcgacgcggacgataccggcgtccggtctttccaaggcattcacgcagcgcaggagcgtggtcttaccggagccgcttggtccgaggatggccagcacctcgcctttgcgcacctccagatccacgcctttgaggatctcgttcccggaaaaggacttgcggattcctttcagcgaaacgaccgtttcgccggtatcatgtccagtcatacagcctgtttcctttcactgcttcttgaaacgcagcacgcataccggcttgccgtctgcgatggtgccttcgagggagaacttcacatgtgggaactgggccgcgaaggcgtggtcgccggccatggcgatctcgcataagcgggcgatctgctgcggattctttccttggcgtacccactgggtgacgtacgggcagtagtggaagtcgatctcgagctcgtcgtcggtcttcttgaccgtttccatctcgtaaatctcacggttgtggtctgtgccgaaattgtcgatgaactcttggaacgaatcgggatctttcagggtcttgcggaattccttggcgttgtcccttccgtaatcggctaccgcatcgtacgcgaattcgtcatcgaggcctcgcttcgaggcctcgtccaccatcctgctgatggtcgccgcgcggcgttccgagatttctcttgtggcgtcgacggtcttgctgcgcagatgaggagtgttgttttcgaatgccatgatcggccttcttccttgggtttgtttggttgttctgtctgaatgtccaatatttacgcgcgtgccggcttcaggaagaatccaacgcgtttgaagagtcgttccgacccaaattcgatggccgcgcacacgacccagtagatcagcgccgcatcgatgtatgcctctaagtactggtatccgtcggcggcactgatctgcgcggtgatgagcatttcggtcacgttgatcaacgaggctaggctcgtgcccttcagcaaccagatgaagtagttggtcatgcttggcagcgatatcacaaccgcctgcgggacaatgacgtgcagagccgtttgcagtccggtcatgccgacggactgcgcgctttcgatctggcctcggtccacggccttgaccgacgagacaaccacatcagttatgtaggcgccgaaattgcaggctatcgccactaccgccgcggggaaatacgagatgtgccgtggattgaagtcatagatgccgatggaaccgagccattttgccacgaacgggaccgcgtaatagcagaagagtagttgcacggcaagaggtacgcccttgatgaacgtgttgagagcgaccaccagctgtttgaacgccggggcgttggacaggatcacgcatccgaatatcagggcgatcagcagcgcgaacagcgtcgaccagaaagtgagtatcagggtcttcggcaatcccgccaaaacggtggggaagtccgtgaccatgaaatcatagtcgagttccatcaggcgtacctcctttcatagcgttccatacgatgtgaggcgaaggtgaagccgacctcgatcaatgagcacagcacgaagtagataatcgcaacgaggcctagtatccaaagctgtccggtgccgtattgtgcggatatgatcgctttggccgaaccaaggatctcgacggttccaatcgtgtaggcgaccgaagtgtccttgagcacgtctatctcgagattcttcagattgaggaccgcgaccttgagtgtctgaggggcgatgacgtggatgaagttctggactcggttgtagccgatgctcagccccgtctcgatctgccctttgtcgacgcccagatagcctcccctcaacgtctcgcagatgaagcatgaaagattcatggccgtcgcgatgatgaagaagaccccgggatcccagtcgtcgatatccaatccaaagaggtagaacaccttcggcaatccaaagaacacgaggtagatctgcacgattcccggagtgccgcggaaaaacgagatgaacaccgtgcacagccagtagagaacgttatgacgcccgaccctgacgatgcaaagcagagtgccgaagaacagggccagcaccgacggcacgatccagtacagcaaagtggccggtaggtactgcagtattctgggcagcacgcctgtcaacaggtcggacggcatgacgtttcacctcgttccgtcgggtcagtccttgagggcgccgagttcacgggccttctggaagttgtcctgcttgaagtacttctcgctgatcttgccgagggtgccgtccttgatcaaggcatcgatctgctcgtcgatggccttctgaacgtcgccgttcttcctgttgtacaggatcacggttcccgcggcgtccaccggatcggtcaccttgagcttgtagccaagcgtgtcggccacgccatcgtactgcgccttggacagatagaccgcatcgtaggtgccgtcatgcactgcgttgaacatgtcctggaaggtctcctgattggtaacggtgggaaccttaatcttgacatcgggattgcgcttgagccaattctgaatggccacgtaacgtccgtctgtcggaacgatcgggtcaagggtcttgccatcaagatccttcaggctctcaaccttgctgtcttccggaacgatgaggttcatgaagaaatagttatacggcttggaaagcagatactgcttggctcgggcgggggtctcgaagaacgcgccgatcagtgcgtcgtacttgccctgcttggtgccgatcagtgcggtctggtagtcgatgacgctgtattcgaacttgtagttgtcgagcttcttgtcgatggctttaagcacggtgaggtcgaaaccggccggattaccgttcttatccgcataggagtacggcggatcctgggactcgagaacgaatttaacggtcttgaccccgttgtcggattccttcgcgttcgcggtgccgcagccggccaacgcccccaacgagccgaccgccacaagtgccgcgaccaccgtggtgaacaatttgttccttctcatttgtcttcctctcttcggaaagcgttgtcgtgtatgtggcatgacggtacgccagaaaaacggggggaacaaaattctcggtcatatgttttgtttataggcagtgccaacagcgcgaattggagccggttgataactcgttataaccctctttcgtctcattattcgaaaccgtcgataacttttgtgcaggggtccgcagccacgctcgaaaacaggaaaaaactgaaagcacatttctgttcattgcgttttataccaagctcatatccgctataacgcagttcgatagcaagaataccgtgcgctaatcatcaacagggttgcaacatcaactatgttgttcatgacagtgcacttcccacatgcatgtattcgagatgatgcatgatttctgttctagccacgcaaaaatgaaataattcggaactcgaatctaagaagagccttcgccgcatgaccagcaccaaggcaatggtcttactggatgggttaccgaatagtgtccaacataaacggacgaatgttcccatccaaacatgtagacatcgtgtcccgttcatcatggatgggacatagacaatgttttcggcgctgtgcgccgtcgaaaagagcgggaagcggtttccgtgcggatattccagccggaaggagtcaccatggaacgggaaaacggtcagctaggggactggaattcggagcgttggacgcgtatgaggcccgccgacgccttcgcgcatcaacactatcgtccaatcaaggctggtctcacaccaaacagcccaataagcccagccatagtgtttggacagcttgccgacatagaggcgatagtatgagcgggagatgggactcgaaggggaacgagtggacgaatcttaggtttccgaatgggtttgcgcacccattcatgtctcagagccgcgacgggagtgcgcatgagcgtatgcttgtggtcatcccaaagggtgtcattctatcggatggccgcaacttgggcggttggaacctgagcgtgccggcatctccatgggcattgatgcagaagcgcactgggagacctgtgaacatcgggctgcgttccgaccagcccgtcgaactgttcaagggacgtggggccaagcggcaagtaatatcgctggccagccccgaggaactgcgcgccgcgctgaatgagcatcgcgacagaatgcttggtcaaaacaccgttcgtgacaagccggccgctattgcgtacaacgtaattccagcgtttggacaaggtgcggggggaggcctcgctgatgcggcccctcagtcatatgagccggcgaatgacgaaggtatgcgtctattcaatgatctcgctttcgatgtcggtttcgtctcgcggatggatatgctcgtatccggattcgcggacgattgcatccataaccgttacgatccggaagcggccttggacagaacccgctcgttgacagagcaggccactcgtcttctggaaccgttgtccggcgtggtcttcagcgatatggcaatcgattgcgccgcgaaccttgcattgtcggcagtgactgacgcgatcaatggttatatcaacgaactcacggatcgcggtgaaggcaatccatccattatcgcggcgaaccatgcggaatacgtcgaagacgcacaaacctgtctgaacacggagcgatgtttgcgcatgttcaccaccgcgtatggcaagacagcagaaactgatgtatttggcgacacgatgtccatcgagaacctatccatcggcccaaacatgatgacgcgattgagataggggagaatggtcaatcccaccgttccaacaacattcgactctttgaatccacctatctggctggacctgtttttagggaatcagccatcacgtcgatcaatagggaaggatcactttcaaccttgataagtattaccaaccaagccgatatcacggatattcacaatccgaaaaacaagcaccctaagatatcttccacatcgtgtgtattcgtcatccagatgttgagattgaacaaaatccaatttgtacttcttgtagcgaaacgatacgttgttttttgtgacaaaaaagttaccgtcagaagtgaatcacaaggagtgtgaatgctgaagagggtaaaggattggctacagcatagccacatctcataccgcaatctcgctgacgagatgaatcaatcggtgagcggcatttgcaaaaagcccgatggcaaaacctatggcccgtccacgatttgccctgactgaagacacatctggaccatccttacgactttgtcatcggcaatacgccgcggatgaaacagaggaatggaccagagacatcgcaccgtttgagggcagatgtcgaataactaaaaattaaaaagggaagtcccatcccatcggaaacgcaaaaccatcagggacagggcttgcatgcgaaccaatggtcggaaagcctgccggggcattccgatcgtcttacaccccctcgaggacgaagaaaggtccacatatattatgatagctgaaaccaccatccaaggcgtttccaacgtcaagtgtagattgcagatcagtactgaatggtacacattgtctacaacatccgacgaagcggttctgatgtcacgacactggtgtcgaagcatggcacggcacagactcataaccaccctaagtaaaccctataaatgttgcgccgaccattcaagtccgatgacggtatgcgtccgcgtcagacatgcagtttcgaaagaaaggagtgtggaaagagatagagccgtaggccgtaatccaaactcgcaacacggcgattgggacaactttggatgctcggtcaagcgcatcgcggacaacgtcgacaggttggagaacaagaacgaggagggcacaggctcatcggctgaggtggatttgcatacagaacgagggaagcgttccgcttcgatggctgcacacccctccgcaacccattccatcaatggggaagggaagcgttccgcttcgatggctgcacacccctccgcaacccattccatcaatggggaagggaagcgtctgtaatggaggccatgtatatcgtgttcgcggccgcggctctggtatgtctcggtctgttgttgccggtcttgtctcttatcgcgaccgtactgtcagcgctcgtcagcctgctaagaagcatcgccaagctgattggcggtggacgatgacagccgggactcttgagaaggtgtacagactaaacgatccaaaaatcagtccgacgatgggcgcggtactcgcatactacgccttccgctcctactacatggacggacgttgcgcgtggccgtcgcttaccacggtcgcgaaagcgtgtttctgcgacgagaagacggtccgccgagcgctggcccgcctatgcgagattggttacatgaggctcagccccgatcagtcatggaatgtgcgtgacacaaccaccggcgagctcaaacgcaggggatatcgcagcaaggtctatgacgtgcttgtggagaacttcgcctcaatggctgacgagggggcttccgaacgtgccggagaaatggtggaaaggcagaccggtcagaatgcccaccctgacgaaaacgttgaaagcatgccgattccacagaccggtcagaatgcccaccctcagaaaagcgacgaaaacgagagtggacatcctgtcccttcagaccggtcagaatgcccaactactaacaaaagaccaactagcaacccctctctccctacgggaaagctccccgcaggcgggaagcgcatcatcgaggagaagaggatggaacgtgtggaagacgccagcgccgatgtgtggagggtgatggatcgtctcgcttccgtccgttccaggctggcgctgtctacgtcgaaacctaccggacgggattttgcgagaacttcggatctcatcggacgtgttaccaaagccaatggtgataatcatgcggtcgcgatggctctgatcttcgacatcattgactggctgccggcgaacacacattggctcggacgcgttgattccgcacgccatcttgccgacaactgggaaggcatcgccaacgactggaccatcgtccagatcaaacgccgtcgcgaacacgacgaagccgcccggaaccaagatcggaaaacagtcgacaaacggtcgttgattcccgacagtcactcgagacgacacacgcattcgctcctttgcaagcatgtcatcgccgacatgaggccacacgaggatgaatacagccatgagggaagtctgcgctacggcaagccgtcagaatggcagaccgcgtgcatgcggcacgcggacaagctcaaccgacgagatggaatcaaggtgacggaatgaccggagaatccaatctcgtcaccggcgtctgctccggtcttccactaggcatccaggatctcatgtggggcaccgacaacgaacgaatcaaaagcacatccgaccagagggtcctgaaaagcaccgcgcgcatcctgtgcgacatgtgtcccatccaggcccagtgcctagcccaatccatcatcagccgcgagcagcacaacagaatcggcggcctcgatgtcaaggcgcgtcgcatactccgccggcacgccgaagctgatggagtgaatctgtcgccatcgagcccagcgcggacacggaatcttaccgtgtggctccgggagcatcccgaactcgtccgagaggtccgcacgcagtcgaccacccgtgaggggaggcggcgtagaagtgaggaccagtacatttatcggcatcgcaaagcgatgcgggaaaaggccggcgaagcatagggcatctgatgtgccgggcaggcctggtcccggcacgtcttatgtccatcgaacttgtagacaccgtgcaccgcggcgcgtccttcagcaatccaagatggaagcacgggaaacgacagagcaacgtccgattggaaaggctggcgggaatggcacaggcgacacggcagcaggtcaggaacatgcatgggctgattgaaaccatgaaggaacgcgaatacgttcctggtgagtcgaaaatcaccgacgaccgaatcaccgacacgttgaggggcatggccgaaccgaacgggctgacggatgcggtgatagccaagatcattcgcccagacatgggattcgacgagttcgagtccattgccgacttggaggaaaaggcctcgtatgacgtgttcgacacgcttcgtgccattatgctgccttccggctatgacgtgtcgcacgccatggcacgcgcgttcaaacaggatattccgcgccttttcgagcagttcgcgatactgatccatccggcgtcggagcgtgccggggcctatcgcatcgcggccaccatcagttatctcgaaggagattccacgattcgctgcaagcattttgcagatatgctgttccaggtcaagcccgaggacgagatgctccgtaatctctccaccgcgctgatccatggcgtggagccggatcggccatccggaatcgaagatccttccaacatccgaaaccagcggatggacaacgcgacgctcggagcgactgccgccgaatccgcaacggctatccgataaaggaaaagagcatcatgaacgcggacaacgggtatctccccgctttcgactccatgccgccattgccaccgcacccgtcggcacgttcccgaaaccggccgaacgaaagcgtctcgggaatccatccgacccctctaaatcctccaatgccgaatccgatcattcccgcacccggaaacgatgacgggcgctcgaagatattcgccgcgcagccgatccaggtgccgccaccgattccatcgttcgccgcccggcccgctccgggccgcatatggctggtgggcgcgcatggcggatcgggatgttccaccatccgcatgagcgcaaaagacaggtacgtggacgcggggcgcgcgctgcccgtcagcaccgacccacgtgtcccaagccggatcgtgctgtgcgcgatgtgcacgggacgtggcctcgaatcgctcagaaatctgctcgccaactggaacgacgggctcttcggcgcgagcgtccttatgggagtggccgtgaccatgccatcgccgagaactccgcgcgaactgcgcaggggaacacttctggtcggttccgccgcaccagccttgtggcggcttccgttcatccgcaatctcgacctcgacggttttcccgaagcgtatccacatgcgtatgagaggatgctcaaggatctcaacgggagcatgcaaacggctgacggcatcagcggcaatggctaaccatccgtggaagcgcgcttcctggatgccgtacgctcaggccgatgtattggccgcggcctcatcggctttgacacggtcgatggctatcaccagtgccagaatgagcacgtccagtcggtcatcaaggacccgcacctcataggagtctccccaagagaggagcttctgccggatatacgcgaccttggcgccgtccatcgacgcctcgaagctcagatcccaccagtctcccgtgatttgcaatcctggaacgtcgatgtcgtaccggtcgcgaaggaacgtgaatcgtttgctgatggtcgcttgtgtcaatccttccatggtgacggtgaagcgggggagcaacgagaacacctctttctcgatgcgtgccacctcgatgccgtcaaccgacgtgatgacgaatgatttcggaatggcgaggaagctgccgcgcacgtaatagcgtgggttgccggcgatgtcggtcaccgtgaatttctcaccgattgagaacaccttctgcttgacatacatcgtgctcatcgttgatccttccgacaccatctttacggcttgaatcttattggcaatcttatatgtcacaaatgacttcgccgtctgccggtagccatgggcatcgagatggaacgtgtagacgccgtgcaccgtcggccagcttggagcatgcgacggtggaaatgcatggtcaactacatccgaaggagaaaccacacatgatgatgttggaacgcatcgcatccgcagccgatacggtgcaggacgccgcatacggtatggtcctcgccgacctccagaacccaagggcgtgcctgcctcccggattctccagtccggtgaccaccgcgctcggatgggtcaaggccctcggactggtcgtcgccattgtcgcactaatccgcattggcgtgcatgtgctgcgtcagcagggcgacggcgtgcccgacagggacgacacattcgacaagatcatcaattgggtcgtcggcatcttcatcgtcgccggagctttggcgttcatgagcgcgctcggactgtccatcgcggaaagctgctgaacggatggcaagccggcgcaagggacgcctgtccgcgatgcttctcgcgctggtggccgtcttttccctgacggcctgcggaggaccgaacttcgatgcgctgaaggatgacctcaaattcggcgacgaagaaatcgccgacacacagaccgtatattccatgaagattcccaaaaacggcgtgggaaaactgatccgaagcaaccagatcgcctatgcaaaggccacatgggcgaatgccatcaatccgtacttcaacggcaatgcgagaaagtatctcgcatcggtccccgcgaaccaatgcgtcgcccttgccaacacgtaccaggaggagactcctgacgcgggaccgtggaactggaacgcggccaacaattcctgcgataagacccgtaagctcagctggctcgagaagaccatgtggacgatgtacgagcagcagtccgacgatacgattgaatggctcagcacgacccgcaatacgctcgttgccgcgccgggtactgtggacacgcttcagaattccatccttcccatgtatgacacgtgggacacgaacgtcaacaaatacctcaatgtcgcccaggccgtactcgtcgtcgcggcggccatcagtctcatgatcctcgcggcgcgcatcatctggcaaatcggcaacggctcggctggcatggacgggcatctgctcggcaggatcggctggattttcctaggcgtgttcatggggtcgtccgccgcgagcatcgcgctcacgttcttcaaacaggcgaatatgacgcgcaccgtcgtcaacggcgtgcccacggccacggcgggacggtccactcctgcgctcacgtcatggacgccgggagctggaacctcgtttttcgtgtccgattgggtacggctccaggtcgatccgttcctgatcatcgcggctgtatgtggtgtgatcgcagccggttttaagctgatcaccacgcaagagggacgtgacttggtccctttgggcaaggcgttcatgtggtccatgctcaccagcgtgtgcctcgcgggattcgtcaatctgttccaaggcactgtggacacgtggacggccggcgtgctcaggagcgcgtccgacatgatgaagtcggcgtggagccataacaccctcgccgcatcagaattcttcaatcttgactggccgattgcattggtgttgaccatcgtcatgtggttctgcaatctcatcagcaaggtgttctgctatctgcgtgccggtctgctgcccattctggtcggcatcgcgccggtgtgggccgcgatgagctggatggagactggacgccaagcgttcggcaaggtcatggggtggctgttcgcgttcctcatgtacaagcctgtagccgcactcgtcatggcgacggggtgcgcgatcatgacgaccgccggcgccggcgatgacagccaggccatcaccctcatgctcaccatcagcgtaatcgtgctgcttcccgcgatgatcaggctcatcgtcccttccgtcgcaggaagcatcggcggcggaggtgtcatcccgtccatgcttggcggaatggccggtatgggcgtcatggcggccggcggcgtgctcaaagccggcgcaaagggcgtgatgggagcgaccggcgccctgtccgggaaggtgaagccttctgttccgaacggcgcgaaacgtgccgtcggctccggagaaaacgctggagcaagtggcatcggatccggcatatcagcgcccggccggcccggaagtgaggtggccaagggtggcggtgagaccatgttcggtggttcctccatgccggacggaacccgtgcggctggttccgttccgaagggtgcggtgggatcttcggcgtcgaatggcgtgaagacgtccatggccgatgacgggaccggttccgtagacgcgccttccggaggaggcattcctgcggcgccgccatcatccggctcgggaggcgtacggccgtcctccgttgcgcagcagcctcggaaagacgttggacggcgggttagcgaaccgtcagccatacagagggtccgggcggagttcggcagtgttccggacggagggccgcacggtgcgaaccgttcgggcgcacgtaagacaaaggagttctaaatggcttccaataccacttacggcgattggatgcgtcccatcgccggcggcattcgcaacatcggcagaccgttgacgttcgcgggtcttggcgtactcgtggccacgctgatgctgtccatggttaacgtggttgcggccatcgccaccgcggtcgtcggcatcggtgtcatcgcgatacttgccatgcgcgacagggagcaccgcaatgtgcttgaccgtactgtggagcgacgcacatggctcgccgaatcaaggaagggacgggcgttgtaccgttccggcatgctcgccccggtcgaatcggggcagtgccgtctgcccggcatcttgtcgcgcgtctcgctcgtcgaggcgaacgatgggttcggcaaccggctcgccctgatacgtcacgggcataccggcgaatattcgctcccgttctcatgccagccacagggcgcgtccctcgccgatgacgatgtcgaggacgcatacgtcgcctcatgggccggtctgcttgagtcgttgggaggcgagatgggagtggcccaactgtccgtgaccgtcgatacgtcgcccgattctggcgtgcggttccgccgcaacctcagcaagcgcaccgttcaggacgcgcctgaactcgctgcaagggccatggcccagatcatggacctgtatgcgactggcggcgcttccagcagcgtcatcctcacgcttacgttccgttatgtcgacgcgcgcaacggaagattcctggaaccagacgaggcggcccgccgtatcgggcagctcgttcccaatctcatccgccgcatcgcagacgcgggaggcgggaccgcccgcacgctcaccatcgacgagatcagccgcatggtccgtgtcgcatatgatccgggcgcgcaggattcgctcgagcagaccgacgggcggccgtggatcgaatgggaggatgccggtccggtcgcttgcgaggccggctgggaccattaccggcatgattccggtgtgagccgtacgtgggagatgtgcgacccgccgaaatccaacgtgaccagctctactctggcgcgtctgctcggtcctctcgcagactgcgaccgcaaacgcgtcaccgtcgtgtttcatatcctgcctcctgacaagaccgcgttcatggccgagcagaacaggcagagggccgccaaccaggtcagccaggagaaacgcgcgtccatcagtgctatgagccagatcaacaaagcgaaccgtcaggccatcgaaatcgaccgaggtgcggccatcgtgttcttcggactgctcgtgaccgccaccgtgcgcgccggcgatgacgagcgcatacgtctcgaacaggccgcgcacgccgtcgagggcgccgcgggaagcgcgaagatcgacctgcggccatgttatggcgcgcaggacacggcgttcgccgcgagtcttccactcgggctcaatctcagaacctattcgccgcccaacgcgctcaccgcgctctcatgaaaggaacgcatgccatgcggaacacgaacacgaaagaccgaggcatggatccggacatgccccttctgcgccggcatatgccatctccgtcgccggagccaatctggagggggcggcgagcaaggggcggcggatgggctggactgatgcccacggtcgacgagttcttcggcaccagcacgcaggtgtgcggcgggttctggccgtttgtcaccgacatggccctgcccgtcgagggcgtgcccataggacggagcatggcgaccggcgcgggcgtgtgctgcgatccgatcagttggttccgggccggcatcatcgaacagcccagtatgttcgtcatgggtctgcccgcaatcggcaaatccacgttcgtgcgccgccaagcatgggggatgagcgcgctcggtatgaacgcgatcatccccggcgatctgaagcccgactatgccgaactcgtccgcctgcttggcggccaggtcatccgtctgggcagcggacttggttccatcaatccactcgatcccggcggcatccatgacgcgcttaaacggcttgccggcaaatcccgcgaggatttgctcgccgactaccatgaacgccgtagcgctctcatggaggtgctgttgaccatcagtcgcacgggccgtgaggagggacgccgcaccgtatccgacgtggagtcgaacatcctcgccaccgcgctcaggattctgtacgagcgtaccaagaacgatccggagccacccgttattcccgacctgcgcgaccttgtcaaacagggcacgccggagatacgcgcggccgccgtgttcgacgaccctgagaatgatcaggcgtatgcacgcgccgtgcgcgatctgctctccagcctgcatgggcttgcgaatccgatgggacggttcggacgcttgttctgcgagcagaccaccgaacgaatcgaactgtcccggccggtcgacttcgacatcagcgcccttgcccaagccggtgacgatgtcgtcgccgcggtgctcgccgccacatggtcgagcgcgttcgcggcgaagaacgcgaccgacatgatggccgaggccgggctgctgcccagacgcaaccacgtcatcatcatggacgagatgcatcgtgccctgcgcgccagtccgctcatggtcgaccgtcttgatctgctcacccgcctcaaccgccagtggggcgtcggacagatcatgatcacccacacgtttgccgatctgctgtgtctggacacccaggcgcagaacaacaaggcacgtggtttcgtggagcgcagcaagatcaaggtcctcggggccttgagccgcactgagatacagcattacctgcgcggcgagtccggcctgcctatcagcatgcgcgaggaggacatgctgtccgattgggccacgcccacgaattttgacgcgaacgcgagcttcaaaggggtgggcaagttcctcatcaagctcggcggactgcccggaatccctgtcaccgtgcagatgtgcggcatcgagcattccggatttaatgacacgaacgcgaagtggaaccgtcgatgatcgccatcgttccccatgcgattaccgacacggggctcggcgtttcaatccgtctcgccattcgcgatctcgccgtcgtcaacggatacggcgacgcgttgtcggtccgtcacgtgcgccgtggcgcggatgacgggctggaccggccgctcgatgccgcttcggtcgcgatcggcgcgcgcggcttcacgctcctgttctgtccccgcgccgtcatggagcccaatgcgttcatcgcgcttgtcatcgaccacgcgggccggatcatctggcaggaggacaccgaccatcccagttattatgagtcgtacgaccttgcgcgccgtgcattcgctcgtctgcatcgtttcgagcgcgaaaacaggagacgggtcatgacgccgtcccgcaggacaaaaaaggatggccagtgaacgagcgtgagcaaggcaaggtcgtccacatgcccgatttgctcgatccgaccttggatgagcttgaactgctcgccgaatccataggggagaaggccgacgggttcgaactggatatgcctgacggttcgaccgcgcgcggctaccgcacgcccggcgtccacggtcctctgccggatggctggcacgtttacgacatcatggagtgcgatagcgatcggtggacgccgtacccgagatacgaggacatcgatgaggatgagcgtgaggatggcgagaacggacgctatgagaccagtttggccgtcgacgacaatcccggaccacatttcgtcgaccaaggcgacccgttcgtcaccagatacgatctgactggcgttgattgggagttcgacgaggatcactgtgggtatgacggtacgcaattgtccgacgacatcatgcggctctccatacccgtcatatccgaatccgcttgcggcagagcggattcgatgatccgctgacggaatcgagaagaccggaatgcatgcggccggacgcatatccgtccgtctacctccacgtagacatcgtgccctattgcgccgtccatgaatgtcgacaatcgctttgaagcaacggcatggaatgccgtgacgggcagaaaggcggacgacatggcgaaacggactatcagcgagacggaattgcgtcagtggatcgacgaatggggagaggaatcccatgacgatatcctctccagcgacgacgaatcggatatagccaacagaatcctggaacatcatacgggaggctcgtatccggacgatgacgactgggacgaggcgtggaaggcgttgcgggacataatccgtcccgcattgaaacatgtcgacggagttttcccggacggcgcgaaagccctcgcacggtacgtgcgcgagcttggccagggcatcgatcccgaaaccggtgaggaagccggacggagggacgatgagaagccccgtcgcacgtcgttccggattcgtgccatcgcccacgccgacccggtggaggaaccgtgtctcgacaagatcatccaggcagccgaagaggactaccgtcatgatgtgctcgccggaggcgacacggcgcgtatggattggctcagcgccgccgcgtacgaatggcggcgtcttatgcttgagccgcacgcgccgaccgacccggtgacggatccgtccgcgttggcaatcatcgcggtgggtttgcggcatgcgcccgacgcgacccgcgccatgatggccacggatgtgctcagtcccgacctaccggacatgcgcgagttgagaggcatcgccaccaccgcggaacaggacgtcccggtagtgacactcattcctaacctgattgggcaatggcccgacgccattcctgacagggattcgatactcgaccgcgatcatgcggcatggcgcatcctctcgccgattcacatgaacgcgtccactcctgtcgaggggcgtatcgaaggattgctctccatgttcgaccatgtcgaatatgacggttcgacgcatggcatggaacgtgagcatgccgaacgcgcgctccgtttcgacccgtcggaccgtttcgcctccgcagcgctggatgccgcaacaggcccgaatgaaatgactggcctggtggaatgctcagaccacgtggaagatgggaggatgaagcgatgatcgatgatcggggccgcgcgttcgacatcgaggacgtggagatgaagaccactgcggcatggcggaacgggccgcgggccttcgacgcggaactgccggatggacgggttctcggacatgtcatgccttatgagggcaggtggttgtggcgactgtcggacgatgtcgaatggcatgatccggagccggtcagaggcggcatcgcgcgattcatcgatccggatgggcgggaagcggccatcctgaatctgctggaagccatcgagacgcggtattccgcatcgggcacggacatggagcgcgatatgggcgaggctttcacggatgcggacatcatgacgggcgtggaggatgccacggatgcgagcggcgtcacgcgttgaacgacggaaacctgtagacgtcgtgttccgtggtgagaccggtaggggcgcaggatgacgtgtggaatgccacgggcgtcgtggcgtccttctctgcgatgaaaggaaattgatggacgtcgatccgaagctccaaaccaatagggtcgccgatctcggacagactgtcagaccgtccagtcgagccgcgggcgttgcgctgctcaccgcgttggcggtcatgtccgtgttcggcatgatgtgcgcgatgtccggccatggctttgacatattcgcgcttctgtacattctctcgggccaatgggaattcacgcgcgcgcaatggacgctggccggttttcttatcgtcttgaccgcaatactggccggattgtgctggtggctcgtctcgcataaggtcgcaccgaaggtcacgggaagcgcggaccgcaccagggtcgatgtgtatgcaccggcgatgggtcatggcaatgccgttgccaaggtcaccaggcagcgtgcggagaaaatggcatcccggcttgtcaaggatttcgatcccaagcgcatggagccaggctatccgctcggccgtaatatcgttgacggaacgccgatgagcaccagctgggaggacatggcgatcgtgctcgccggcccccgttccggaaagtctctgtgctatgcgatcccggcgatctgttcggcaccaggaccatgcctcgcgacttcgaacaagggcgacatccttgatgtgacccggcctgtgcgcatgcatgaccatcctggtggacggatttgggtgtttgacccggaacgcattgccgagccgaaccggacgcataccacgtgggtgtggaatctgatcgattccatccacaccatcgcagacgcgaaacgtatcgccgactgttggcgatacgcctccggacagccggccacaggaggcgacgacttctttcctgggaccgccgcccagcagctcgcggactacctgttcgctgcccatcttggagacaagaccgtttctgacgtgttccgttgggcgtcgtccgaacgcaataccgagcctgtgaccatcctgaccaaacatgaggggtatggcgagatcgccagtcgtgtcagcagtgtcatcgcgttgactccggaaacccgtagcggcgtgttcggctcgttgcagaccatggtggcgttcctcgcagatccggacgtgatcgaatgggtccttccccgtgagggggacggcactccggagggcagggacgtgttcgatccgctcgcctttgctaccagcgagggggacacgctctatctgctgtccgcgcagggccgtccttcgaccgcgttgacggcgagcctgaccgcggtggtcgcgttcaccgcgtttcaatacgcgcaggcagaatgcgcggacaacagccggcgtctacctagaccgatgtgctgtgtgctcgatgaggccgcgaacatctgccggtggcccgaattggccgatgtgtactcgtatttcgggtccgccggcataccgatcatgacgatctggcagaacccagatcagggcaaagccgcgttcggcgagacgaacttcggtagcctgttcaacaacgcgaacatccttgtctacttgggtggcatcaaggatgcgaaatggcttggcgagatcagtagcctcgttggccagagggagattgtccggggcagcctcaatatcgacgggcgggggagacgcagcgtgaacaatagcatccagaaggagaacatcctggatgtgtccgacttggccgaatggcctgtcggccgggcgctcgtactcgcctcgcagtgccgtgcacagattgaccggaccatgccgtggaccgaaaaccatgtctggaacgacatcatccgcagagccgcatgacatgggcttcggatcattcatcgaaaggttgagcatggcgttccatagaaatccttcaaaagacaaagagttccaaacaatccgcaaggcgatggtctttccgccgaacttgtcggccgatgcgccggcagctcctgttccacttccgtggtcggatgcgcttccgccagagccgcctgctccaccgcaaacggcttccggaaacgtgcgggtcgaagaactgaccatcgaggatgggccggagctagaacgcgcggtcgctgccacatttgccgtagatggggttaaggacgcgaccagatacgggttgaccattccttttctccgttggcttatcgcctacaaggccgagctcacggcagaggatttcgccgtcgtctcgcgggaagatctgatccaggtcgaacggaagcggacggatgcgagacgacattcgtcgaactccgcatatcgtccgcggccttcccagatcggcatcgagcgggagccgaattcgaatccaaagattttcgatgccacgacagtcgattccgagggccgaacttccatcgccactattcagaatggaggtgagcctgcggatggaaacgggatcgacgatgtcctatccacaccggaatcaagggagataggtgacgaccaggccgaacgggaggctctggtcggccaattcggcgcacgcacgcaaatgcgtgacacgtactatccgaacctcgcttgtttcgtggaactgcatgtcgcgaacatgtggccctaccaacagggcgtgatgacgaagttcctatgggtaccggactggtggcgctatccgccgctcatctaccagcttgacgcgctgtggcgtgcctacgagaacgcgcgacggcaaccgggacagatgatgatattcagcatccaggcgttcggtctgctcgaccgcgtgttcaacaaggacaccggtctcgtcgcctctcttggcatcgacgagaccgagcacacgaccggcccgaacgaaccacttccatgtatccggcctcctaggggctggcggcgcaaggccatggaaccgctgcgtccaatccgacctaaggacatggatgaaccgatacccaccgtggagatggaaaaacaatcacaccgcatgataccgaagatgcgctcgtccagtaggaatcaacgaaaacaacaggaaggaaatcgatgatgtcagcgatggatcctgatgacgcactcgaccagctgcttaacaacacatggagcaacatggcccagcagttaggcatgctgcatcgttccctgagcgcggacgcccagcagcatcggagggaacgtagggcggagcggatgcaacaaaatcggcttcaggctgcggaaatcaaagagatggagctgcaacgcacacgtctgttgtcttgggagagcgcccatcgacgtgaattgaacaatggtttcgaaagtgtactgaacgcgaccgtactcggtaaaaaaggttgttcaccgttaagcgacaccagtctgctgaaggcttggaatatcagcgacatgctcgtggggacggatccaggatacgcagcccagctcaaccgtgcgcggaatcttatgaatgcggaatggtcgaaacgccatcctggcgagacgattgaacaacatgcggaccgagtcacgcgcaacgtgactatcgcatatgcggctcgtacgcccgcattggaggatacgctcgccgcgtttgagaaggccggattcactgtctccttggatcggcaggagctgtccccaaatgagttcgaggccctgcatgacggtgaaacatttcgggtcgaaccggagttcggcgagggttggaacgggcagaggaacgacctgatcgccgagtgtgtgatgatgcaagccgtcgtgtccgtcgatgaggcaggacaacagatcagctatttacgcgatgctggactgccggaatcatctggtggcgacaaccgcagcgaaggcaatgagccctccagcttgttcgagggatccatgaacgaaaacgaaaatgcggctctcctttccgacctgccgctcccatccgaatccaatatggaaaaaccggataagactgctagcgccatgattgtttcctcttccgaagtcggacccacggagaggagaagagaagaagtcgtcgaggtcaaaaccgggggagacctatccgccaccaggatagagaccgttgatgatggaaccaatctggttgacctgtatgaagcagaggaatggaatggtccagatatgtttggcgaatatagtcccaagcaggaggcgtcaatgatgggtagtaattcaccaatgccggcagggaacatcgcgttaccggacattcgcactctcaaacattcagataatcgataataggttatatgtttcttatataaattctatataagaaacatataacctccatacaacatcacttcatccgccgacccacaatcaaaaacagtcaaatcgacttcctcgcaccaccccaaaaatatccttgcgaacacatacccaagccccgcttaagtgttgttaccaaaaagtgatacaacgtttattttgccggcaaaatcaacagagaacatagaaagcgccccgtaaacacgaatccagaacacacctcggatatagagaccacttcatcacatgaggcaaaccacggcgagagtcgcagtgaatccgccgctcaaaataaacccgcaaatcaattcccgatgaccccaagaaggggatgctacagtccaaaaaactatataatagttatatatatcttatataactattatatagttatgcagatatgtcacatcaacgcaaccgattagcgacaataaaaaggtcccgcattatctaaagtgttgtaccctcaatagtcacaacgcttattttcaatagaagctaagcgttgtaaaagaaccagatacatcacttatttttgcggcggccaaaaatgcaatcatcccaaagttgccgaaccatggaactcgcggtttcgatggtcgtacagacaaaacgggcattcatcctggggtgatataccttccagatggtctctggcaagaccgacatcgaacagagactggctggtgaagacttttccccatccagtgatgttctgccagaatccctcatcatcagatttcccgctaacgagagagcacgaatgagatgatgatgcgcgcctagcaaattcctcgttacgttcttttttcctggtctcggcaagagtgggcacatgcgtggaggaagggaacagggtaacaccattgctgtcgctgactgtcaaatcaagaccatcccatgcatccctcacatgaaccaaagcagctttaaatgtctgcttgaattttttcatggtctgagcggagcttccgaattgtccgcgaagctgttcccaagtcaccagtgatggctgacgcagataggacatccttcgattgagccacaggtagatatccaaagagaggggagacttgatcttgttcagttcgcgaaggaccctgaaatcaacaggtaccggattctccttgaccacctttttcacaaacatttcggagaactgaatccagcattccttatcctcgggatgctgagcccattcctctgcatccacccacggaacatgccaggcctcggcgacgacgaattggcctcccgaatcaatctggtcctcgccaagatttgtgattgtgtatgcggttctgagccagtagttgaattgattgcgtaaacgtctatactgatttcctccccgcgtaatgcctaagcggtgttctgcaaattcgtaaaaactttttccgatgacccatttacggctggaggtatcccaactggaatcgttggtcaatatgagagtggcgacaatggcgtcaagattacgcggcagcttgccataaggcatgcattcaccgagagcggtgaaggtcacctcgacattgccattccgttttacgattttacgttccggggttttcttcaatggaagagaaacaatggaggagatacgtgatatgtacccggtatcagcatcgaagcgggagacttcctttttgggcatatcttttacctctggactttggcgaaacggcggcatggggtgttgttatttaggtaccactgtaatgcatagtggtgtcattcgggtaccaaaccgtatgaatagtgtcattctggtaccaaagcattgtcatttgagtaccaaatcatgtcttctaggtaccgcttggagcatctccccgtcatctgatttcattggtggcgatgtctcctccccctagattgctccgtgtcttctaggtaccattccaatacgcgtcgaagtccattttccttagaaaacattgggattcaccaccaaaaccgaagggaaaaggacatttcgtgtcttctaggtaccagctcgtgtcttctcggtaccaccagaatccgcgccgaaggtcaattccccctagaaaacattgggattcaccaccaaaaccgaagggaaaacagcatttcgtgtcttttgagtaccaatgtgtcttctaggtaccatttcgtgtcttctaggtaccatttcgtgtcttttgagtacttgaataccctcggagctctactgtcgcaaggatttgaggggaatcccctatatacctatatacctatactagaaaatagattcgtgtcttctgggtaccagctgtagattggtcagacaccttgtatctattctaaatgttgtatctaaattaaccacaacatttatcttgtctgtttcaccacatcatttttcaagaaagtcaactggatcacactggagagcttccgacaaacgtctggcagtatctagcctcatgccggaggtagagcggtagccggtctcgaaccaagaaatatttggttgaggaattcccgtcatttcagacagctcactttgcgtatagccacgagtcctacgaatctctctcaatccgtcttcagcacaatgaattccgcctcgccatccgctatcggggtgtaaatctaaaacattgcaatgcaacgctttggatatctggcaagcagtgtccaaatgcatgttgcgtacactttcgggattaccttcaaacatggcaagacgttcatgatcaacgccggaaagattggctagttgctctagtgaaagccctttctcgagccttatctcttgcatccccataagcaacgcctccatgccattccctcccttcaaattatcactaggttttctcccaccctccattcggcctaccggagagagaggttcttttcccgatagtctgctgtgaattcaggcttgaattccacgcgacccacagaataacagaacgccctcaacgaactactttgcatgattctgtcttatttgcaacctagctggttacaaaccgcatgaaaaagccagatatggaaagatacattttcaacgaaagaactttccgacacgccgagggaaccgttgcgcggcaacgcctcacgccatacgcgcgggacgccgatttgcgtggacgggcgggaacgtgtaaattaatcccttgctgccgctcagcgagtggtccggttcactccggattgcgaggtgggtgagtggtggtggtttgagaactcaagagcgtatttgtactacttctttatagtcaatgattgccagttcgttgccggccacgctgacgcgtggtgccgagggatcggtcaaacggcggcgaggtttttgtgcgatgcgcctttccttataaggcgatcgtcaattttcttattttgagagtcattcaattggttctcttcatgaagttttttgtggagggttcgattctggctcaggatgaacgctggcggcgtgcttaacacatgcaagtcgaacgggatcggctggagcttgctccggccgtgagagtggcgaacgggtgagtaatgcgtgaccgacctgccccatacaccggaatagctcctggaaacgggtggtaatgccggatgctccagttggatgcatgtccttctgggaaagattctatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatacggtttcccttcggggcgggttcacaggtggtgcatggtcgtcgtcagctcgtgtcgtgagatgttgggttaagtcccgcaacgagcgcaaccctcgccctgtgttgccagcacgtcgtggtgggaactcacgggggaccgccggggtcaactcggaggaaggtggggatgacgtcagatcatcatgccccttacgtccagggcttcacgcatgctacaatggccggtacaacgggatgcgacaccgcgaggtggagcggatcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcccaaccttttttgggggagccgtctaaggtgagactcgtgattgggactaagtcgtaacaaggtagccgtaccggaaggtgcggctggatcacctcctttctacggagaatttcaggacacggttccgtgtccggtgtaagccccgtgctcgtggaatggttccacggtctcgcatggggatgctggtgtggaagagatcatgggcttggatgtcccgtcgggatgtccgggagtggtatgggtatgcttttgggctcccggaccgccaccccacaggttttctgtggcgcggttcgatgcccatgcgtggtggccggtcctgggtggctggtcggatcgtgtggcgcgtggtggtttgagaactggatagtggacgcgagcaagagaaactgaaagaacgtttctttttgcttatcgcgatttcgccaaactcttcaattgagtttggtttcgagatcgatcgttttgtgatcattttagtgttaagatttgtcgtctggcgatcttgctatcaggaaacccgcgggtggggcaatgacaatttgttttgctgttgtgccgcttgcgagggcgtatggtggatgccttggcagacagtaccgatgaaggacgtttgaggatgcgataatcctaggggagcctccaacatggctttgatcctagggtctccgaatgggggaacccgccggccgtcatgggccggcaccgcctatgggcggggggtacgcagggaagtgaaacatctcagtacctgcaggaagggatactccgtgagtagtggcgagcgaaagcggatcagaccaaaccggttgcgcgtgatacccgtcgggggttgcgttgccggtgttgtgggatcacgtgtcccggttccgacggaccgggcgggagtcataaaacggcttgccaggggaacaggcttgaaggcctggccgtagagggtgccagccccgtacctggacgtgagccgtcttccgatcgtgttgtcccaagtagcgcgggcctcgtggaatcccgcgtgaatcagcccagaccgttgggtaagtctaagcatacctgtctgaccgatagcgtaccagtaccgtgagggaaaggtgaaaagcaccccgggaggggagtgaaacagttcctgaaaccgtgcgcccacaaaccgtcggagcctccttgtggggtgacggcgtgcctatcgaaaaatgagtctgcgagtcagtggcgggtggcgagcataagccgtgtggcgtatgcgtagcgaaagcgagtccgaatagggcgttttcagtcgcttgtcctggacccgaagcgggatgatctagccctgggcaggttgaagcgcgggtaagaccgcgtggaggaccgaacccacctgggttgaaaaccggggggatgacctggggctaggggtgaaaggccaatcaaattccgtgatagctggttctctccgaaatgcatttaggtgcagcgtcggttgattgcgtcgcgggggtagagctaccggatgcttgcgggcccttgttgggtaccaacagcagccgaactccgaataccgttgacgtgtattccggcagtgagtcggcgggggataagctccgtcgtcgagagggagacagcccagaccgtcgtctaaggtcccgaagcgtgtgctaagtgggaaaggatgtggagtcgcatagacagccaggaggttggctcagaagcagccatccttgaaagagtgcgtaacagctcactggtctagtggttccgcgccgacaatgtagcggggctcaagcacaccaccgaagacgcggcagcaatcttcatggttgctgggtaggagagcgtcctgcgaggggcgaagcggccgggtaaccgtgccgtggacttcgtgggagtgagaatgcagacatgagtagcgagagacgggtgaggatcccgtccgctggatgaccaagggttccggggccacgttcgtcgtccccgggtgagtcgggtcctaaggcgaggccgacaggcgtagtcgaatggatgaacgggtggatattcccgtaccgaccatggaccggcaaaaccgagacggtgagtactaacctccgcctcgtggtggttccttccttcgggttggttccgtcgcgtggtgttgggagcgtagccgcagtaggtcagcgcaggggtgacacggaatgggagccggccgcggaggtggttttccgtggtcaagcacgcagccagtcatgtaggcaaatccgcatggcatgcatggcgaggtgtgatgatgggagccgttatggttcgatatccggttgtccaggccgtcgagaaaagcctcggcgtgagggccatggccgcccgtaccccaaaccgacactggtggtcaggtagagaataccaaggcgatcgagcgaatcctggtcaaggaactcggcaaatcactcccgtgccttcggtataagggagacccactggggtgaaggaccttgcgtccggagctttggtgggtggcacagaccagggggtagcgactgtttaccaaaaacacaggtgcatgcgaaggcgaaagccgctgtatatgcactgacgcctgcccggtgccggaaggttaagaggatccgtcaatcccttcggggacgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcgttaggcgcggattgtgtagcataggcgggaggctttgaaacgggtgcgccagcattcgtggagccgcaaggtgaaataccgctctgttctcgtttgacgtctaacctcgacaagtcatccttgtcagggacagtgcctggcgggtagttcaactggggcggttgcctcccaaagagtaacggaggcgctcaaaggtccgctcagcccggttggcaatcgggtgtcgagtgtaatcgcacaagcgggcttgactgcgaggacgacggtccgagcagggacgaaagtcggagatagtgatccggtgccggcgcacgggcgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacgaacctctggtatgccggttgtcgcgccagcggcacggccggttggctacgttcgggagggataaccgctgaaagcatctaagcgggaagcctgctccaagattaggattccgtacggtcttgaaccgttgtagcccgcatgttgaacacgtgtttgataggccggaggtggaagccccgtgaggggtggagccgaccggtactaacgggcgacggcgacataacattccgatccttttgcggggttggttccgcgtctttcctgtgctggatcgtcctggacggcaatatgcgttgggatggtcactgaacgatacaacgataggtgtttgcctcgcgtccgctagccggttcccaaaccgccacatgataattgaatggccggaatggttgccttgttttggttgtcgttccgtgatcgcggttttgcggtggtcatagccctggtgagacgcccggtcccattccgaacccggtagctaaggccaggcgcggcgatggtactgcactcgagagggtgtgggagagtagcacgccgccgcttcaaacgttgggggttcccgtcgagcatcctgctccgggaaccccattttttatccccgaatcttttgttcctcctcccggttcttccggctgaccccatgcgggttcccggaagggcttttttatttcccgtatttccttcttccttccgggactcccgtggggcttggcttccggggaccccgtctttccatccttgatttccatctgattcccaggtctcccgcaggggcatggaaatcctttccactcctggttttttctcttcggcgccgcggattcctgctagaagaccggaaaaactatggttttgggacctcgtgtgtgtcccatgcatcaaagcgcttagactggtcttatggcaagagttacggtgtatgacgttgcagagaaggcgggtgtgtctaccgcgacggtctccttcgccttcaggcatcccgacaaagtgaaggatgataccaaggccaaggtcctcagggtcgccgaggagcttggctacgttcccagcggcaacgcacgtagccttgccaaaggcaggacgggcacgttgggcatgtacgcgttcgatatgctgctggaaagacctcagggaagcaaccttgaggatgattggcctgatgtttcccccagatccatcgacgagcctctggacggtgacgaacccaacgttcttgtatatccgttatacgttgatgaggtgctccgcggcttcgaactcgaatgctggaagagcggcaagggaatacttatgggagccgcctcggaaagggatgatcatagatctgtaacggatatcgccggtcgcgttgatggtctggcgctgatgccaagtggatataacgatgcgcttcctctttccatgttggcgaagaccattccgcttgtaatggtgggtgtgggcgatgaaaaactgcctgccgcatacctgcaatgcgataacgcatcgggcatgagacagattgtcgaccatcttgtcgaagtccaccatatcaacgatatggcattcgtcggtggtgtcaatggtggagcgtgcgcgaggggtaccgacgctgatgacgtcgtctcgcgctatgacgcgtttaaaaaatacctcgaggaacgcgggctagactccaaaggggctctgttggatgactctttcgccacgtccgatgaatacatggtgggtttgtgcgaggcgataggatccggcagactgccgcaggccttggtctgcggcacggaccagaccgccttcggcgtgatcagactcctcgaggaggccggtgtccgggttcccgacgacgtcatcgtcaccggattcgacggaatcctcgccggacggctgatggaaccgcagctgacgaccgtccgccagcccatggaggacatggggcgcgaggcggctcgcatgctgctttccaggaacggggagccttgggagaaggctgaaagacgagtactcccggttcgcctcattgtgcgcggcagctgcggatgcaatcaaaaaatctaagcgcataaatcatatgggcgtgtcgccttgacttcctcaaatctaagcgcttaaattgtaatatcaatctaagcggttagattgatatgaatcaaaggagatttcaatgaggaagccatttttcaaagcggtcgtggccggcatggccagtgtggcgatgattgccggtatgtccgcgtgcggacggtccgcgaacaacgcggattccgattccgatgcggtcaagaccatcgattcaagcaaggccaccggcgacctgaccatctgggccatgggcaacgagggcgacctgctgggtgatttcgtcaagggattcgaaaaggagaaccccgacgtcaaggtcaaggtcaccgcgatcccatggtcctcagcgcacgacaaactccagaccgccatcgccgcgggcaacggtcccgaccttgcgcagatgggcaccacctggatggccgatttctccaactcgttctccaccgtgcctgacaacctcgacatgtccgacttctccgacgggtctagggctactggccaggttgacgggaaacagctcggcgtgccttggtacatcgacaccagagtgctgtactaccgtaccgacatcgccgagatggctggttggaacaaagctccgaagacttggaatgagcttaagcagatggctaaggacatgcagaaggtcgatggggtcaaatacggcatgaacctcaacccatctggcactgacgcgttcctcggaactttgccgttctcctactcggccggggcgtccttgactaacaaggaacagacgaaatggactttcgaagatactggcataaagaagggactgaactttaccaccagtctctacaaggacggcgtcgcgaacgtcaacgccgacgtaagctccggtgccgacatcgcgaacttcgtgtccggtgacactccgatgatgctgcaggggccgaccgccgtcagccagatcaacgaattgggcggcgacggattcgaatccaagtacgccaccgtcgtcctgccgtcgatggacgaatcctcggggcccgccacgtccttcgtcggaggcagcgaccttgtgacgttcaaggattccaagaacaagcagtccgcgtggaagttcatccagtgggtcagcaaacccgaggtgcaggccgaatggtacaagaagtcctccgatctgcccgcttcccagaaggcatgggacgatgacgcgctctccggcaacgacaagctttcggcattcggcgaccagctgaagaacaccatggctccgccggcgctgtccacctgggcgcaggtgtcctccgctgccgaccgcatcctcgagcagataaacaagggacaggtctccgttgacgagggcttgaagaacctgcagtccgaagccgactccatcggaacgggaaactgatcccatgagcctcgggacaagaaagacaaagacggagggctcgggcaacgtcctccgccgccgccgtacgattctcgcatggggatttgccttgcctttcgcagtcgtgttctgcgtattcatgctgattcccctcctgtcctcgatggcgatgtccttcaccgacatcacctccaaggaccttcgcaccccgttcaacgtcaacttcgtcggactggaccagtacatcaccctgttccacgaccaccgtttcctgcacgcgttgggcgtcaccggaatcttcgtgcttgtcggcctgccgatcaccatggcgatcgccctcgcattcgcggtggccctcaacaagggatccaagcacctcaacgcgttcttcagggccgtgttctacgcgccggttgtcgccagcgtggtcgcggtctccgtcgtgtggaggtacatcctccagaaggacggcctgctcaactcgctcctggccgtcttcggtatcgccgggccggactggctgcacgacacccgctacgccctgcccgcgctgatggccatgaccatctggcgcaacatgggaacgctgatgatcatcttcctcgccggcctgcaggccatccccgaggaattgaaggaggctgcggccatcgacggcgcaggcaaatggcgcacctttcgtagcatcacgctcccgctgctcaagcccacgctgctgctgggtgccgtgcttctttccgtcgcctacctgcagttcttcgaggaatccttcgtgatgacccagggaggaccgctcgattcgacgctctccgccgcgtactacgtgtaccagaagttcggtttcggacagtacggcatcgcctccgcagccagctgggtgctgttcatcatcatcgcgctggtcagcgtgctccagttccgcattctcaaggaggattgagatgacagccacgacagtcgcggcctcgaggccgcaaagcaacaagcagtcgctctggcgccgattcgtcaaggggcgtggactctcctactgcgtcctcgcggtgatcggagtcttctggatcttcccgttcctgtggatggcgctgggctcgttgaagacccagagggagatcctcgccaaaccgccgaagctcctacccgagcacgcctcgctcgcaaacttcgcgaaatggttcggggagctgaacttcggcacctacttcaccaacagcatggtcgtcgccgtgatcaccgtcctcgggaacatggtgttctgctccatggtcggatacgccctggcgaagatggacttcgccggcaagaacatcttgttcggcgccgtcatggtgacgctcatggttccgagcgtggccacgttcgtccccctgttcgtgatcatctcgaacatgggactcgcgaactcctacgcggcgctcatcctgccgttcctgtgccagcccatcggagtcttcctgatgagacagttcatctccggaatccccgacgcgctgatggaggccgcgagggtcgacggcgccggtgagctgcgcatattcttccagatcgtcctgccccagtgcgggccgccgctggcgacgctgtccatcctcacgttcctgtcctcctggaacaacttcctgtggccgttggtcgcggcccagaccgaggagaagtacacgctgcccgtggcactgtccctctactccaccggccagaacgccacgaactacagcgtcctgctcgccggagcggtactggtggtcaccccgatcctcctcctgttcgtattcctgcagcgctacttcatccagggcgtcgccggaacgggcatcaaatagaaagacatgtcatgaaagaacaatacgagttcccgccggaattcatctggggcgcgtccacggccgcgcaccagattgaagggaacaacgtcgcgagcgactggtgggccagggagcatgccgaacgcacggatctcagcgaaccgtcgggagacgcggccgacagctaccaccgctacggcgaggacatcagaatgctcgccgacgccggattgggcatgtaccgcttctccatcgaatgggcccgcatcgagcccgcggagggctgcttctccaaagcgcagctgctgcactaccgccaaatgatcgacgcgtgccacgagaacggcgtcgagcccatggtcacgctgaaccacatgacactgccgctgtggctcgccaccaagggcggatggctcaacgccgatgccgtcgactacttcgcccggtacgtgcggtacgtgatgccgatcctccacgacgtcacctgggtctgcaccattaacgagccgaacatggtcgcgctgacccgtggcggaaccgaaggcagcgacttcgtggccgcctcgctgcccgcgcccgatccggacatctccgccacgctcgtcaaagcgcacaggaaagccagggaaatactatccgagaacccgcgtatcaagtccgggtggaccatcgcctgccaggcgttccacgccatgcccggatgcgaacgggagatggaggaataccagtacccgcgcgaggactacttcaccgaggccgcggccggggatgacttcattggggtgcaggcctatctgaggaccttcatcggcaaggatggccccgtgccagtccccgaggacgcggaacgcaccctcaccggctgggagtacttcccgccggcgctgggcatcgccatccgccatacttggaacgtcgccaaacgcacgccgataatcgtcaccgaaaatggcatcgccactgccgatgaccgccggagaatcgattacaccttcgacgccatagccggcatgcacgacgcgatggacgacggtatcgacgtgaggggatacctccactggtccctgctcgacaactacgagtggggctcgttcgctccgacgttcggcctggcctcctgggacagggacaccttcgaacgccatccgaagccatccttggattggctaggatcaatcgcgagaaagggggtcatggccagatagaagccgtttcctctccatccattacatgaaagggcgcacgttttgaaacgtgcgccctttcgtttgatttggcggattcaatagaaaacgggtatagccctcgatctggaagaacatgtccgtccggcggccgatgctcgcggctggcatacgccgaaaacgcagcactgctgttcccgtaaggtcgcatctcccttaacgtgtcaagcgtctcctgatacgttgctgtatcgacgccggtttcgtcattccttgcctttcccgagtggccctgtcggccaagtgcgtttcaactcgagaaaatagccgggttatggcggaccggcggggaggggcgtgctggacgcctgcgcgaactcggtctgacccgattcgctggatgtctagccacaatggaatgacttgatgcgtattccaagccggacggaggatggaatgcatctccacgcggatggcggccgaattcttaagtgtttgcaccagcgttacataaaacgcttagcgaaccgaaatgatgtccggcggaacgtgtccttgcgcgtcttggaaacggatatccgtattcgttcgaaggtttctcgaccaggggatgggctttgctttttcagattgacagtccgtaatcatttcggatatgtcggaatttagacaggaatcccttggatgcgccgcgggcgataaatacgggccgtggtgcgggaaggacctcgaacatgacgattcgaagaacacggtcgcctatttcggcgagcgtgccgcttcccaccctcggcgaggtcacggccggcaccgcgagcctcagccggtaggagctacccacaggatcattcgtgttggtcggagttctctcgttcggcgacggaattgtatccgtggggtacttcgtcgttgtttctacggacggatccgagggtgtccatccaccagtgttcgcggtcgatgatctctttgggtgacttgttcatgtcgaagatctccaggatcgagtactggaagttcttctcgatgtatccggcgccgaggtttctgagctgcttgtttcccccggagtggtctccggacgcgtattccttccaacgcgacagcagaccgtgcgaggctcctttccgtgagtaggcggaccccacgtaatgccatcccgttcgtctatcggtctgcagatagaccgcctggacgctgccgagggccgcccgccattcctcgttgttcacggccgccacgagctgccggtgcgtcaaccgaacgttctcgtatccagagaacggtaacgcggatacgggggattgagcgattttctcaagggtcatcgtcttgagaaaatcccggcgtcgttcttcattgttggacaggttaaagacgactcccgtgtaacccggatctcttttgtagtacactaccgccctggcctttagcgaggcgtattccgggatctcattgtaacggtatagaatcttgccgtcgttctccgtgtactcgtcgaggacgtcgtaggctccgacgaacagccattgtgtggggtggggattctctggcttgagctgaatgaactggaggactttacgtgtgtgaatctgcgctgttgccttatccttatctggccatttcttcgtgaaaatccacttcatcaggtcatcataggaggaatagtaggcgtcgggaagatcactccatttgccccattccgggttgctgccattcagacgaatgctatagccggctaggtcctcttcgtcgagtcccaatagttcgaggaaccggatcggttccgtatcctggattccgtcttcgatgcgcgtcattgccatcgcctttccattcccgattgccgccggacggtatgattttccggtttgtaagacagtctagcgtcttgatgatgaggattatggaaccggctggctccttgccaggtggacgtggagtccgacgaagggttgcgggtccggctgtcttcgtggaacgacgacggtttgacgtggccgggtgatgggaatgagaccggtcgcgcggtgtctgggcgttatctgttgtcatgtcgccatgtcgcgaaatcggttcgttgttggatgagtgtggtcctgtgaattcttaaatgttgtaccgaatgcaacatgcaacacttggtgaatccgactaggaccatcggaatgcgtcttggaccatttcgaaaacggatgtttccggaacggaggacggaccggccgccatgtccacgacactccggcgattggtgttccgaaacccgtcccgtaatcaatgttccggaactcaatgccattgacgggtagtggtatggtcggacgcatggcgagcatgatttacggatacgcgagggtcagcaccaacgaccagaccaccaatctgcagaaggacgcactcgagaaagccggctgcgaccggatcttcaccgaagtggcctccggcgcgaaggcccaccgtcccgagctcgaccatatgctcgacctcctgcgcgagggcgatactgtcgtagtgtggaagctggatcggctcggcaggagcatgcagaacctagttgacctgatgaccacgttcgacgagaggggagtacagttcagatccctgaccgagtcgatcgacacgaacactcctggaggcacgctcgtgttcaacatcttcggatcattggcacagttcgaacgcgacctgattcgcgagcgaacgcgcgccggacttgaggccgctcgcgcccgcggaaggaagggtggacggcccgccaaactcgacgagaagcaggtcagggaggtgcggcgcctatacgaatccaggacggtgacggtagaccagatcgccacgatgatgggtgtgggacggtccacaatttatcggtgcctgaatacgtcggataagtaattttgattcggtatgtgatgtgacctgattctaaagtcgacgatgtatgcttttattgtgtcaataagaggacagattgacctataaataaccgggagtacgagatggtcgacactgattacggacagcagattaaggataaacgtgagcggttgcatatgactcagaaggaacttgctgacgcaataggcctttctaagaacggtgaccgtactattcgccgctgggagaatggcgaatcaaaaccgactgaaccagaattcagacagatcatggaattccctgagaatgcgccatttaagaatcctgacgaggcggactataggagtatcgacttatttgccggaattggcggtactaggcttgggttccaagagacaggcagagtgaaggttgtcttctcatctgagattaataaattcagtgctaaaacgtatcatgccaattttggagaatatccagctggcgatattacgcagattgctgcgagcgatattcctgaccacgacattctcgttggcggttttccctgtcaagccttctctcaggcaggccttaagaaaggattcgaggacgctcgaggaactatgttttttgagattgctcgaattctaaaggaaaagaggcccaaggcgttcttgctggagaatgtgaagaaccttgtcggtcatgaccatgggaacacgttcagaactatcaagtccattcttgagggcctcggctatgcggtaaacgcaaaggttctagcggcgaaggacttcggagtgccgcagaacagggagcgaatctatatcgtcggtttcgacaaagaacaggtgccaaactgggccgacttcaaataccctgaaccgccttgtattcctacaaggctcggtgacatccttgaaaaaaacgtagatgacaagtatacaatctcggacgcgttgtgggcgggtcatcaacgtcgcaagcaggagaataagaaggcaggtaagggcttcggctacggcttatttgatgaggacagtccctatgcgaacaccattagtgcacgctactacaaagatggttcagagattctcattaggcaggatgggaagaacccacgtaaactgacaccgcgtgaggcatctagactgcagggtttccctccagagttcatcatccccgtttcagatacacaagcatacaaacagtttggcaactccgttgctgtacctgtcgtgaatgccgtagcaaagcaactactcaaggtgcttgatgctagcaaggaatgatgcggcttggcggggggataacggaatatcccgttatccccccgccaatgactataggcactcggccaagcgagccttgtaataatcgcagacgataggatggttcttgtgcttctctatctgtttgcgcagaaactgctctacaacgcttcgttgcttgtcggtataggagtatccctcccatttttcggtaatgttggacgcttcagtgatcatttcttcgaaggtcatgactcgtggattggtgtagtgcgaacggttctctttcgtggtcacgatagttatgttgctttcatatagtacgttcaaggtgttttcggttatgtcgctgtcgagcgtcgctaagtacattcgaggtgcgccggtcctagttacttcttcaggaacctcttgccagcgttcacgaagtgtagtttttgcggaaatcagcacggtacgttgcttatctatcgagtattgaattgcccccggtgtcacaaaatccaccagtttgccaaggtgatgctgggcaaaaaattgcttgccaacgttgccttgggagtcggtcggaatacttgccccaattagcatcatctctataatggcttcgaactctttaccagctcgtgacctgcgcgactgagtgttggagagagtcaattcgtagatgtgctgcgggtagtcagacacgaacttcttgatcgcatcgacagcttccattcctttgaaagacatgggatcgataagggatgatagtgctttgacagtgaatttcttttcgcatacttggaaatccttccaacattgcgtacgcatttgacctacgaagtcactggcgtgttccttgaagtatgactttcccatcttgtcgaatccgagttccatgaacgaattgtaggcgatgtcgaaaggagatggaaagtggtctttgcgcatctctttaattgtctctttgtaatcgtcagcggtaatcatcgagtctcctcgcccgtattgagattcacagattcctcaattttagcaatctttgttgtggaaattggagaaattagctctctggagaaagagtaactgcctttctcactaagtaaatcgcaccaaaactgggcaatctgattggtgctcgtattgtttacgtacaaggagagcgctttctttatatcgagcgcaaaagcaggtatcgctctccaatctgggagacgttcaatgtatgcgtcggcaatgaaatggaatttgacagtgtcttcatttttgggtgcctctgggaaaatgaaagcgttagtcgttcctttgatacgtgaatacttgtcgttgccttttcttttgcaaagaactgatcggagagtatcctcgtaataatactgtttgatgatgtctggaccgccgggcatgttgtgccgatagtcatagtatttggcatctaggatatataatgtatcgttcgttacgaacagaacatctggacgttgacttgtgtctggcttgagattcggtagcttccaccgcggttgcggaagtaggttgtcgtaaatgtactgatcgtcatggaaaatatgcttgcaggtggcttcccagacgcgccaataggtttttgttccgaagaacgatacgtcgtttttagaatcattccggatggtcgaactgatatattgcatcagaaggtcaataacatgcatttctcggtcagagaagacagtccatttttcccttgatagaaatgtcaatgccgtctcctgcgtgcatgggagccatccgcgttcgtgctgtcggaaattgacgtgatatcgctctgggtcaatcaaccagccccaacgtttgtagcaatcttgtacacaagctttgtgcaatatggttagaggcgagtcgtcgtcgtcgattctacgtgcgatgaccggcaatggatagaatacggaggattccgtgaatatgggatcgcttctttggatggttctattccatgcgatacgtcctgattggttttgggaatattgggttaggaaacgcctgattgggccgttgacttcgtaatcttgaattaactccatggcggtgagaagcggagtacttgttcgcctatctgccgaatataggaagcctgcgtcttcaggagaatgcggataatcgtctctgaaacgaataagtgactttgttacaagtgatattaactgttcagtatcttcgtcagaaatattggagggcgaagcgaacagttttttagggaaacaaaatatgacacaatcggcgaaggctactatgccgacgaaggaaatggaaatccacctttccttagaggaaactaaggaaggttggacctttcggactctgtccagaagattccatgtttcttcatcagtgtagtggcgtccgtcaatgagcgtgtagaggttcatgcgtcttgtccgtcgttttcctcaaattcgttcgtgtcaggttcactgtggtcttctggctgagcttcctcagatagcgtctttttaagcgactcctcgatgtccaacacatccttggtttgataattggcaaacagatacgataacgagtccacgttcgcatcaaaaaactcatttcgatcatttcgtagcacatcatcccaaaggtaaataagcaccttcttgaaagcgcctcgaataccagcctcgctgcgcaacgcttcctcagggaggaagaactgcccgataagacgatcctctggaacaggtgggcgtttttcccgaagcttattgttcacggaggatagaatctgaagcagactatgcgtttcgttgttatagatgatctgagacgttttgagtttttcgttcagtgacagggagatagtctcatattcaaaatcccatctcctcttgaaggcggaatccatgaacatgactccctgatcagcattgttcatcgtagcccatatgaataagtttcctggaatgcggagttcattgggagatgagaccccttcaagattgagtaaatgctggcttagatagttggggctgcggacgttttcttggagaccgaacggaaagattttcgtatgttcagtcttgaggaacgagagcgtgcggtggagttgtatttcaccacgccgatgacgacggcccaggtggtggagcatctgggttatccgaccaggcagtgtctggagcgttggctggcgatggattcccggtatgctggccatatggccaaacccatcatcccactggagaccaggcgaagggcagtcgagctggtgctgggcggcatgcagcagaagcaggccgccaaacagctcggcgtgagcgtcggcgcggtgcatggctgggtcagggcgtaccgcaagggcggcatggccgcgttacagcccaaaaacaggaactccgcgcagggcaataagcccgctgactcccgtcgccggccgtccgcagccgatgatgatgacgcggaggctttgcgccgcagggtcgaggaactggagctggagaacgcgttgatgcgggaggtggtggaggtcgtaaaaaaagaccccggcgccgacctgcggcgcctgtcgaacagggagaagacgctgctgatcgaccggttgaggccggcgtattcgctcaggtcgatgacatgcttgctcgccatcgcgcccagcagctaccactaccaccacgcccggctcggcgttgacaagtacgccggactcagggcagaggtggccggggcgttcgccgattccaagggcaggtacgggtaccgcaggatcaaggcggtgctcaagaccggcgtatcggagaaggtggtccgcaggatcatggcggaggaagggctcgtggcgcatgtgcccaagcgacgcaggtatagttcctacgagggcgagacgacgccggctcccgccaatctcgtcgaccgggacttcacggccgagcgtccgaacgagaagtggctgacggacatcagcgagatcaaggccagggacgggaaggtgtacctttcgccgatgatcgactgcttcgatggcaagatcgtcgcatacaccgccggcttcagccccaacgcggagctggccaaccggatgctggagaaagcggcctcgacgctgccggggaacgcgcgtcccctggtgcattccgaccgtggatgccattaccggtggcccggatggctcgggctcatggaacgcttcgggttgacgcggtcaatgagcgcgaagggctgttccccggacaacgccgccgcggaggggttcttcggtcgaatgaagacggaatccgtctatcccgagcattgggagaaacgcacacgcgacgaggtgctcatcctgatcgacgattacatccgctggtacaaccacgagcgcatcaaacggtcgctcggttggatgagtccggtacaataccgtcaaagccaaggaatggctgcgtgaccatctccaagaaaacgtccgcagcccatttgtaatcttaaaatgagcaaatatttctttttcgattattccgatttctgagggttgataatttccagcccttgtttgttgggagcaagttcaagtatggcgtgatcggaattatccagtactggtaatgctgccggttgtgaatgtaaggcacaagtcagcttaaagaagctagaacgcaaggcactcgttttctttccactcatttcgacggggaattttgccgctcctaccggaagaaaactaaggctttccaaggtgtgaacaagttgttcctgtcgttgggcaatagaatccaactcgcttcgcaaaatagtctctacatgagcgagtgaacgactcgcattgttctgttccgcggcaactttttccagaaggatgattctggcgcgcagggcaaacgtctggtaggtctgttctactgcacactcgaaatcgtatagagaattttcgctggagttagtgagctctttcaataaatccgagctattaacatgcgactgcttggaatagtgttccgcaatgtccgaccacttatcaagacgttctccataaagcacgaagagttcttctaacttgccaaaagcataaggtgccgtggacatgcttggaatacacgcttgatctagcagatatcccgtcacttttcgcgcttgttgagcggcgttgataaggatggctcgatcttctgcgtccctgcgttcttgcagagacttgactgatttatagatagcgtcaagttttttgtttgtttgataagaggacaacatgtcacccgccatggccaaggctacagtagcgatcattggtcctgccgccacggcagctccggttgcgggaattagtcgcacatgactcgcaatggcggaggacccagtggcacgcgtgatcccccggaagcctccacccacggcagggactaaatccttcacagtgaacccagccggtagtatcactcgatacagtccactatctgaagcaacgtggcctatttgctgagtagccagactcactgctttggcaaatgagcctgcagactgggcgacaaggttggtgccgtttgaagattgatgttgtgttgttgaagatggctggtactgaataagcatggcatcctgatttaaaagcatgagcagcatggtttccgtatccatctgaccactcagttcacgactgattggtttcagcggcacgacgattgcatcttccataatcagggtccttgtcagatctgcttttcgatgatttgatttttcaatcttaagtatatggggaatgatattgacgttgaggttgtcaagtatttttcgagcgagcaaattcaaagattagcgtactaagtgttgtctcataaacggtcgcatacttaaatacttgtattgattcatgcggctagtcagtaggctctgggcttttcaacaatggtggcgcagaaagtaacgctgccatccttgttctcagtggggagactaaactgccagattgaaccaagctgagattcgaggtcgttgaggagcatgtcgattcggtcaacgcctccacggatgcttttgacggtaatacgcaattcgggaccgttcttctgccgttctttagtaatgtcaagacgactagatgggtctgccacgcgtactgcgcgccacgcattccagccttccttgcgggcttcgttctctttctcctgcgccttctccaaggcacgttccccatgtctgacatcccagtcgacagctttgcgcatggtaagcaacaagttggtgccgcggttctgacgcactgcggccagacccttgcggtcaagactccgtgcggctcgtcggcgagcctctttttccgctgcagaaagctcacgtggcgcgaccgttaccatgccggtccgctccagttcatccaacaactcccgctcgacctttccaagacctctgctcatggcgttctccgtctctaagtgttgtacatttattatctacaacatatagaaatatgtcaataagtgtcgcacggagaagtgaagcaacatttatagcaatgaaaacgataaatggaatagacgggaataaaagagcatgacaacaattgaacaatcttcgcaagtctattagtcaggattgttcgggaacatctaagaacaattgccggcatactgaaatcgacgtaaagaatcagacgccgataatttttcttatgtcagattcaaagcacgcaacagccttcatcgccgttcaagcaacaggattatacgccgtttcgcggtcgaatgtcctatgcgtcgaccgcgaaacggcgtatggaatcacttcttagcgacaatcgctacatatccgccggcatagtagccatcgataggctcctccaccatgcggttcgtgtaaacgggatgagcgacaagcgtctgcttgtaacgtaggtcatgcaatccaagttcatcggtcagaaccttacttttctcttcggttgtatgccagagagcggcatggacgagttccaacgggtatgggcatttaggcgccgtatcaacggtttccggggaatcgtaggtgtcaagttttcctgccagtagatagagcagaccataggcgctttctttcggaacatcgagcaggacgaggctgccacctttcttcaacgccttgagcacgtttccgtaagcaactttcaaatcgggaatatagcttgaagatccattgaagtagatcacgtcatatgattcctctggtagatccgccgtctctgcggtggctatctgcacatccatgccacgtttgcgcgcaatggcagccatatcctcagacggttcaatgccctcggaaacagtgatgccatactcgtcttgcagtgatttctcgaacaaaccggatccgcaaccaactgatagcatccgtcccccgtcggttaaatccaacgaagccttgagcagcttcaactcgctgaggaaaacgttctcgttagtcatgaaccagctgtcatagtcagcagcgtatccatcgaattttgcatgtgccatttatcggcctccctttcatcattgttagctaggagaccggtaaacacggtcttgcttccctacgcgagcattaactcacaggttcaaagggtcccaaaggtctcagcggaatcgctcccctagcgactcctagtatagccatacggggacatacttcgttccgttgtccagaatctatcagggataacatctgaatgtgtaagcgttccgcggcatattcgcgttaaccaaatttactgcatgccatcagaaatacgcaaaaatagcattagccgcaatttttaggtcgatggtcaaataccataactgatcggccgtaagaggcaccttccgtttttggaaggagagaaacaggtttagcgcaagatgctaaaccatcatttatcactatatatagttattatatagaatttatataaaatcaatatagttgatatattgcttttatatagtcctttttgcgtggaccctgcactggaaaatcattgccgcctatatcgtcactcccctgtgtcaaaaaacgtctgccactgcttctataaataaacgtcgcaatgataaggggcagcactggggatagctatcctcgtctatcacgccatgccacgccgctttccatccagtctcaacggagtcttccttagggaccactcccccgcccactatcagtttaaagtagattccattccagcaccgcactacacgtcagacacaaatcatggtggttatccaacgccatgttcaattaccaacgatggatccgaactaatcccgtctgcctcatttgcgttagcgtactacatgacacgatatggttccttattctccgatgagacgtcatccgtttgcgcatttttcatcaagagacaacaatgcttaaatccacattgatatcccagctaagcgtatcgcataaaagagctaaaatatataggtcctatatgaaattcatataggacctatataatacttatataaaaatcattgattggcgtcagtcatcctgcttaagtctcagtcgaactccatccacgatgagacgcgaggcgctggtgccaagacgcgcagcgcgttccttaagttccttttttaggtcgacagggatcatgaaactcatcatggtcttatcattgccttcgctgtcgcctttgtgcttggtgtcctgcaggtccataagtctgccggtcggctcatccggcctgttcgccctgattggtttaatcgccatcagttggttgcctcctcgagttccttgtagacgtcttcgtagccatataggttgctgccgaatggctgaccgtacacgttgcccaagtcggccctcttaggaatcacagcgtcgaacacgctgctgtccttctccctgaagtattcctgcgcgcttttgagcgcgatggtgtgcggctcggcacggactatcaacactgcatattgcttgccgacttcctcgagattgtcagccactgccgaagtctgctgcaggtcaatgctgttgggactggtcggtacgatcacgaagtccgagacggaggtcgcttcgtcggtgatcttgcctgtcggcggggtgtcaatgatgacgaggcgcggatcgtcgggcttcagtctgcgtagggtggcgatgttggcgctttccaccgagaacggcagcggcttgccgttctgctctgcattccaagcccataggctcgcactggattgctcatcggcatcgagcaccacgacttcgtgccctttccgtgcggcaagggtggcgagggcgatggccgtggtggtcttgccaacacctcccttgatattcactacagccacaatcatgatgacctccatagttttatataatcattatataatatatcataaatacttatataagtcttatattaatcttatatttcgctatagaccttcagacaatcctttaagcgttgtatcgcaaatgcgagcaacacttatagtgccgtgtgaatgccatccaatcgttcggtaatacttatgtgccgtagggtcacactagattcagcggacatcagcaaccgtgtcttaaattaagaagaggagcaagtcctggcattttgcggatcagtttcccgactcggccataggagacctcatcggacgcgccaaacttgcgcacctctcccctaggcttttttatgattcatgtcaattcttatagacggaagtcaaacaaaagcattaatgaatcactgccatcagcggatacgttccaatgaatgaaaacgggaaatcgttccctgattacttcgcatgagaccagtatttcaatagatgaatatataattcttatttaatgcttatataaggattatataagtctttattagattttatatagtttaatcggataatctgatcaaatccttattcatgatcgagtgccaggaatcgattcgctgtcaaatcaacaatctgtgcgagcgtcccgtaccccgaacgtcagtgttatctgttttatctattccgctgttgcagtcaatgaagctttcaacttatattcaatgcgatgacaggtggtctattctggcactcgacggctgtgacaataattcgaccacgttgccgtccatatcgtttctatccgtgggagcatttccgattccgtaacgttcgaacaatctgtcgaatacgcgcagtccctcgcatagcgcttggtcatagtcatccgggttctcgtttgcgcgtcgtacgtttatggcgatgtggaatgcttcgttgatcagtttttccatatcatacgtggataaattcgcaatctgccgttccatgccatcggaaaggaacggtggtctgttttccatgcttgctcgccactcctggacggcaagggcttcgcttctctcatcatgaatccaagcgtttcgcaattcccgtagtctcatgtccgaaccgatgtcgattgcgttgaatcgttcagtccaaccgtccgcactgcgccaggtgatttggtatccgaccacttggcttggtgatttgaatgagtccttggacactcctttacgtagatgcgggtcgatgttgaatccttcgcgtcggacgcggcggatgaattcgtcttcgctccttgacgctttcgcgcatgcctccacgatgagtcccacgtgttgtttcggcatcgtttcggcagctactgcggcgatcctgcgggtgtgttcgtccctgctgagcgtcggccaggggagtgccccatcatattcgttccgagctttccattccgcccaacgacgccattcggcataccggtatctgacgtggtttgccgtggtcgaccggtcgagttcaatcagttcgggatgttcccgttccatctcgcggcatgatcgctgcgcattcttcatgtcgttgaatgtgttgagccatccgtcgtccattgcgagctgcaccatcacatgcacgtggtcgttgccgttccggctcagtccatggcgtaccgcgagccaagtcaccttggacatgtcgccggcaggcaggatgttcatacgttccagatagtcgcggacgatcgagtcccattgctcgtcggtgagaataccttgacctgccttgatggacaacgaacaatgccagatacgatccttgccatgctctttgtcgggattatgtctgcctcggcggtcgcgggggaatgggtcgtccctaagttccctgtcatggtatcgtcggtcgaaccgtgttccgattctcgcgtacgcctcgatgaggcgcccgtcgaaatcgaatgagtcgagcagatcagtactgcaggcgatgaggtgctggttggcgtgctcgttatggcgacctttgccgaacaggtacttcaccaatcctgcaggattcgaaccgcggctaatctttggaatcatgcttctcatcgtccggcatgttaattcccttcatggtgcacaacgtctacaaatttccaaaattgagtggcggcatccccgcaaggtttcttcttatattgaaattcatcatccatcgaccaagtaggggagtggctgctcctacctggtaaccgaggcgacaatgaactgtgtcgacaacacttttcagaacaaacacaacagatatcaaaatgcagaaaagccggtagagattgggttatgaaaatccctaccggccggatacaaaataaacaacgagaaaattcactggacgagagtgaagattccagttcattatatcatttggtatcagtccaacgaaaaccattgatgatttcgcgtacctctgcaagcagcaacgcgcagttccgcactgctatgacggccgaatattcgtctctttcatcggcggccatctcccgattcgtattgcgcgctatctggttgatgttgtgcccgatatgccaaatctcagtcctgattgcttcaagttctttcacgaccggttcggtttcgtactttctccggaccgattcgagattggcagcgacttcgcaagactcaatcagataacgtgagacactgatacctctcgtttccgcggccgaacgaatctcatcgaactcttggtcagatacacgcacgaaaatccgtctgctacgggtgatccctgtcctatattgttggtttttagccgtcaatgacccatcatctccttccaccacttcgtccggcaatcttgcaaagcaccgttccttcttctaaagcctgcggcactcgggtccatgtccaccgccgtaggcgcagtggggaatggtttcggtttgtacgcacaaaccgtataacttgctaccccacggtgacgctttccgagtccggcttcgtgccggccttccgcctatcccgttgattaggattgcgcctgtctccatgccatcctgcgtcatcggtgaacggaagcgtcctcttccagctcatggagcatctgcctagcgtcggcgtctactgacacgttcgtaatatcttccggtaacggccacccgagacgctcggcgaggtcgaattgctccgcgaggatctccgacacgtatgtggcgcgggtgacgcccctcatcatcgcggcacgggtaatcacctcgtattcggcatccgataaacggataccatggcgcgtgcccgcaggtctcaactcaccaccgactgttccggagggaaatggtcgacgcatcatcccatccgccccatcaagacttcccggataaagacacgatgacgcttgaggaagaagcaaccagcgcaacacgacggcgacctgatagccatgcgcccggctctcatctctcaaccgctggtactggtggtcacagatccacgccatgatgcgataggggaatgccttgtatcccatttcgtttttccctttccttttgacgaaactattcgccagtccatggggaagagcccgtcccgtcgtctcacggaagagcgagccttccgacgaggcaccggaacaatgtcgttaccggacaccacatcaatccaaccgcacgccgataggtgtgacggtgcacggtgtctaccagtcctcgtcggtggacggcatccgccgaggaagacatatgccgatggaggacacgggcgtcggaaggatttgaaaaacataagtgtatactctataatagagttaacactttgaaaaggagcggacatgagcctcggatacggaagggtcgagcggcagctgctcgacgagctcaccgcagacgcagccagaccgcacgacgtcggcgtgctggtcaaaaggccaggcatggcgcagagcgaggtgtgcagccgccgcagggccgcgaagcgcctcgaggagaagggcatgtgcgagacgctccgcgtcgtctacgccggacgccgccgcctggtctgcatgacaccggagaaggcgctggaatacaagcggcgccaggccgtggaccggcgggccgacaacaaactcgaacggctcagactggacgccgagttctccaggctcgacctggacaccgagacgtggaagcccatcgacgaggaaggggaggaatggtgatcatcactgtcgtgaacgtcgatggaggtgcgactaggaccacggcatggaaccgaccgcagaacgagacgatgggcagaaagccgaaacgtcgcaccaaaagcgtaaaacactaaaacaatctaagtgtatgcttaataggtaaactatacactgtcgccgggctgagcattcttgccacgtgagtctcgcgaacgccggccccacgaacggcaaccgaagaaaagtctgcggcgtgggagaccacgccgcagaccgggaccgctagccgcggttatggctggccatcgcgtacgcgcctatggcgagcaccgtgatgtcggccgcggtggtgtccaccttggccgcgagggcgacgacaagcaccgccatcaaccagaccatgggaccgccgcgcggcccctcttcattcatgcgcatgatctgcgcctttccggtaaagccgcgccgcgtcaggcgcggcaacgtcgaccggctgtcgccgggcggtcgttccagcccctgcaaaaaggccttctcgacataaacgatgatatcggttagaatggaaatcgccggtcgaggcactgcaaacttcctcccacattcaaggcggtgcgcaacgacttcttcgggaggatggccggaaccggtggggtggtttcattcccatcccctggcaaagcgtcgggccggtgtcttcggacaccggccctttgcattctttggccataccggaaataagagtttatcttacaataaagtatacttttaagcgctggcgaacccatccatgcaacacctgcatcttgctggaatgtcactcatcggttcgagcatcgttccgttgtcctacgctccatcagcttatggagcattcgcctagcttcgtcgtccacggattcatttgtgatgtctttcggtaatggccatccgaggcaatcggcggctctgatttgttcctcgaggattcgtgtcacatacgtggagcggatgatacctttattcatcgcggcgcgggtaatcagttcgtattcggcatccgtcagatagatgttccgataaggcctcgcatctttttgcccactcgtcgatccggacggcaacggaagcctcatcagcatatcagcgttgtcgagacgtcctggatgcaagccgtcgacgctttgtggaagcaggagccaccgttgcacgactgcgacctgatagccgtgagccaagctctcttctttcagtcttgcgtattgttcgttgtcaatccgtgccatgattcggtacgggaagttcttgcgtcccacgttaatctcgcctttcgcttgtttgttcagtgacggtctggcatccggaaaggatgtctccgcctggaccggaagaaggttcttcctcttttggattcagcggtcgatacaaatcgaatatgacatcatgcttccttccggataccaactacgcatgattcccattgccacttctggcgcaaggtattcggtgtagcccataactccgtggaccggcctcactatccgcgtccatactgtctttagccacctcaaatccggatacgaaaaggccgcgcccagtaggtgcggccggaagacgacaggcgacgtcacagttcaacgaatccgagcaatggcgcgaataccgccgccacaccaaacatggccacgatcatgaagacgacaccgagcacgtatgcggcaacgatgatggtggttcgtccagccaggctcccgttcaaatcagccgtcggaccgttcatgcgtttcgcaacgattgtgcacacgcctgacatgacgaccgccatgaggacgagcgtgacttgcaatccgccgttcagtcgtatggtccaatcccatagtccggtgagcatgccggcaacgttttccagaagacgctccattctctgatccttcccattgttggctattgatgaatggctcttcaatcctgatgcggttcccaccagccagcggcgcacggtgtctacacattctccgaacgctttttgtagacaccgtgcgccgtcgagcgcggcgtatcgattcatccttgcagggtatccggttcatcgaaggtaaggagttgaatttgtcccacagcaacagggcccgcgacacaagacgcaacatttcgaaggcgattcgcgaatcccagcagtctcggatggacgcgctcgatgcgttagcccaaggattgactgaaatcagtgccgcgcgcatacggctcaaggagcttgagacgcatgtggaagacttgcgcgtccaggcgaagaatgcgggcaacactgccactgacattcgggccgtggaacgtattgttaatgaactcgctctgaaacggtccgaagcgccggagaacgattccaaggacatggaagagccatccgggatgggggatgagtgatgaccgggagggggaaagaaccgcatccgatgcctcgacccttccgctggctggccatgttcctcgcgtttgtgttcgtcatatctctcggcgtggctgccacctatcgaatgaaacgaaccggcaacgatggagatcttgggagagtcccgtccaaatctgcgcagaaggaggacgtcagcccgcacggtgaatatgccggtttgaaggccgcgggagtccccgttcccggtgaatggtcgcgtcagtcgctcttagccgtcgacgggacgcagaacagtgacggaaacggtgccgcgctatcacctgtcggaggggatgggggaccggtcaacgtcgcgttggagacagtcaacaggattctcaacccaacgcaatccgacgtggaatgggaccggacgatgagagacctcttccaaccggatatggccggattgacgcatggcccgtcgaacatggctcgttactggtggcagcaacgccgcttccaaccggaccgcctctgcacgggaatcgcaaaggacatgctcatcattcagtcctatgactgttcgacggaccgcatgttccaaggccagaatacggaagcgatcaagggtacccagtactggtggacgggcatatcatttttcgatgctccacggtcgatcacggaaaagattccatcgtcgaccgaccctcagaccgtgatttcgcaatactacgacgcggttgctttccccatggatgacggcgtctggtatgtgaccgtcgcatgcccggcgatgtccgatcatccatatctcgacgaaaacggcaatgagctggcgacggaagacgacagcgctccatcctccaagtactggattagcgtcggttcgatggtgggagtcggcacgaaccaacgtccgtgccggccggttgaaatcaccgtcggcgggcaacgtccgttctggtacatcggtgcggacgggagtaactgacatggctgtatcctgttccaccgacctgatgaaaggcttgttccgtcgccgtgtgcttcctatcgttgccatgctgtgcatcgtattgacgaccggtgcgtgcaatccgactgatgtattgcatttcctcgccggctgcaaggatggctcctcgtcggcggaatcctcatcgagcatggtcgcttctactgcaaagggcgactggacgggactcgtcggcaagaccgaaggcgagatcaaacatatgtggcctagccacgtggcgccatgctcaggctataacgtgctgtatggcggctccagattgcaatgcacttggtgggcgtgcatgcgtcagcgtgccctcggccatgatctgggccaaggatcctggggcgacggcggcagttggggagcatccgccaaggcacgcggttggaaacaaggtgccaaagccggaggcatcatctcttgggcgcccggctcgggaggctcggatggactgtatggccatgtcgcagtcgtcgaacaggtcgatggcgacaacgtgcatatcagcgagggcggtgccgggttcaggaattccaacggcgtggccgctatccacacccgggtcatccccattcacggcacgggcgcgactttctggtatccggacggcaacgacaacgccgagcccgtggccccagataccagcaaacgatcctcctcgtcattggccgccacgtcggcgaaatggacatgctcggcatcctcgtcgaacgattcgacgagcggagcggtgaacgtgaaatacaacggaaacgggtatcatgccagtcctgaggacgccaagggcatcgccaagcagatgatcgccagcggatacaaggaatgggataacgacaacgactggcaggcgctcgtgtggatatgggagcatgaatccggctggcggtggaacgccgagaatcccacgtccggcgcatacggcattccgcagtcctatcccgcatcgaagctcgctgctgccggaaacgactggaaggacaacgcggccacccagatcaaatgggggctgcagtacatcaagcaacgttatggcagtccacatcaggccaaggagttctggctgcgcaacaacgcttactaagattccatgaccttatgtgcctttgcctcacgattacacaatctaggagggctggatagaaaagtgattctgcaaaacatcggcgtcatcgcgagcatgcgacggacggtagattgtggagtactaaaacatatgcatcgtcagggaagttcggcttcctgtggataaaaaggagaatgcttgatgacgtgcaccggcactgaagcaaaaagtctgtcgaagacggctatttcagatgaccatccaagcacgctgggcaagacgagcgtggagaaagtcagcgaaccactgacgaagtccgtgaattaggcagacagaggatgcgtagttatcagcaagcgaatgcctctcttcctattgcccgacagcatttaccttggcgtccgataagaggtttcgaacgttctcttggaaatatgcatgcaattttaaactctacgagcgcatttgaaaagaacaaattccgctgcgattcgtaaaggaaagtaaactcatcaaattcatttgcaatgatgctcagcacctgaacggattaatcgttagttttatccactatacagaattcatataacaagcaagcgttttctggccttcctttttctaccattgatttcaatcaacttatggcaagaaagaaacatgatgaaagtagcagtcttttcagcagggaacaccggattggccacagcagctcatctatcaagtcttggttttcaaccgatgttgtatacacgtaactccgaaaaactacgaatgcttcaatcccatgcaatggaatcgaccggcatactggatggctcatggcatataccagcaagcagggacgcgaagcaggttttgaacggtgccagtctcgcaattgtgtgcacatgggcaaatgcacaccgtgcgattttcgaaacaataaagcacgcatggcaagaattgccacctcagcctttgcggattctcgtgttcaacggtaactggggcgcatacgaagcgtatcagatgttttccatggactacatagttccagagagcataaccatcgctgaaaccgctggaatgccgtatgtggcacaagcgtcatttgacagggatcatccggtgccatcagcgtcagtccatattagtggcatcaagtcctccattgaggtcgcatacgcggccaatcatgacgccgaccatgtcatcgattcctttttacaggctatgtacgccatagtacgctatgacacatccgtcttcaccacttcgctcactgctcccaatccaatcattcacgctccgttatgtctgctgaacatgacgaaaatcgaagccggtgccaattacaagatgctggtggaaggattcacggaaaaacagaacggctcatcctagctatcgatgacgaacgtaaagcgttagcgaacgcgcttggatgcaaatatattccaatcggcaaacagctcaatagcttctggggaagtagctatgcgaccctgcgggagctttttacaaacaattcattgtattcgcacgtccgcggccccgcgaacgtttcgcatcggttcatccatgaggatgtgccattcggcatcattccgctggtcaggcttggacacctgttagatgtccttacgccaaccagcgaggccttatcgactatctatagcatgtacctcaacgaatcgttcgacggtcccctgttcgatatagagatggttgaggcattgggaaaatgacgcgacgccgtttcctcccattcagactcatgcaacaacatgttcaatcatgttttccgagctaaacgtcatttcgccatcatcttgctgagaaattccttgattcggggcgactggggattatcgatgacctgttcgggggttccctcctcgatgatgttaccttgttccacgaaaacgacccgtgacgctacattccttgcaaaacggatttcatgggtcacaaggatcatcgtgacgccggtgccggcgacttttgtgatgacatcgttgacgtcgctgacgagttcgggatcaagggctgaagtgggttcatccagcagaatcacgtccgggcgaatcgcgagagcgcgagcgatggagacgcgctgctgctggcctccggacagctgcaccggatacctgtcctcatacccgtccatcccgacgcttgacagggctttcaacgctctttccctggcttcgttcttggcgacgccacgcacgacggtcagaccttgtgtgacgttgtccagaaccgtcttgttcttgaacagattgtagttctggaacaccatcgcggtcttgcggcgtagttcgagtatctgcttgttcggcactttgccgctgaaatcgatggtggttccatcgacgcggacgataccggcgtccggtctttccaaggcattcacgcagcgcaggagcgtggtcttaccggagccgcttggtccgaggatggccagcacctcgcctttgcgcacctccagatccacgcctttgaggatctcgttcccggaaaaggacttgcggattcctttcagcgaaacgaccgtttcgccggtatcatgtccagtcatacagcctgtttcctttcactgcttcttgaaacgcagcacgcataccggcttgccgtctgcgatggtgccttcgagggagaacttcacatgtgggaactgggccgcgaaggcgtggtcgccggccatggcgatctcgcataagcgggcgatctgctgcggattctttccttggcgtacccactgggtgacgtacgggcagtagtggaagtcgatctcgagctcgtcgtcggtcttcttgaccgtttccatctcgtaaatctcacggttgtggtctgtgccgaaattgtcgatgaactcttggaacgaatcgggatctttcagggtcttgcggaattccttggcgttgtcccttccgtaatcggctaccgcatcgtacgcgaattcgtcatcgaggcctcgcttcgaggcctcgtccaccatcctgctgatggtcgccgcgcggcgttccgagatttctcttgtggcgtcgacggtcttgctgcgcagatgaggagtgttgttttcgaatgccatgatcggccttcttccttgggtttgtttggttgttctgtctgaatgtccaatatttacgcgcgtgccggcttcaggaagaatccaacgcgtttgaagagtcgttccgacccaaattcgatggccgcgcacacgacccagtagatcagcgccgcatcgatgtatgcctctaagtactggtatccgtcggcggcactgatctgcgcggtgatgagcatttcggtcacgttgatcaacgaggctaggctcgtgcccttcagcaaccagatgaagtagttggtcatgcttggcagcgatatcacaaccgcctgcgggacaatgacgtgcagagccgtttgcagtccggtcatgccgacggactgcgcgctttcgatctggcctcggtccacggccttgaccgacgagacaaccacatcagttatgtaggcgccgaaattgcaggctatcgccactaccgccgcggggaaatacgagatgtgccgtggattgaagtcatagatgccgatggaaccgagccattttgccacgaacgggaccgcgtaatagcagaagagtagttgcacggcaagaggtacgcccttgatgaacgtgttgagagcgaccaccagctgtttgaacgccggggcgttggacaggatcacgcatccgaatatcagggcgatcagcagcgcgaacagcgtcgaccagaaagtgagtatcagggtcttcggcaatcccgccaaaacggtggggaagtccgtgaccatgaaatcatagtcgagttccatcaggcgtacctcctttcatagcgttccatacgatgtgaggcgaaggtgaagccgacctcgatcaatgagcacagcacgaagtagataatcgcaacgaggcctagtatccaaagctgtccggtgccgtattgtgcggatatgatcgctttggccgaaccaaggatctcgacggttccaatcgtgtaggcgaccgaagtgtccttgagcacgtctatctcgagattcttcagattgaggaccgcgaccttgagtgtctgaggggcgatgacgtggatgaagttctggactcggttgtagccgatgctcagccccgtctcgatctgccctttgtcgacgcccagatagcctcccctcaacgtctcgcagatgaagcatgaaagattcatggccgtcgcgatgatgaagaagaccccgggatcccagtcgtcgatatccaatccaaagaggtagaacaccttcggcaatccaaagaacacgaggtagatctgcacgattcccggagtgccgcggaaaaacgagatgaacaccgtgcacagccagtagagaacgttatgacgcccgaccctgacgatgcaaagcagagtgccgaagaacagggccagcaccgacggcacgatccagtacagcaaagtggccggtaggtactgcagtattctgggcagcacgcctgtcaacaggtcggacggcatgacgtttcacctcgttccgtcgggtcagtccttgagggcgccgagttcacgggccttctggaagttgtcctgcttgaagtacttctcgctgatcttgccgagggtgccgtccttgatcaaggcatcgatctgctcgtcgatggccttctgaacgtcgccgttcttcctgttgtacaggatcacggttcccgcggcgtccaccggatcggtcaccttgagcttgtagccaagcgtgtcggccacgccatcgtactgcgccttggacagatagaccgcatcgtaggtgccgtcatgcactgcgttgaacatgtcctggaaggtctcctgattggtaacggtgggaaccttaatcttgacatcgggattgcgcttgagccaattctgaatggccacgtaacgtccgtctgtcggaacgatcgggtcaagggtcttgccatcaagatccttcaggctctcaaccttgctgtcttccggaacgatgaggttcatgaagaaatagttatacggcttggaaagcagatactgcttggctcgggcgggggtctcgaagaacgcgccgatcagtgcgtcgtacttgccctgcttggtgccgatcagtgcggtctggtagtcgatgacgctgtattcgaacttgtagttgtcgagcttcttgtcgatggctttaagcacggtgaggtcgaaaccggccggattaccgttcttatccgcataggagtacggcggatcctgggactcgagaacgaatttaacggtcttgaccccgttgtcggattccttcgcgttcgcggtgccgcagccggccaacgcccccaacgagccgaccgccacaagtgccgcgaccaccgtggtgaacaatttgttccttctcatttgtcttcctctcttcggaaagcgttgtcgtgtatgtggcatgacggtacgccagaaaaacggggggaacaaaattctcggtcatatgttttgtttataggcagtgccaacagcgcgaattggagccggttgataactcgttataaccctctttcgtctcattattcgaaaccgtcgataacttttgtgcaggggtccgcagccacgctcgaaaacaggaaaaaactgaaagcacatttctgttcattgcgttttataccaagctcatatccgctataacgcagttcgatagcaagaataccgtgcgctaatcatcaacagggttgcaacatcaactatgttgttcatgacagtgcacttcccacatgcatgtattcgagatgatgcatgatttctgttctagccacgcaaaaatgaaataattcggaactcgaatctaagaagagccttcgccgcatgaccagcaccaaggcaatggtcttactggatgggttaccgaatagtgtccaacataaacggacgaatgttcccatccaaacatgtagacatcgtgtcccgttcatcatggatgggacatagacaatgttttcggcgctgtgcgccgtcgaaaagagcgggaagcggtttccgtgcggatattccagccggaaggagtcaccatggaacgggaaaacggtcagctaggggactggaattcggagcgttggacgcgtatgaggcccgccgacgccttcgcgcatcaacactatcgtccaatcaaggctggtctcacaccaaacagcccaataagcccagccatagtgtttggacagcttgccgacatagaggcgatagtatgagcgggagatgggactcgaaggggaacgagtggacgaatcttaggtttccgaatgggtttgcgcacccattcatgtctcagagccgcgacgggagtgcgcatgagcgtatgcttgtggtcatcccaaagggtgtcattctatcggatggccgcaacttgggcggttggaacctgagcgtgccggcatctccatgggcattgatgcagaagcgcactgggagacctgtgaacatcgggctgcgttccgaccagcccgtcgaactgttcaagggacgtggggccaagcggcaagtaatatcgctggccagccccgaggaactgcgcgccgcgctgaatgagcatcgcgacagaatgcttggtcaaaacaccgttcgtgacaagccggccgctattgcgtacaacgtaattccagcgtttggacaaggtgcggggggaggcctcgctgatgcggcccctcagtcatatgagccggcgaatgacgaaggtatgcgtctattcaatgatctcgctttcgatgtcggtttcgtctcgcggatggatatgctcgtatccggattcgcggacgattgcatccataaccgttacgatccggaagcggccttggacagaacccgctcgttgacagagcaggccactcgtcttctggaaccgttgtccggcgtggtcttcagcgatatggcaatcgattgcgccgcgaaccttgcattgtcggcagtgactgacgcgatcaatggttatatcaacgaactcacggatcgcggtgaaggcaatccatccattatcgcggcgaaccatgcggaatacgtcgaagacgcacaaacctgtctgaacacggagcgatgtttgcgcatgttcaccaccgcgtatggcaagacagcagaaactgatgtatttggcgacacgatgtccatcgagaacctatccatcggcccaaacatgatgacgcgattgagataggggagaatggtcaatcccaccgttccaacaacattcgactctttgaatccacctatctggctggacctgtttttagggaatcagccatcacgtcgatcaatagggaaggatcactttcaaccttgataagtattaccaaccaagccgatatcacggatattcacaatccgaaaaacaagcaccctaagatatcttccacatcgtgtgtattcgtcatccagatgttgagattgaacaaaatccaatttgtacttcttgtagcgaaacgatacgttgttttttgtgacaaaaaagttaccgtcagaagtgaatcacaaggagtgtgaatgctgaagagggtaaaggattggctacagcatagccacatctcataccgcaatctcgctgacgagatgaatcaatcggtgagcggcatttgcaaaaagcccgatggcaaaacctatggcccgtccacgatttgccctgactgaagacacatctggaccatccttacgactttgtcatcggcaatacgccgcggatgaaacagaggaatggaccagagacatcgcaccgtttgagggcagatgtcgaataactaaaaattaaaaagggaagtcccatcccatcggaaacgcaaaaccatcagggacagggcttgcatgcgaaccaatggtcggaaagcctgccggggcattccgatcgtcttacaccccctcgaggacgaagaaaggtccacatatattatgatagctgaaaccaccatccaaggcgtttccaacgtcaagtgtagattgcagatcagtactgaatggtacacattgtctacaacatccgacgaagcggttctgatgtcacgacactggtgtcgaagcatggcacggcacagactcataaccaccctaagtaaaccctataaatgttgcgccgaccattcaagtccgatgacggtatgcgtccgcgtcagacatgcagtttcgaaagaaaggagtgtggaaagagatagagccgtaggccgtaatccaaactcgcaacacggcgattgggacaactttggatgctcggtcaagcgcatcgcggacaacgtcgacaggttggagaacaagaacgaggagggcacaggctcatcggctgaggtggatttgcatacagaacgagggaagcgttccgcttcgatggctgcacacccctccgcaacccattccatcaatggggaagggaagcgttccgcttcgatggctgcacacccctccgcaacccattccatcaatggggaagggaagcgtctgtaatggaggccatgtatatcgtgttcgcggccgcggctctggtatgtctcggtctgttgttgccggtcttgtctcttatcgcgaccgtactgtcagcgctcgtcagcctgctaagaagcatcgccaagctgattggcggtggacgatgacagccgggactcttgagaaggtgtacagactaaacgatccaaaaatcagtccgacgatgggcgcggtactcgcatactacgccttccgctcctactacatggacggacgttgcgcgtggccgtcgcttaccacggtcgcgaaagcgtgtttctgcgacgagaagacggtccgccgagcgctggcccgcctatgcgagattggttacatgaggctcagccccgatcagtcatggaatgtgcgtgacacaaccaccggcgagctcaaacgcaggggatatcgcagcaaggtctatgacgtgcttgtggagaacttcgcctcaatggctgacgagggggcttccgaacgtgccggagaaatggtggaaaggcagaccggtcagaatgcccaccctgacgaaaacgttgaaagcatgccgattccacagaccggtcagaatgcccaccctcagaaaagcgacgaaaacgagagtggacatcctgtcccttcagaccggtcagaatgcccaactactaacaaaagaccaactagcaacccctctctccctacgggaaagctccccgcaggcgggaagcgcatcatcgaggagaagaggatggaacgtgtggaagacgccagcgccgatgtgtggagggtgatggatcgtctcgcttccgtccgttccaggctggcgctgtctacgtcgaaacctaccggacgggattttgcgagaacttcggatctcatcggacgtgttaccaaagccaatggtgataatcatgcggtcgcgatggctctgatcttcgacatcattgactggctgccggcgaacacacattggctcggacgcgttgattccgcacgccatcttgccgacaactgggaaggcatcgccaacgactggaccatcgtccagatcaaacgccgtcgcgaacacgacgaagccgcccggaaccaagatcggaaaacagtcgacaaacggtcgttgattcccgacagtcactcgagacgacacacgcattcgctcctttgcaagcatgtcatcgccgacatgaggccacacgaggatgaatacagccatgagggaagtctgcgctacggcaagccgtcagaatggcagaccgcgtgcatgcggcacgcggacaagctcaaccgacgagatggaatcaaggtgacggaatgaccggagaatccaatctcgtcaccggcgtctgctccggtcttccactaggcatccaggatctcatgtggggcaccgacaacgaacgaatcaaaagcacatccgaccagagggtcctgaaaagcaccgcgcgcatcctgtgcgacatgtgtcccatccaggcccagtgcctagcccaatccatcatcagccgcgagcagcacaacagaatcggcggcctcgatgtcaaggcgcgtcgcatactccgccggcacgccgaagctgatggagtgaatctgtcgccatcgagcccagcgcggacacggaatcttaccgtgtggctccgggagcatcccgaactcgtccgagaggtccgcacgcagtcgaccacccgtgaggggaggcggcgtagaagtgaggaccagtacatttatcggcatcgcaaagcgatgcgggaaaaggccggcgaagcatagggcatctgatgtgccgggcaggcctggtcccggcacgtcttatgtccatcgaacttgtagacaccgtgcaccgcggcgcgtccttcagcaatccaagatggaagcacgggaaacgacagagcaacgtccgattggaaaggctggcgggaatggcacaggcgacacggcagcaggtcaggaacatgcatgggctgattgaaaccatgaaggaacgcgaatacgttcctggtgagtcgaaaatcaccgacgaccgaatcaccgacacgttgaggggcatggccgaaccgaacgggctgacggatgcggtgatagccaagatcattcgcccagacatgggattcgacgagttcgagtccattgccgacttggaggaaaaggcctcgtatgacgtgttcgacacgcttcgtgccattatgctgccttccggctatgacgtgtcgcacgccatggcacgcgcgttcaaacaggatattccgcgccttttcgagcagttcgcgatactgatccatccggcgtcggagcgtgccggggcctatcgcatcgcggccaccatcagttatctcgaaggagattccacgattcgctgcaagcattttgcagatatgctgttccaggtcaagcccgaggacgagatgctccgtaatctctccaccgcgctgatccatggcgtggagccggatcggccatccggaatcgaagatccttccaacatccgaaaccagcggatggacaacgcgacgctcgggagcgactgccgccgaatccgcaacggctatccgataaaggaaaagagcatcatgaacgcggacaacgggtatct

(The sequence listing continues in the following parts.)

What is claimed is:

1. A method of treating a disorder in a subject with the disorder, the method comprising:
administering a therapeutically effective amount of a microbial composition to the subject, wherein the microbial composition comprises two primary fermenter microbes and three secondary fermenter microbes that increase production of butyrate in the subject, and wherein the disorder is hyperalgesia, anxiety, or both.

2. The method of claim 1, wherein the microbial composition modulates a gut-brain neural circuit in the subject.

3. The method of claim 1, wherein the microbial composition modulates neurotransmitter production in the subject.

4. The method of claim 1, wherein the subject has gut dysbiosis.

5. The method of claim 1, wherein the microbial composition further comprises a pharmaceutically-acceptable carrier.

6. The method of claim 1, wherein the subject is human.

7. The method of claim 1, wherein the microbial composition is formulated as an enteric-coated pill.

8. The method of claim 1, wherein the microbial composition is delivered to an ileum and/or colon region of the subject's gastrointestinal tract.

9. The method of claim 1, wherein the microbial composition is formulated for oral delivery.

10. The method of claim 1, wherein the microbial composition further comprises a prebiotic.

11. The method of claim 10, wherein the prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, psyllium, chitin, chitosan, gums, guar gum, high amylose cornstarch (HAS), cellulose, -glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, xylooligosaccharides (XOS), locust bean gum, P-glucan, methylcellulose, and any combination thereof.

12. The method of claim 10, wherein the prebiotic is inulin.

13. The method of claim 1, wherein the primary fermenter microbes and secondary fermenter microbes are obligate anaerobes.

14. The method of claim 1, wherein the microbial composition comprises *Akkermansia muciniphila* as a primary fermenter, *Bifidobacterium infantis* as a primary fermenter, *Eubacterium hallii* as a secondary fermenter, *Clostridium beijerinckii* as a secondary fermenter, and *Clostridium butyricum* as a secondary fermenter.

15. The method of claim 14, wherein the microbial composition further comprises at least one microbe selected from the group consisting of: *Anaerostipes caccae, Bifidobacterium adolescentis, Bifidobacterium bifidum, Bifidobacterium longum, Butyrivibrio fibrisolvens, Clostridium acetobutylicum, Clostridium aminophilum, Clostridium colinum, Clostridium coccoides, Clostridium indolis, Clostridium nexile, Clostridium orbiscindens, Clostridium propionicum, Clostridium xylanolyticum, Enterococcus faecium, Eubacterium rectale, Fibrobacter succino* genes, *Oscillospira guilliermondii, Roseburia cecicola, Roseburia inulinivorans, Ruminococcus jlavefaciens, Ruminococcus gnavus, Ruminococcus obeum, Stenotrophomonas nitritireducens, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, Lactobacillus bifidus, Acidaminococcus fermentans, Acidaminococcus intestine, Blautia hydrogenotrophica, Citrobacter amalonaticus, Citrobacter freundii, Clostridium aminobutyricum Clostridium bartlettii, Clostridium cochlearium, Clostridium kluyveri, Clostridium limosum, Clostridium malenominatum, Clostridium pasteurianum, Clostridium peptidivorans, Clostridium saccharobutylicum, Clostridium sporosphaeroides, Clostridium sticklandii, Clostridium subterminale, Clostridium symbiosum, Clostridium tetanomorphum, Eubacterium oxidoreducens, Eubacterium pyruvativorans, Methanobrevibacter smithii, Morganella morganii, Peptoniphilus asaccharolyticus, Peptostreptococcus*, and any combination thereof.

* * * * *